United States Patent 7,892,730 (COMPOSITIONS AND METHODS FOR CANCER) - sequence listing, part 11

SEQ ID NO: 1051 - DNA, 145025 bp, Mus musculus
  misc_feature (1)...(145025): n = A,T,C or G
taagctaagctttcttctgaaacctggtagtctagaaagccagagtaaagtctgtcttctaattttttttcctcattagtggttttctagagaatcagaacaaagaaacccaattaaaagttctggcttatccttctgcccaggtggctcttacctctgagattgccttcccaccatgtgcctccctctccagtagcagaggacagtttatagacccaaggtcactgagtctttgtccaccctttgtgtgttttgtgtgaaatgtgtgtgtggttaattcagagcaagaatcaccagcaatctgcagtgtaccccaattcctccgtacagaacgcacacaaaggcattcatgcaatgctcctagcatggtagccctatcttagaggtgacagagaaagattttcacgtgtagaaccaggaagaaaaggaagagagaggccacttggggggccttcttcatccccttcattcagtctgattccccagcctacaggggagtgccacccatgttagaggggtatctttctccattcatcttctgcagaaaccctcagatacacatggaggggcgtatcagtgcccacccacgtgcttcatatctcagttgcatggataatgaaagtcaaacacagcttctatttggcctgagattttatggggatatttaattatttttctgtctgcacctttttttttttttttaaagctgctttttttcttttaccattttctgctttttcctgaaacctgaaaccacagcagtagataccactcttgctgggagttgggaactatgtgagcctggctccttctcttttctgccctggatgtacagaagagtttcctgtgcctaaatctatatctatgaacactcctttgagagacaccatgaccaaggcaacttaatgaaggaagggtttatgctggacttacagttcagagtgtattagtcagaaccctctaggggaacagaatgtatatgtatatacacatatatatgcatacaggatttattagagtgacttacaagctgtgttccagttagtacaactatggctgttcctgacagaagggccaaggttccggtagttgttcagcctacaaggctggataactcagttggttttcggtataccttcaaatccccaagaagtaggctctaatacccttgaagtgctgcctcaggatagagtgaaatgctgcctcaggatagattaacttaccagcaagagcaagcaggcaaaaagccacccctttcctcttccctgtcctttttttggaagctgccaccaggggatgaaaccatgatttagggtgggtcttcccacctcaaatgatccagccaaggaaaccctcaccgaagtgcccaatggcttgaatttcagttgactccagatgtggtcaagttgataaccaagagtagccatcacatggaggcataagagcccatcactgttatggtaaggaagtgtggcagcaggcgggtatgcatcaggaacagccgagagctcacatttcaaacaaacagagagggcaaacgggcctgacaggagatttttaaacctcaaacctcacccccaaaaatacattttcttcagcaaagccacaccccctatgctgccataaatggcctcaccagctgggaaccatgtgtacaaatatccaagaatatgcggggtaaggagcatcacattccaaccaccatagaccgtataaagggagcagaaaggtattgggcatgaggagaacttggggctagatcaggtttaaatggtggacttagcttggagtaactatcatgagctaaggttcaagttttctggaatttgtcaatctttgtcaaaaatcccaagcttccattttgttttcttgccagtgtgtggaggactggagtggctgatacagcaggctggcctcacccggaaggaaacaagcaggtgaacaatcgttgtgatcgccacgaggaaagagaatgacggaaagggaatggctgttctcacataccaagaacaacgtgctctgtgtctgtttgcaaaccccaggccttatttttgtagatacgttcattctgagttttcatggtgtcccgacagtgactcttacttgagttctcatttctgcagatacaccaccctcctctcaccagccctgtccttcccagaatccacctcacacctgaccaaaacattcctcaggaacccgttcactgaactttttactgctctgtgaagtcttgtgatttcttccacaatcatctctagggagaaacgtggaattgttgaaaataataaaaaaatcaatatatcacttagtggttctttacaattgtctatgtgtagatcattcacaagaggtagcagggccatctcagcgaggcagggaagagacagcatggcccagggatcagtcaatgctctctgaaaggacagatgaataaatagtcctgatgtgtaggttgtaaaggctcaacaaacgggataaaggcacaaagaggacttaggtagctctatgagttgactatatttataaaaatgtactgcttctaaggttgggactaacttagttgtagaacacatgtgagcacaataccagggttcaatccccagcagtcagaaaaacaaacaaacaaagaaacaaacaacaacaaaatctcaaccaaacacactccttccactaatttaaaaaacaaagcaagagccaggtgtgtgtggtagctcccatccacaatctcagcacttaagaggtagaggcaggaggattgctccaagtttgaggccatcctggttgtattactatttttctatcactgtgataaaaacataacatgactgtgtaaaagttttctagagtagcaacttatagactgaatcaatctctgtctctctctctccctctccctctctctctctctctctctctctctctctctaaattagaatgacttacaggctgcagtccagctaatccagcaatgaataccaatagaaggtctaggaatccctgaggctggttggctcagctagttggtttttgtgtttttgtttgtttgtttgtttgttttgttttgttttgttttttgagacagggtttctctgtgtagccctggctgtcctggaactcactctgtagaccaggctggcctcgaactcagaaatctgcctgcctctgtctcccaagtgctggaattaaaggcgtgtgccaccactgcccggcgcttttttgctgggatttcaactcaggacctttggaagaacattcagtgctcttaactgctgagctatctctccggtccccttgttttgttttgttttgtttttttgtttgtttgattgattgttttgtttttaaatttaatgtatatgagtacactgtagctgtcttcagacaccagaagagggcatcagaccccattacagatggttgtgagccactgtgtggttgctgggaattgaactcaggacctctggaagagcagacagtgctcttaaccactctccagccctcagcttgtctttataagatgctggaagcagtaggcactaatgccagtgaagggaaaggaggtggtagcaaggtgacagcaagctggcaaagagccgaagctgccttcctccatgtccttatatagacttctggcaggaggcgtggcccaggttagatccggattaaagatgtgttttctggacccaagatgtgaattagaagtagatcttccattccaaattaagcagaaatccctcacaggtgtgacccccacttttgagttttagttaattccagatgtagtcaggtcacccaagaacagccaccaccatgaccttgtttgtttggcatggcacagaagcaagagtttatttctgccttggttccagagggacagtcagtccatgatgttgggggacatatgagagcaggcagccagagcaggctgctgaaagataacatcttcaactgacacgggaagcagagagagtgacctggaagcgggagaggttatatacgcttaaagtgtatacaaccccgtgagaatttcactccaacaagccccaccctttagaggatcctaaaacctccccgaaggacacattcatatggggatcacgtgtttagatacctgagcttacggaggacattgctcactcaaaccaccacactgggcaacatagtgagctgtgggccagcagcaactaaacagtgtgatctacaaaaacaaaggaaagcaaaacaaagcacatactggccagtgcaatagagatctccccaaaggcttacagacgattgaccacacacgggccagtggagcagactacagagctctgggataaatccacatgcttatagtcaattgattttgaacaaacgtgtgaagaacacacattgagaaatgacaatctcttaatgagcgctatcagacaaccggatgcccgtaggcagaagcgattcagatccacagcccacctcacataccaaaatcaactcagaatggactgagttaaaagacccaggggtaagacctaaatagaaaaaaaaacaagcaaaagacctcaacaggcatttgtcaaaagaaagcccacaaccataataggtgtatggaaaaaaaaataacattacaaattaaacatttttaaaaaggcatgttaaaaggagctcgcgtctttcagattgactaatgtttagaaagacaaaaggagaagcttgtcaaggtcgaggagaagaaacctctacgctcttctgatttccactaaggaaagcagcttggcggttcctcgaacaaactaaaactaccacgtgacccagaaatcggatggaatctgtgtcagagagtgtgtgctcgcaggtgtgcatttagcacgggtcatgacagtcaagggagaacgtcaaaagccacgtgtggtatcacatgcgggtaatcccagatgtcctgaggtgggagaaggagaattagaggccaggctgtacttcgtagcaagttcgagcccaacctgcgttatctagtgagactcctaccttaaaaaacaaaaacaaaaacaaaacgaaatgtctaagcaaaaaaaataggacctgaagatgtagcataagatggaagcattatgtgatgtgatatgaataaacctgaggatattataccctgtaaaacaaagagtcgtggaaagacaaagatggcatgattttgattctcggaagaactgctgattggctgaaaacagatctggctgtatcctaggctgatggaactcctgggccaccgcatcctaagtgttggaacttcaggaacatggccacgatagaatttacaaagatgtgattgtttgtatatgttgggcccagggagtgacactattagaagatgtggccttgttggagtgggtgtggccttgttgaagtgggtgtggccttgttggagtaaatgtgttactgtggacttgggtttaagacctcaacctagctgcttggaagccagtattctagcagccttcagatgaagacatagaactctcagctcctcctgcaccaagtctatccggatgctgccgtgttccctccttgatgataatgcactgaacctctggtcctgtaagccccagttaaatgttgtacttatacgaattgccttgatcatggtgtctgttcacagtagtaaaaccctaagacaacagggcagtctcacaaaggcagaaaaagaagtggtgttgtttcagttacaagaataagatctatagatttacagttagtcatgatgaccacagtgaagaataaggcactgcacggtgatcagtaccatttggggacacacacacacacacacacacacacacacacaggctttttaaaaataaattagaggatttcactgcgtagccctggctggcctggcagccccctggagcattgagaacatcgggacatgcagctctaatggacctcttaatgccctgagttctctttccagtgatttgtgcaatgagacaagttgaactgcttcatgccgtacatggactctcctggaaattttcttccattatagccccgcttaaggagctatcaaaagtcttgctttttatccttcctggtaagtggtctccttctatgttatcagtaacagttagtgccaggtcctttcaaagaaggtgctcagcagaaactgagctaataggcacttaccactgctctaattggcaggttctcaccatcccattaggccacacccccctgtgctacgcctcctgggaagatttgcatttactttgccttctgcctagaacatgcccttcagatactagttgcatacattaatcttcagtttctccaggtcttccctaaaataccgcaatagataaggtggtttgggtgtgtggaagccaggaagtaagcgcagcagtatttagccatgggctggctaaagcagacaggggaagggaaccaaaataactcttacttacggagcttaaactgtctgctttccactctcaagattattggtttctttgaggatctggggtcactccttggttcgtgcagtttgagggtagagattgtaaactgagattgggcctgctaagtttcaatggcataagaaaggcccaagagacgggccagtgtgtcctcaaatctgggaatatggacagagatttagactgcaaatgaaaggtgcggtagtctccacatacacaattttcaggggtcagtggttgtcctgtaacaagtccctctgcatggaagcacccaaacatcccttcctggagagaggttccttgaaagtcaggaaggaagcctcctcattgtcaggaagtacctaaaacttacaggactctgaagccccgcctccaacgttatataaacagtaacagtggtggaagatagatttcccaggtctgagctgcttgaagtaaattctaacttgctgaactgcatacaggtcattcccagagtgccaaggaagcagagctctagggatgcctgtgctgggttggatttttcaatgatgcatctgcctttaagccaccagcgttcctccaacaccaatacactcactggctcaccatactggactcgagtggagctgttacttggttgttcttctggctcaagcagatgtttgctaatgcctctctagaaaaaaatcacacaagagctacaagattaaaaaaaaaaaaagtaagggcacagaagagacagctcactggttaagagcggcacatcaggctgctcacaactccaggtccaaggggcctaacgccctcttgtggcctccacaggtactgcactcaagtatacaaatggcacacagacatatataaataattaaaactaaagctaaaatatttttaattaattaatttttttacactccatatttcattccccaaagctaaaatattgtaatggttagagttctttgttcaaagagcatataaggttctgtagctgtggagtctccaactaatctgttggtggtctgactaactgcttttgcaaaggcagaaggcgagccaggtacgtctctctggcttttcactgcagtccacatggctgagatgacaacctctgtgtgagagagacattctttgcttttcagtctgggtgattgaggttctggcaatccaggtaagggacagctgccaccatgcctcacctggtcatgatcctgaccctttgccagtgcccagacttccagggtggtctcaagtatgctcaggaggatggcagagattgaagaatacagcagctgcttgctagcccattttacagagacctggaaatgacaatgaggtattgcatatgaatagaggcattgtcccatctgacctcactgacaaaattaaatttcacagacaatgttatttacaaagtcaaggttgccttttgagtggtggtggtgcacacctttaatttcagagtttgggaggcagaggcagacagacctttgggttcgagaccagcctggtctacagagcaagttccaggacagctagggctatacagagaaaccctgtctcaacacctccccaccccaaaaaaaggaaggaaggaagaaataaagaaataaatataaaatggcaattgtagggttttaaatttttcaggagctttggaatataggggcctgtgtgagcacactgtttggatgcccatagaactcttctttcttggttgggatagatagtagttaaaattgtagaacagcaccagttctatatagaaggagaagaggactgaacactgaagccagtggagtaccagcatccgaaggctgggcagagagagcatcctggctgaagaaaatgagtaggaaagtatttggtttgtgaccctgacttggaaaagccttgcaaacacaaatacactggccacataatgccacaagtgttttatctcacaaactatgtattacacagacatccccccccccttaggattaagagtatggctcctatataggactataacttagattatttttgcagcatatattgattgattgaaaaaaaataatgcatgagaaaaaaactgtaggaaatgcattaatgtaccaaatggggtgtactaataatagatgcacagctggcctaagtaaataattcaatttccttgtggcaacagtcatgtctacacaaaagaccacaatggctctgtaacacttatcaagcaagaagcaaaaggcatctctaaaatctcttacaatttccaagtgactcactgagacttaggtcagaatcaagcccaagaattttcgagctacaaagtagaagatccagaacttctacatctgctgagaaccgaggcaggtcagtgatgagaccgggtgggttggaagaagtgggtggaaaggcctctggaggcagtttctgaggtgcatatagcaaaagggcattgcaggtcgcagatggcattacaggccataggggtcattgctagcattactggtccccgccctctcttcctctctctccctctcatagtctcctcatcttctcaagatctccagagttctgcacttacttttcatgttacaagtagtcttctttggtaaaaaccagagcttaaggagcaaggagagcgtctctaatttgtactgtcctttagtgcatattcgtgattaaattcctgcgttattattgatcgcaatgttttttcccttcaagtgagaacattaactatgaggttgggagtatagataagtggagagtactcccttagcccgccaggggtgctgggctggactcctagcatctgagaggcgaaagaggaaaagggtaagaatataaaagaataaaacacacagtggatgatgtagtagtgtcttgtcattgaacattgactaggaacgggctcaggaggcaagtgcttctccagggagtgagcgacaacacccgggcactgcagggaagccaccattcaccagcgtccttgagagcagctgtgcagacccaaggacttggtactcccgccgcatctgcgccccagtccttgggttgtcagggcggcattccttcactctctaccgtcatttccccctttcgtttctttgtccttcctggtactacagtttcccatattgtcttattaaagagtttacacgtagctatggcgtgttttgttcggcctagttccggggcttggagggcaccccgcgaccactccccgcatgtgctccttcgggcgggggcacaggggctctccgtgcgcacgtgtgtcgttttcctcccccacactaagcgggcaccttgcaacgtctcgtcattctgcagattaaagaccctcgtgagctcatagaagccggcctgcctctgcggctgcagcgctccccgcaggcgcggtgcggctcgcccggcttctgccactcccctccccccaacccccccagcccgacttcctcccaggctcctcgcagccggggcggtttgatctggggcgggagcggcggcgtccctctgggcatgctcagtcgcaggctgagcagcgcctgctgaagcagagcgcgggcggagcgcagcggggcagtgccgagagggcagagcggagcttgcggcccgagccgagcaaagccgagcggagccgagagcagccgagtgacggtctccgggagacatgcagatgatgactaggaaggtcctgctgaacatggagctggaggaggacgacgatgaggatggagacattggtgagtgccggaaccggggccagggcaagggggatccggggcggacgcctctgcgcggaagccgaacctcccaagcaacttcgggtctttttcctgcgtccgctccgggcggtgttttgggggcccctgctcccgggttcacgacacacctgagccggattctccgaggccacaggctgcgccgctgcaccagcccgcagagacacaaacaaaagggctggagccgcgggcgcggggcagggacgcggggcgacgccgggcggaggaccgtggcacgtttccatcaggcctcctggatgtcaaaatgttccctctcaaggcctccaaacactttacaaagtaaatttaggagttgggtgtggcttttccttcctttcaggttttgctcacagaccaatcaaaggaatttggtaactcccaggtctagacgaacttgggaattccacgccgcgatttagccttggcctttcattgtgacagcggtttatcaggcactcctctttgtggagagagcaaatagtattcctttttaaggagaggagaaaagtgtgcccaggttagccttcctggagcctcacactgtcaagtagaagtttctgatttcccagagttgagcaagttaaggctctgcacctggcggctgattgggtaaaggatgtaggatgctcttgtctcatgagactgaacagttaagtgaccgtttacataaaataccacccacgggagcagcgttaaaaagttacactcgtattagcacagttagtttcttagggaaatattcttgtctgtcatagtgaggcactcaagtgagatccagccggaatagaaattgacataagcaagaggctctgagtgtaagcccttgctgccctcagatttcaatttagaaagaaaatctaatttggtctagcctctgttacatgataggcatcataggttgtcttcagaccctgccagtaggctggctttgcttttactgacccatgtaattcatgcttgttccacgaagtaaaacagccgatgtagttaactacctctgcctcttcttactgtagcctccagtatttagattcatactttagatagcagacagcctgtttggacaggcaacgtttaagcaggtcctggcaatttttggttgtcctttattgaattatgaatttcatgtggatcatagttatttttttgtcccagacgttttaccaaacctatgaacgtttatgttactacagaattataagccttcttgaaggtttactgaagtaggttgatagactattatgaactaattctaaatccaacagtgggagaggaggcgctggtgaaatggaggactgcaattgaaacctctgcctccaatcttgtagtgttaaagctcttggttagtctctctcttcgggactcctcactagagggagcgttgtatagttgtttaaagcataatcagcgcccatgttaatttctgttaaattttgcttagctttaaaattcagagcaggaaagttactttgacacgaggccccaacgtcatctaaggcaaacctcaaacaacgaaagtaaaccattttaaagtagaagatgtatcacggaggtgttccacccgcgtgtgtgaagccgagtcttctgggaggccgggttgcccggctttataaacagttacttcaggttgttgctcgggacttagagaactaactctggccgttgttcaatatttaggtaccgctttaggtgcaggagtagcctccttgcctggcatgaacccacatggagaattgaaaatggtatctttcccatggttgtcttccttgttaagtcgtgaccatcggaagtaacccaaaaggtgcagtgatgagtgaacccatggggcacagttttttgttttttgtttttttgttttttttcttttcttaaaaacttgctcaattttaccaaggagccacagaagtcctgtgtgggcagcggttgcagaagtgccctggtggagatggctgtaactgcaagtctcggaaatgcagagtggtctgtccttggcagcttttgtctccacactttccacctccagtttgtcagttgattcagcatcacttcctcttgatttaaaacgtgatataggacaggtgagatgactcagggggtaaaggcacccgctaccaagctccaggacgtgaattcaatccccatggaggacgtgaattcagtccccatgacccacatgatgaaggagagattattatacttccacatattctctgaccttcatttctgctttggctctcttacacccccctcccccatcttaaaaaaggaatagcaatagctttcatggcagaatgtagatgctcttggttaatatatttcttcagtgcctctcactcctctatagtttgtataatactatacaaaactatagtttgtatgataggtttaaaaaggcttttattttcttggattacctgtggctcaaactctgctaagggaaagtagtcctagacctggctgctctcaggaaggactcaggcttcagatggatgcgtttgaaagctctcggtttgccgtccgtttctggtcgttgactttgtggtttctcagacggattgtctgtcgcctgggaaatggaccgaggccatgttagatgatggcccagccatttctctgtcctctttcggtgtggcagtctcaggaagacttatctacccatgtaaactattcccgaggtccatttcatgtttaatcatcccccactctagtcctggtctgttggacctcatgaacagtggtggagtaacccttctgggctaagggcagatggctgtggggtagatggggcaaggcacacagccctgtcccagggcggggggtcccttgaaacatgaaaagtcccttgtagagggtggctttattgaagtgtatgcggaactatgggaggacggcaggaaagggaactttccagaagaggtggtggttaggctgtggaaagcctacgcggagcagagatgccaggctggaaggacatggagggactctcctgtgaagaatcctccagacattttaaagatcttgagctgtctgtaacttgggagccctagaaagatgtcttagaagtaaggaggagggagatggtacttactgtaaaccctcccaggagttgggtttagaagtggctgcagtgatccaaggtgtaaggggtgtgtcctggagcttacaggaggaggagcatctccaagcatcccattctagctgtctaagtccgcctcttgagctgagtggtaggaaggatgggtggggtggggtggggtctgtgaagtcatacttttcttggctgctttggcttgggccattgcttccagcctcaattcctctctttccctgtgagtcatcctcctcccaagcctgttggaaactcctgtaggtagtgctgataactgcttctctaaaagaccccagtgcattctcacaccccttgtttctaacctctatatacttagccttcatttatttgttctgctcttgtgtttcatgatctttactcttattatctctctatcacgacatatctactactgtgtgtgctattatttattatgctactgtatgtgtgtgttatttacttatttttattttatcattttggagacacagtgctactcctaggcaggctgtactatttggactctttaagtagctgaggctggctctggactcccgatcgtcctgcctctgcctcctgaacatacgattacaggcctgagccaccacacctgaatgactcactcctgagataattggacataagacttaacggttttatagctttgtagaaatctcttctgtgttatctgaagaatacatactcctagttcttctgcttcattgcacaccttattgccataatcttttactaggctgtaatcaagggtgtgtcaagagaagtcctggtacggaagtagtacagaggagaaagcttggaaccttgccaggctaactgtagagcagtgtgggcggcagagccatccaggaggcctgggaaggcagatgatggggctatgattcctaaagacacaatgggttaacctccaaatgaacccagtactgctactcccagcttatgcattatattttacattcatgtgtgtatgtgtgtacatgcatgcatttttttttaacaaaagaatgaggatttaaaaaaccaaacaaactgtgatcaaagtcttttctctttcggcctggccttgctcagttccacacactgtcatgtctcgctgtccacattctaacttctgagtcaaacagcaactttccaaaatgtcccctagcctttctcaactctttggcaacctcactgttctgcatgtgacaaatgagccctcagagaattattctgaaagagcatgtgggggcggggctgccaccgtggcatgtacggctggttcccctttcccctttagaagccaagaaatttggatcaaacactcccagagacatctccactagagatatggttttaatcctgaggtttgcgggagataattctgtattattaggaattgcctgctatgtgcccatggtagagggtgggattgaactccgctggtagtgtttgtagtgcactagactgaaatgagtgtcttttagtagaagttttcctgtagcgaacgctttgtctcgcatcaccaatacctcttgaccaaaagctgtggtctcactgtgagatgcttcctgttcctcgtcctgatgctttatcacatagtaggtgttttaggaaagcatttgttatagggctgatttaggttttcatgtcatatgatttaagctgcctgatccagtttagacaggacattcaggcctgggtccgtgggaaaagaggctagttttagaacaaagaggagacgcctctaagtcccttcatccgaggcagtgtgcttctggactgatcgatcgatcggtaaactttaagatggagaatgtggggatttaatacagccacacgatcacgatatgctcttatggccattgttagggaaccccagcctcttgcatgcctggcaaaggcaccacccccgagcagcccacccacccggcccaggtcatttctatgactcctttttgcttttgcttggctttgccacttcagctttgcagctaaaattaattggcaccaagaatcccaagaatcagccagtttgaagagcataagaatatggcaacagtggattttggatgtgggccaagcagcaatgaagataccgttcagccaaggcatccaagagaacgtgcacagagagagacaagttgaagggttaatgactgctctccctgcctctgtatttatgggtaccccagccgcatttcttttttatttcttttttttttttttttggcttgtttgtttgttttgtttgagacagggtttctccgtgtagccctggctgtcctggaactcactctgtagaccaggctggcctcaaactcagaaatctgcctgcctctgcctcccaagtgctgggattaaaggtgtgcgccaccactgctcagctagaaaatacagtcttttggggagtccagatgttgcttttatatttaatgcttttattctaggacaccggaactctacaatttgttgcatcttttacaaaaatacaactaattcaagattgggaaaaagagggtactgatcttttaacgttctcttctctgtaatatttcttttaacttggacaactttactactgggtcaaagtcataaatagatgttctttcacaaagcacaaatatgcaaattaaaggcttatttataaagtttgttttgtagaatccaagactctgtttacataattgaaattgttatcgtctctccaaacattgcagctagatagttgacaaaaccttgcacactctcagcaatggctgagttcttcttgtggcactgtcacacagatgcgatcttaaacgttctttttttttctgacttgtgctgattttcgagggaaaatattcgaaagaaaaacaaccagttttattttaaaaaacaattagtactgtattgttttaaggttttacgctcttttccatactgattaaacgtggttgccttcacttgaatcatcatatttctttctgttgcttatgaaacagattcggaatgttccagttgtgtaaaacacaatactctgttctgaagaaaaggaaaggaaaggaaaggagcggagccaggattgctcagtaatgtgtaaagaaatggtagatgttttgtgactttggatgctgcttaagaagaagcagaagtagattttttaagagcttcctgctctctttggggcaaaggcagttcccgaagaacttctatggaggaaaaggaagtcgtccttacagatacttgctgctctttgctgagtgacagctgagtttgtgtcagctgggaagcacctgtggtatccacacggagctgagtgcttcacctgaggccagcgtctcagctgtctcttcagccctgtggggttcctaggagggtgtgggaggatgtttttagaacacacacacacacacacacacacacacacacacacacacacagacacacacacacacccctaccttccccccttcagtagtcagtgttattcatcctctctcttcctcatccattccccagaaactgtgtatcagattttgcgcctctcactaaggccccatgcagtctcttgccacagtgtctccactgcattccatgcttctgccttttaaaggcggtcaggggaactgctcttaacctctgtcaccactggagggttttctctggcccacagctgcttgtttctgttctatcttgtgcacccaggagcttagtgatttcctggctgggggcagtcctgagagtggctgttcttcagtcctgtgtatttaaaggtgagagttaaggaacaatagccaacagtttctgcagaggtaattattgggttttccctatattctcacagttagggttaatcgtgtttcctagacctcgagaagcatattttatcagtaattctttttaggggaacttagctaaaggctataaaagttaatgcgtagtagggaccttaatacatggctgatgaaatatggagattacagccccatcggtagcctctgtggcacataccttgctctggtggttgccagaccatgtttgcaaaagtttgtgtctacctttcatagtaagtgaagaaggagagattcacataggtgactgcggtggtttgaatgaaaatggcctccgaaggcccatagggagtggcactattaggagatgtggccttgttgaggtagatatgtccctgttggagaaagcctgtcacttgggctaggctttgggatttcagaagcttaagccaggcccagtggctcattctctcttcttgatgctttggatccagatgtagaactctcagttccttctccagcaccacatctgcctgcgcgctgccctgcttcctgccatgatgataatagattaaacctgtgaacctgtaagccagccccgattcaatggtttctttaataaaagtaattgtggcctcatggtgcctcttcacagcagtaaaacgctaactaagacaacggctggcttttcttacaagttagctcttggaacgggacaagacaaggaacagagagcgataactggtcaggctcttcctgaacagagctctgcatgaccccgcgggtaattctggaagtacagaatcgtgttcaccattctacagaggtcagcccgtcaggaatcccctgagaggcaggatggacatcctgatgtgtaacatgctcttaaactttccactcattcagctttgaagttctccaccagcgtgtatgtagcgagcacccccattccagtctttctgtctcttaaggtcttgtagaattcaagggtatctggctcttggccttccctgctacatttcttctttgtgcagacttcagggctatagggttgctttgggaatctatggatctggaaaggagaagggaccaggccatgggctgggggattcctcctccattttgaatcctgggaggtacagacctggttagccagaggtctggatctgagggtgaaacctgagcgggcatgccaggacttcttctgaagatgaagaggaaagggtgctcttctctgtgttcaaagattatttctgccatcggtttagtgataacttcactcttattgggccaaagatgtggactgacgtcctgccatgcttcagctagctgtgatgcacactggtagccctgggctagcctggggtctgtcctttgcatggaagcagttcctgggtgggttggttctctgctttttcgtctcatgtcagctgcctggccttcttagttgctcatcattttttcttagagtctttccttgtctgcctccatacttcatcagatgccttagcctggctctgcacagagttgcagagcatgcaggttcacggtctggtccaggcagtcatcagccatgcgaccttaggtgatctacatgaccttcctctgtaaaatggggctgtggcatgcaaggtgtgggaatgtcaaatgagtaacagcatttaaaacctcggcatggtttgcaggattctggtgcctgttgaactgggccctctgcacttgtcaacaatgttgccagtgctttgtgtagctggtttttatctaagtcttaacccaggttactcttggatactctacaaagtttgttcctttttcctaagacagtgacttctacacccgcttttcacgttgtacttctcatttcttactgttactgtctggagggtggtggccctagtcggcagcatggtgcctgatgcttccgctctgatgaataagtaagggaaagatactgactactaaagagctgacataagactttggatagtaaccagcacttgggtgcacaagttggaggattaatacatacaacagagtggatggggcgtgacccaatggctagtcagtcacagccaaagtatgaagaaatgtaagtgattttacagtagtagatgcatttcataacagggttgtatcaccttgatacagttttagtaaggaagataggatatagtataaagggtcaatatgacaaagcctttgataattctaaagatgtgtaagaaataagaccatacatacacacagaacatagcttgatcatacctcatgcttatctctccaacttcctctaaaaccacccaacatgtcccttcaactcatgttccctttccatatggttctccccagccttcattaaatagccactgaggccaattggtgctgactgaatagatatggagcttgggcaacctgtcagtcaccatatcctcaaggaaaaaggagccttccctcttttagcttgggccttgtgagcccctcctcatccatgctagatttttggctgccttgatccttaacaggttttatgtaggtaaccaaacagtgtgttcacgcctgtaacaggtaaccatacccgtgcattcatgcctgtaatggctgcgtcatttatgacattcctcacttccccacctccaggctacattctttccatcccttcttccttgatgctccctgggccaggggtgggagcactcactaacttaaagattccatctgaggctgaggactcagccacttctcggcatttggatgactcctcactgcctgttgcccaccgcaccaagacacttctgacccctgaggatgagcgcgagctgctgccacatttgcacaggttgggaggtgaagttcctatccttctactttttataatagtaggggatttttttgtttgtttgtttgttttgttttttgagacagggtttttctgtgtagccctggctgtcctggaactcactttgtagaacaggctggcctcgaactcagaaatctgcctgcctctgcctcccgagttctgggattaaaagcgtgaggggaatttaaaaggaaaaagtccaaagtgtttaattgcccatgaaacttaaagtttcctgttcattgggtagcatttaaaagtctgaaagttggttaaaagacacaaatagatacaaatagacacaagtagataaagtggaaggtttgcgtttgctttgtgttgttgcccttgtaagctaagatttgtagcttaaatctcctggatttaatgataacagaagggaaagctctgtgtcatttgcaggctaggcgcaggagacaaagctttctcattctgtgttctgagaagcttggggaccactgattcactgtgtccagttgttggagctgggcggcaggagcaccagccggaggacagctaatgcattgcatctcttggggtggaaggaagacgggagttgtgtttacggttatttgactgacccttctgcctttaatagaagtgactcctagtggaagcctaattccattcttcagtcacagtgcctggagtccagcctctgccacgagggccgctcacggttcctgccttcatttaaatgtaaatagtgtttagtgaccactgggtactggcatctataacaggctcattatagcctacaaatcatagaggagatgcgaacacttgcagacaagcctttcatcatgctcagggtaagcgaacaccaaagactttttagcaatcgggtaatcatggttttcctgggcgttacagcggcctcagctgtggcttctggctcgtcccgagctccgtgtgcttgttttgaagagttcaatcgtagatagcgttgactaatttctttgaccaggaaggttcccttgaactcttgactggattgccagcagtgaggccggcttacaaatcaaacctgatgttttttggttttgttttaaatccatatgcatagagattccatttatgctagcacactggggtggtctcaccttcctcgctgtattagtttggtagctttgtaccgaagacctcccgtaggccatgcgtcctatgatgtctgaggatacagaagcaggtagagacagccccacctttggtgcagtttgtattctagatgtgatccgagaaagccaaatgcacgcaagttatgctcatttactgaaagtccctttagtgccttgtgtgtgctaggtatggtcttcgctctgggaattgatcagtagataagacatatggcccctaccctcagcgcatgggctgcctggcagggtgaagcagacgtatcaagtgggtgcagcaagttatatttaaaggctgtaaaaggagagcaaaccaggatggcacagtgagaagagaatcttgggtgtgcccaccactctccagggggagggctttcactggggaatggctggccctgcagctgttcttttcatagttctaaaaataccctgatcttaagggagcatggctttgaaaagcagggctgggtgaagaaggctcaagtgtacatttggcgaacatgtgaaaccctgcctttgctttcaggtttccaggtccagttgccctggggaactagtcgggtgcaggctttatttatgatgatatccgtggtctttcatgcaccttgcagaggtggttcatagtcctaagccccactattccttggtgtgtttgttggctgcaatagctacactgggttagaggcaataaaatacagttgcatcttcaggtcccttcatgatggctttatagttcaacttagcacgatgctctcccttccgtaggtttgaaagggatgctaagacctttgaagtcatcagttgttagtttttctgtattgcccaaggaagaggggagacaatgggtactgccattccctgctcacatctgtgcctctcttgacctcaagggcttggggacctagagcagaatgactcttctggactaagccagcactgagttctcttctctggctgctctcctgggggctatgaatcacttctgtggggaagaggcgggactgactttgctgggagtcacaacccagcccctgagggcatgaatcagaagtctggtggagcaggaaagccccacaggtgactgaggcttggctccagcttctcctgaaacccttgctggagaatctctctttcctgtcagagcacctagaattatatggaagggcgaaagttaaggcttgttttgttctcaggtcgtggggcaggagggcatgagaacaaactttcttctcattggctgttataaacaagagtcctctcgcttgagattctgtgttaggttgtacatcctagaatggcatctcaccttacttgtggttcctggccaaacgggagtcttcttgatgggtgaactcgagggagtgtgagagactgatgctgccttctgccatgcttttgtctgataggagcccactctacggatgctcttgattagatttttaaagttcacttcatatagtgagtgatatgcgatgtaaactgtaaagcttggcagatcctgggtctgactgccacccacactcaggtggaggccacgcccctccacccccacccctaccccacatccctcatttcttttctcagttcaggggaacagtttgaagacctcttctgtaaactgagggtgccagctgttggaattgacccaaatagaacaaagtagagtataataatcttttatgcttgccccttttcatgtcacgtggtatttttttggagattaatctagtgtggttatctattcccattagtccagtgtatttgaactacaagaatatctggaaaagaccttttttttggttaaatcttaacatgctacctaacgctaccttttcattctatttaaagtcagatttcttcctttctttttttttctttttttctctttcttacttttttatttttcttttagttatttttgtggttgtatccaccgctcacacaatgcttttgcttatactaggaagttaactgactttaagttggggaggtgggtacaggcaaactgtactcattttaattgctttgctgtctgaatccaaactcagagtcacttcatacgctgtccctgagtgcccaggctgctgggtgcaacagcaatccatagagaaatacatgcgggtttgttccttccgcacaagaatgtcaagtataataattaatttttccaaaaggtcagcacttgctggcattttgactaaggcatgtttcggacagatattcttagccttcatctggtaactaaagagctctaagaacccaaaactaaaactgacctgcaccaagagaggaggcaggatttaccgttggccccagatataagattccacagtgtttgtccaagcccgtgggttcccagttctcagagaagttacttggcgctggcgttgctttccctgccgcgtgactcatgatttcttaaggctgattagtcattcactgcctgagttatggaggcctaggaactgcctgaatcaaattacagcccccatccacactccccctagagctagctcctgagtcccaattcttagcagggccacaccccagtcagaggaactaattctggctctctgtgagaagccttgaagcactcagcattccccaggagcctagcaatagcctagcaatggccttgagctctgatgccattgcctgcctcccaccgaattcccccatgtgtccatattccttgcttggaaatgtttttcctcggcttagggcctctggttcaatctggctctggtttgtgtctttagaagccttgtccaatgtggtgctacctgcctcctgcttgaggtagacctggggtgtgtgtgtgtgtgtgtgtgggggggatgcctgcctggcttggtgtcccttagtggatttaatcatttctgatgtgtcccaggtgggactgccacattggtggtgcctgaaatcttgcgtctgactgttattttattttcgctgtccttcttcggtcatgttaggactgttggatataagatggtgaaaggggtatggtatgagagagaggctgagcttcagcccgccacctgaaaaagacccagtgctttctaggatgtggggaagtcatatccctcctggtggtaggcagacatgtggatctggcagctgacagatcctttgagaagcagctcccaggggcctcgtgaccttgagcttcctgatgctgacgtagtgaaaatggcacgctgtccaggcttggtgtggatgccttaatcccagagcatgtggctgaaaagctcccttctgtattttacatcatgagaagtggacatcccctcagtgtttgtgagaagccctttagtcaaaaccagcattctgtagtaaactgtttgcatctgatgagtcatgcatgactctcaaccttttccttgcctcatggagactggtgtcattccttagctggcatggccaggtgtctgtctctcacgtcttgatgactgtgttctccgaggtggctttgctcctgcaccctcctgctttttttcagtttctccctggcacaaatcttccttgcagggtctctcctctggcctgcttgaattctgagttcagatagatgaagggaggtttctgtgaagggcagaatggtcttccttggtttaatagagggaaattaggcgtttgtggttaagtgcacaggcagcgcaccctgactgttggatagagctgagacacacacctggttggttttatgtgtggctgtgtgtatggggtactgggtcaatttttaatttaaaaaattaattctgtgaataagtaaactttagggttcactgtcagacttgtgttagagatagcctgtgtgtgacctgttgtttgctttactaataaagagttttatgaattcttacatattaagttctaaatggacagggaagagtcctgccctggatttgtttctgatgctctgataaaatcccactaccggggctggagagatggctcagcggttaagagcactgactgctcttccgaaggtcctgagttcaaatcccagcaaccacatggtggcttacaaccatccttaatgacatctgactccctctcctggtgtgtctgaagacagctacagtgtacttacatataaaataaataataaataaaatcaaaaaaaaaaaaaaacactaccaaaagcaacttagtagcagggaaaggactttatgtctcctataattccagggtataggccatcatggtggggaaattaaagcaggcacttcaaacagctggttatattacatccactgtcaggggcagagagaaatgaatgcatgcatttgtatgtgttaagcgtgatttctgtgctcttaaacagttcaggacttcctacctagggaataataccaccataggtactgcctagggaatgatgccaccatgtgaactgcctagagaatggtgctgcccacagtggactgggtcttcccatattaattaagacagtctcccacagacatgaggccagctcagtatgtagactgccctacatcaagactcttgccaatgattccaggttgtgtcaagttgacagttaaagctaaccatcctacttcctgagttttttttttaatatgttacagtttttatattcttttgaataatgtttatatctattgatttttaacctgtatatcatcccttggtatctgtggaggactggctttaagatcttaaagtcctcaggtgttcaggccctttatgtaagtggtatggtgtttccatataacctacagtatactataagtaaattctatattgtgggaccacatacactgtaaagactgttaatacctgccctggctgttccagtgctaacactgtattccttaggggaagtgtgaagaagtgtgtgctcagcccgcagtaggtgcaggctttttacatttccagtctgaagttggttgaaactctagatgtagatccggaaggcagagaaaggctggctgtgtactagttaggtatctgcatacagttgttcaacaccatcacccatgacttctgctgtgtaaaatatccatttgctattatgtccccagtaatgagagattacccggatagagtaatgactattctagattgctttggagttttttgcagtctaaatagatttgtttctaggagtcctgtgggccttgcattctaaactttaaatgagattgcgtttgtagcattggcccgccgtggtaggctgcagtaaagggtttagtttttctatgtctaccagtttcctctggtttgggtcttaagagaagtgcttttttcccccttgttggagacagaatatcactatgtggcccagcctggccttaaaccagagctcttcttgcctcagcctctctggtgctgggattacaggtacacataaaggtgccaaccaccttggaggagacgagtggaaatcttaggatagtgaacggcacttttgaaagactgagcgagaagttgctttctgtcttgattctgttttcttcattgttgaagcatgagcactaggaagaagtttgtttttgtttttgttttttttaaagatttgtttatttttatttatatgagtacactgtagctgtcttcagacacaccagaagagggcatcagatcccattacagatggttgtgaggcaccatgtcgttgctgggaattgaactcgggacatctggaataagagtcagtgctcttatccgctgagccatctctctagccccaggaagaagtttttaacccaggatctctggactacataggtagggaaagggaccttgaatcccctaagctgcatgggaagtatattctaggtctttttgagtctctgatgaacacagccataattgccttagatgctgaaggggcccccattgcccattctctaggataagtaagttaattgggaggcgttaaggtttcactgcttagtattgtggagttcttaaccagagcttctgcctttagaaactgaattccaatgctgttgccttagccctttccaacgagttcccatgagttgctgtgttgggtgagcataagagaagtgcagaaggcccttccccttccccctccctttgttccttccccttctctccctgacttttgacttcctgtttcaatgactttgggcacaggaagcttaaaacacatggcctggacatggaagatcgcggcttgtcagagcatggcttgtctgtcagagtgcagtttcagaagctgggctggtcctctgctccccaggtttctggagctactctccactgtagtggctctgctctagtggtttcctagctgctaaacctctgcagcaagaatgaccatgtccatacccttacctggcgccaatatcgagcgaggccttgcacctgtcccttgacaggtcacagccctaggttagaacccgctgctgtaactttgcaaaatggatactggatacagtattgtacctggtggcttctccaaactccccccccccccccaagatggtgattgacagagagacccacaagctcagggtgcaggtaataggacactgtggggtgctcggctttataggacatctttatcacacacacacacacacacacacacacacacacacacacacacacccctcctcccaagggtcaggagtcattctggaagaagggacagaaagattgtacgagctggaggtggtgcatggctacaatataacagtgttttctggacactgcagggccattgtgcatatgaaatttacaacagtggaagtagcctgcacaacctgtgcacactataaggccagatgaaataccagcgtgcagggcagaggtgtgtgtggacattaggtatcagcaaattgatagttctggtagatgaagattcattgtatttttaacgaagggtgtggcccctgatggtttgtctactctctcgtggtgaaggtcacatatctaagagtatacgggcaacacaaactgtgctccgtatgttaacaaaaaatggagggtgtaatgttgggtgggtaagaaagggggtgtggatctgaaaagagtgtgggtgggtatgatcaaaacacacgctatgcaattctcaaagaactgataaatgaagaaagaaaaaagaaagcattctggcagcttctgttctcagacgcccagcaagtggctcttgtgggatcctagaaggttctccagaccacctttgtgggcaggtgtcagtcagtattcctacacaccagcagtagaactacctcagccacagttggaaagggtaatacttcttattcagttggaaatgagacgatttcttttgaagctttgtggtatcttgtagtgatgtcatctgcaattttaatctacggccatgtaatttttaatatactgtttggttttttaatataaaaatcaaaagcataacattttttcattgatttgtcatattaaaaacaaagtttaaattgattttttttcctccttcctccttgagttattattgttggtggctcttttatagaaaataccttcctggcattaatctgcttttttttattgtcctcctggcaaatgtttttcagatttctgtctagtacacagcagcgggaaagactcattaggagatttttcggatgttgaaatctctgaataaagtaatgaccctgctacacactgactttccaaccttagcaagctgttggttcttcagagccttttgtatttcctgctatgaaggtaaaatgagatagtctatgcccatggcttggcatagaacctggggctactggctatttatattggcccaataatgtaaatcttctgatttcaaatgaaactactgtgatatataaaataccttaactatagccattcattgaatgggctctcagctaattatactgcttatagaataaatctgttaattataattttccatagaccctcttgggtgggattgcagaagttagattgacattctagtaaaaaggaaggcccaagatcattgcattgacggtgatagcacatgctgcactaatactgctgataagcattacctgtgtaacagagctagggcctggaaataccaagagggaaattagcgtgaagcaatgaattcctaagtctgtctgagtgtaggcacacagtacatctttagttaatttttattcctctggtgacttcattcagtgaatactggggctcactgttcttaatgttgtagtaggaatgaattaaaatgaatatattcatttaccttctgcagtaaatgattctgatcgggaccattcaccagcaaccttctttgaaaccagcgagtgactgaaacccaggggaagtttgttttgtggttttggggtttctcgcactttcccatattaatcctcttggagttcttcaggatttttctaacctgggtcaatagagtgcttgaaatacttctatatttgagaactcaagtcaaagcaaacattgccacgggaaggcgagagcagtggagatgatgtccttggcctttgaggagaagccgagaaggggcctgtgctaatatggaggtggatagacaggtagtcatggtaggtttggggagttggtgcttataagttaattaagcacttggtgatctcccaaatatagacttgtttgcttaagaatacttaaaagtaaacaaggcagtggttggcatgattgcagactagatgacgtcacctggctcagttctgtctttataaggaagtctgtcctttagcccaagtctgaagcttgtgttccaaaagcactggggatgtgagtggagagtgcagcatttctgccatgatctctcacctaggcttgcaatggccacttctgtctcaggtgaacattgatcccatggtgagccttaccttcatgacctcatctaaccctaattaccttccagagcccccagggaatagcatcgggttgacagacaggatttcatgttatgaagttggggaggatacagttagtctccatccccccctccccccctatgttatgttgcatgcataaacaaacaagagcggtataactgcttgagtagctagtatcctggcatcttagtaattttatttcaatttgtttgtttgagacaggggtctcatgtagcccaatctggtctcaaattttctatgtgttgtagactgaccttaaattccccatcctcctgtatcattttgagtgctagggttgctggtctatgccaccaggcccagcttagattttatttttaaatgtgtattatcttatctctattaaatttacttggtcggctcgacaattctgctgcactctccctgagtagaaagctaggtagatagtgtaatgaattaacaagaggaaaaagccaacagtagattaagactggtatgaggtcacttcctttcctgacgttagtaggatcggacctggcttcattgggtgaccttgtggctcagttagggcaaacatgtcttcttaggacaagcgtatgaagttgggaggacatcactttgatagatgagggagctgaagtacagggtgactctatacttctgtgtcatagtcttgcctcttccttaagaaacatatacaggcacaagactctattttcttttgtgtttaaaagactacatgggaggatgaagaatgcgtgaaagcaggagctttttaggaaatcaaaattaaagtaggggtttggagttaattggtgtgatgggtttgtatatgcttggcatgactactaggaggtgtggccttgttggagtagatgtggtcttgttggaggtgtgtcaactgtgggtgtgggttttagtaccctagtcctagctgccggaagtgagtcttcctctagcagccctcagatgaagatgtagaactctcacctcctccagccccatgtctgcctaaatgctgccatgtactcaccttgatgataatggatggaacctctgaacctgtaagccagccccaattatatgttgtcctttataagacttgccatggtcatggtgtctgttcacagcagcaaaaccctatctaagacaattggcctgaaggactatggagggtgagcctcacacagagctgagacaaggtgttacctcagattgctattgtgtcaaacttacaattcactgcaggtcacctgagcccccagagtcttctgaagtggaaagtgttgctggagtgaaagctgttcctctagtcagctggcagccttgatgtggcctgtcccgcctctcaggccctcacctcctctaacaatcaccagtgtctctgcctgcggcaccatggaggacttctgaggcagataaacaacagtgtagatgttaacctgcatcgaagcacgtaattgcaggctgatgtggaggattgtcccaactgctgtgtgtcatagacctgagaggccttgtaaatacaataatgcagtttgaaccagaactcagtttccatatcaaagaagcagaaccccaatatgcataatttaaaaaaacacacacacacattgtctgtgagagtgctgtccctcagggcggttccccatctcgtcacgctcatgaaatattcaaagatagttttaggttgtactctgtttggttttgagtaatccttctgagatatttatttctttggattgcggtctgtctttttgattttggtctgttaaatattccgcaagtaataaaggtttgccaattcggaaaatacctttgagagtgtcagaactcttctcactcctgaatgtactgctgcagagctggaaatcagtgtttacaagaaccggcccattggcaggtcaagtggttccaaaggatttcagcccccttcctttcgaagatttatattttaccctcggtggggccagggatggggcctgagatgggcaggagtaggattgctctcccctgccctaggcatgtgtgtcttggtagtgtgttcttatagactggtggccaggttaaacttcctctccccttataaggtcatgcatgcccagaagcacctggaatgcctcttatgcaaatgaggcatctccccattaaaataagctgtcttactgaagctgcctcccaagagtctgttctcaccatgacctgagtgaggactttcagcccctggtcttgggaggcagtttcagtaggaacataaataagtgcccgtaacactgaatttgggggttcatttcctcttctgttgagcccaaacaatcctcacagttttatgagaatcaaaggtaacagtttggatgtggaagactagcgttctgtgaggtattatgggtgtgtgcatgaccaaaatatctggcagacaagccaatggatggaaggtgtctctgggctcacggtttcagagacgtttcagttcttctggtagggagggcgtcaccgcaggcaggggtggctggctctatctttgaccacaggagcagatgctggcaagtgatcacatgatacagaccaggaagcagaaggcagactggaacaggggtggggatagccagtaagtaagggcctgcttctagtagcctgctcctctaacattctactgctgaagttacaccacaggatcgcaccagaggcttccaaatgtgagcctgcgggggagggagcgagcactgtagatttaaatcacagcaaacttctatttcaatttttgtattttgtttccttgtatttctcctaaggtgatttagtcatcagcatacttaaaaaaaatagatgtatggataaatggtgactctgaggaacaaattagccaggttatgatttttatatgtctttaataaatggtctttttggaatttgtggaaactgtcacacaacaggagagtaccatggttcctcacccagtaaaaagcagaattaccattgcagttttgtggtgtattctggatgtagaacgtgacataacgttgttttaataggggcttagagcacctgtttttgtttttgtttttttttcctcaagactgcatgcctctccttgttctgtggaagatgtctactttgttgagagtgaggtgtacattaagaccctcccatgttgggttagaggtggggaggatcatgggtagttccagctgttcaatatcatcttccttcagttatccaatatcacatctgtcaccggaataaccaagagtattcagagaaaggggaaatttgatggtgcctaatgtctgtcaatattcagtttttaagtaaaataaagactgttcatcagtcactataacaacggcatcagaaggaatcctggctttctccgtggaaatattctgcttacagccgtgggaggtctgaccactgggcctgtcctccctgcatttcatgacacgttagagagtctggccgtagctatgtgaccttcacccctcctgaagctctctctgcagatgtcatcgagggatggagtctattcctaacataagaattgaggccacagaattaaaagatcatttaaatttttctgttttacattttttgatttgttagttttttgagttaatttccctctattgccaaagctggtctccaactcccaattctcctgtttcatacatcatcaatcctggcataaatttacattttacttagtttactacacacataatattgggagtatttctctagagcagatcggaggacatcacatcttagggaaataaatgaagttttaatgatttgcttcatcatgtagctccccaccaggctttctcatttgaagtcaacaggagtccagaccttgattttcaatcttcctccaagccctagctgctcttaatcccattgtaggcagagaaaataaaattcagatcctaaacatacagaattattcattgcttgaaataatttgagagctacgttctggtgccattaataacactgatgtagaatcggagtccagggaagaggcacaaaagattaaaacctccaagcgttagccttagagctacacaagttggaagatacaaggtatcattaagaacccagatttaaatgaataacctcattcaacaggacttcagctctcaaagcaggaagatatagaatgacggtgctctgcccaagttatataaacgtattaggttactttgagtcagttattattcttgttatgcttcatcaccgatatcctagctcctttgtcagtaaactttggagtttggattagatcgtttgtttgagagtcctcccatttgactgtagattagatagcacctgtaaagaggctagggcgtgttgatttatgctttagatttgcaaaagctcttcccaagggttcaaccagccataaaggagagcatccataggtgctggatggaaggaacacaatcaggacaaacctttgctctgaggtctgaagagcctgagaggaggttggttccctgggagattctagaacctgaatttgtaatagtcgcgtataccttctgcaggtggctcaagcaggggtgggggtggggtggagatgatgttagtaattattgccgggggaggaaatatctctgtacctgcagcatctccacttttgcatacaaaccaaatatccgggcagagctgtctgtgacacaagcgggtgccccttccttcattattcagaactaacccagcaccacagctgtttacctggcctttcagtggctgtggctggcagtgggctccaggttaacagtgtagagatttgacaggtcgcgtgcaaacaccacgtgaagggacttgagcgtcaatagagttgctaggtgatgtctgcctgctcaggtccatggctttggctcagtgaagaccagctttcctgcgcccttaccaaccagagattctagaccagcaaacaagagaaagtgaatgttttgactctattttcctcctcccgtggtctctgggcaaacaggaagggtatatttttcttatgtcctttgcggatgtggtggcagtgtactgggaaccattgagaccactaagaaaagaaggggctttatcttgtggcaggagatcatacccccagccctatttctccccttcactggcctttggcgaataatagccttttgtagttaactaagagcatacttggccttagattataattatggcatacacggaaatataggattatatgaccagctgattaatacttggacttgaacacacagacctgagttgggctttgtttcattcagttcccataagatggatcataattatactattaatattgatgatgattataaaagtattgcagtgagccagttcttacagaaggaacaatgcgctgggttcttttctgggtacgcttcttagtgattcctcacaagggtcttggtgggtggctaccaccgtgatctcttttcatagtcagagaagctgaggcactgactaggtaacttagcaaaatcacgtaatttaagagggggctgatcttacatttgaacagaggacctctgtgtctgagttcatgctggttatcattggacctttcccaacagactgggctgtctgggagtgggcagtttgccgcaggtgttataggtactacgagcaactgcttgttggaacgactgaacatatatatgtatatgtgtatatgtatgaatatgggtatatatagagatatatatatccacatataggtgtacacatatctgcttagtagttatttattgaaaagctgtttttttaatttaaaatacatctatttatttatttatttatttatttttggcatggatacatgcttgccacagtgcacacatgcggaggtcagaggacagcctttggcagtgggttctgtgtccaccccaaggttcctggggaacaaagtcaggtaatcagatttgtcagcaagacggtctgctcactgagtgtgtctctccaggccaagaaccaatttttattctcatattctaagtttgattttagaaaagtaatgcaagtactttattattgttgttgctatggtgtttctgtttgtttatgcatttattctgagacagagtcccatatctggcctcgaattcctgcctctcccttgcctccacctccccaaagctaggattgcaggtatttgcttcgacatccagatatttcttcttatcaaatgtttgtcacattttggtagagactgtagtctttaaccttttgactagaagacctagggttaaacaaattatgaaaaactccccacattgcaaatgagaacctaggacctaccaactgtctagtaatgaggtagagacctggattatgcacatggcgtatttaaatgcctgaaagtgaatattcctgctgcctgccggtgttttattatgtgttacctctgattgacaggtcgtgaaacaatcgcgttttaaaaaaaactgttcaagattggacctcacatttgacttttgtattttataattgagaataagctaggttttacttaaaactcctccatgtaataacaacctcttatatttgtgatccaatcaagccaccagtattttaacatgctcagattgtcaaaatgtctatttattagagaattcttaactttatgggcacccgttcctgtaatttatgcatgtcatcccatctcttgccttccttctctctcttttttttttaattctagttttgcatgtttaatctgctggtcatctgtaacccaggtcacctttccacttggagaagaccagtgctcactgcagcagctttgtcctctgccttggacatcttttcctccaggaaaagcagggctgtgagggtggaggttgccatggttaccgttccttgggtgttgtctgtaaaggagataccttggaatcacagacttcttagtttggtaaggaccgctctgaacagagcagcaaaaccagccaggtggtggtgcatgcctgtaacccccacattggaaggctgagacaggagaactatgagtttgggggctcagctcggtttttgagacagggtcttaaaaacacaaaagcaaaacaaaaccacagagaaacaatcctaaactgagaatccccatcagttgagactataatgctgatcccagacctggtgacttaatggcagtgtttgctaagaggagatactggaattgggatagtcctgaatgactccgcctgcccctgggagtttcttcttttgatcctgatgttatcacaggtcagtttatgatcatggtatcataaagttgatgctgtacctgacacatgtgtgcaaatgcattcttgtgcctgtacacccaagcacacatacacacacatgtgtacacacacacatgcatgcgcgcgcacatacacacacacacacacacacacacacacacacacaccatggatgaaggatcatcgtgtactgcatctctatctagccttgttaaacaccaccaaagtgatcatttcagactctggaccacattttcctaaggtattttggatagtttattttcctatctgtctgtctgctgttgcatggtgacctgagataggctgtgctttcccatttatttggttgttacttctgttaatcattacagaatcttattatgactgcctgcatataaatcaagaaaaacaaatttgatttctagcattctaatgtagcaaagcaaatttgtgcgtctaggaagtttgctctgtcaatgtcaggaacagagagaaaataaatgtggctgcaaatgctagctgttacaatcttcttttgaccccaatggccctttaaatagcccaaataatgactgtttgatatttattattaagcatattaaattccttgattaattgaagcatttagtcctcttttttttgttctgtgtagcagtgaaaatagattgttctattatcattcttgctaggaaacataaaattattcataaatgtattttaaacaggagatatattcaggtatcattgggtatacggagcagaaaatgtttcacatttgaatggcaggcacaagattataaatgcctttcctactgaatattaatcactggtggttccatatggctggtggataaagctctgagaggcggcccagagatgtaaattcctaccctactgtgaactttatgcgattagtttgctgtttaaaattaactgactggccttcaaattatttaaaaaagaaaaagaaaaaaaaaaaagaaaattattagccgggcgtggtggcgcacccctttaatcccaacactcaggaggcagaggcaggcagatatctgagttcgaggacagcctggtctacagagtgagttccaggacagccagggctatatagagaaatcctgtctcaagaaaaccaaaaaaaaaaaaaaaaaaaaaaagaaaaagagaaaattattctttttgggaagtccaaaggcagaataggctcaaagtgaccctccatttctcctcttggttggcctttctccttccttggctccactgacttaattcaaattgaatttgtgccctgtctgccctggctctaccatgcctattctctaggggcaatgtggggccatgagctgggcacagacagcctgatcccctgttgagcacaggtcttgaaccctgtgacctggtgggtggtgacttccactacaagggacagcaggtgtttggccatgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcacccaatgaagggcaggtgtgtggccatcagtcatgtaggcgatgccccaagctcctggtattctgtctggactccacccctacagttacctggcaacaaccaagtaggcccaacccactacaaaagggactgcttatcccctcccacctctcttgctcttactctctttctctcttgctcctgcctctcttactcttgccctcttgctccccctcactccgccttcccttccccctctctccacgtggccacggccctcctctgcttctctactcttctccctctctctgcctttatacaataaccgccttaagctgggcgtggtggtgcacgcctttaatcctagcacttgggaggcagaggcaggtggatttctgagttcgaggccagcctggtctacaaagtgagttctaggacagccagggctacacagagaaaccctgtctcgaaaacaaaacaaaacaacaaaaataaacgccttaaaaccatggactgcctcttctcatcgggatctgtcatgctggcgcaatggaacagagccctgcctgcgctctccagccaactcaactgagccaccgaacaagcctaggactcttgtccctgtggtaaccagctggagccctctcctgcctttttctcttcgccctgggccagagtccaaccgcgggcccacactctgggaggttcctagctcttccaaggcatctgtggtgcccaagagtgagaacctgccagtctcgccctctgtgcaggctgggaggctcccccacaccccgcaagcagctcccggaagttcctcagggacctcagactggtcctagccctgtgatgagctggacgcggaagcccattttgacccacagggcaatgctgtgcacatccctgctctagggtacatcaggactccctgtctgttctcctgtggccccattccttctgccccaggatcccgggcttccgataagcatttggtgactgactgctcacagtgcagcctattaccttcactccttcagccacacatccccgctggttctctctaaggcactcactgtccccttacagtgttccatttcctcttcctcctcataccttcacaccgcttggtgctctcagcggaacaccagatccctttaattcttccttctctggtttctcagccaggctcctggcttgctccaagcgaccacatgtttctaggcccgcagagggacgacatcgttgtttgcatctcgttttgctgacctagtcttcccaaatggcacccctttccactccattttcagatttatttgtccagagcaggtatatgaaatgtcaccctccaggtcttttgggaggagaaggacagattgtcctgagaacatgaacagacttgtgtgggagaatgatgtaagcaagagctcacgtcccagggttattagcgtgctaatcaggatcccaaagggacacctctcagaaaactggaaaaataaattaatttttttctataaatcaagcaagtgggaaaaaaaagaaagaaagaaaagaaagaaaagaaaagaagagaaaggaaggaaggaaggaaggaaggaaggaaggaagggagttttgagatgaaaactgttaaactctgcttggttcagctgcatgtgaattatatggtcttagtgccaagcatcacccattatgatggtttgtgtatgcttggctcagggagtggcactcttaggaggtgtggcatggttggagtaggtgtgtcactgtgggcatgggctttaagaccctcatcctagctgcctggaagtcagtgttgtggtagcagccttcaggtgaagatgtagaactttcagctcctcctgcaccatgcctgcctggatgccgccatgttccagtcttgatgataatggactgaacctctgcacctgtaagccagccccgattaaatgttgtccttataagagttgccttggtcatggtgtctgttcacagtggtaaaaccataattatctttcaaaaggatcatgattaatagtggtcattaaatgatttcatattcagcacagggtctggtacatagcaaacataagacattttagtaagatagaaacaccactcgtcacatgtgcaggtgtgcatgtttataaagtacataaagacgaaaggctggtgctcatctacgtacagtgaggtcgagattgcttatttattctttccattactttactaagtaaaaacaagaaacgagcaaagccatcttccagaggataaagccaccgccctgtatgtttcatcccatgattctctttctcgcctgctccctctttaactcttggttcccaaaccttctgacttgtaccatgttcctcgttcacgccggcttctgactgcccttgctgtccatccttgtgtctaggttgttgccatggctcctttaaggtttatggtgacatcacttgtcccagcaggttgagtgttagggacatgtatattaaaagtgtctgattcatatttgtttacctcagtggagtgctttcctcctgagtggggactttactagaagctgaaaatggaacgtgatttagttgctgagcacgcatgccctccacgctgctgacagtcctaacagagggaaaggggcatgtgacttctcgagggtaggaagtgccatgggatccctggtacaggggctactgaaggagaaaaggaagtggtgcctcttggaggaggggcttgggagcgtgtaagtgttgcgttatttctgtccgacaggatagtcaaagtactgactatctgtttcccgaacagatagcacaaaggcaggtagaagttcccagcatgggggctggtgagatggctcagtgggtaagagcacccgactgctcttccgaaggtccggagttcaaatcccagcaaccacatggtggctcacaaccatctgtaacaagatctgatgccctcttctggtgtggctgaagacagctacaatgtacttacatataataaataaataaataaataaataagttcccagcagttttacagggaaccaaggcaggtcgtgggaggatgggctggcagtcagaaggtggggggctgagcttgaggtgggttcttcttggtgcttggcatgtggcagtcacccagaaatgttcagactgcagagtattcctcctcctggtatgtatggtgggcttaggggttcgggattctcagagcttctagataattctttctacgtgtttctgcttttgaggttttcttttccccctagggaaaggggtttcggattttatcagatcctgctaaaggatcatgtgtgaaaagctgagagccatagtttttgaaaaacaaaacaaaaacaaaagaaaaacaaaaattcaagagagtgtgcatgtgcacactcacacatgcatgtacacacacacacatacactctcacacatacactaaatggatgaggacagcgacagagtacagaaatggtttgaagatgctttgactctggctgagcttggcagggatgtccttggcgcccacaggacaggcccttaccggctagaaccccacagggactagtcactgtcatgctctggaagttggctccagatactctttccagatcctcctagcaggctggtttctgcctctttggttcttctctgacacctctctagggcaagaaacatgggtttgaaagactggagagagaatggaagtgccccatgctttgttccgaggtaaggagagcaggcaagtaggtattacaagcgtggttccgtggtgcccgttttccagcagtaaagaaggagtcagcatgaactgaaccctctcagaggcagagtcagtcccattccttcatacccagcagcccatagagagatgctgaactacccagccctcaagatcctgcccaggcagattcctcaccctcagtgcagaataaccctctgcatccctttgttctagtgcagcggttctcaacctgtgggccaggaccccttgtgggcgtcacatatcagatatcctgcatatcatataattacattacaattcatcacagccgcaaaattacagttgtgaaatagcaatggaaataattttacgattggggcacaccctaacatgaggagctgcactgaagggtcacagccttaggtaggttcacaatcattgttctacaacgtgatggaccccggcaaagttgtttgtattttctctttcatcaggcaagcctggcttattgctgatatgcatgcttatgaatttgagctccccagccctaaggtagcgagttcagcttgtgtagtttattgtgcacaaaggaaattcccaacggctgactgttctctggtattcatggcttagtaaggcagagtgtgtttttttatgggaaggaggttgatcttagcaaagataggagctgcctttctacagggagggttttgtttggtgttgatctgatgcaacgtttgatgctatcagctccctaagacatgtgggtaacttcaagtttgcatgtagatcaacggtcatggaacagacacagtgcccattgttggtcacactggacctctgggttctcttgggagcaccatagtcactcagaatcagttttttttttccccccaaagcttgggagctagcctggtagtgtgttcatccttgtcagggtaacagacctttctgaggactctgaggacccactgcagttaaggaatgcaagatttcaaaagaggattatcaaaaaaggaaatgcaagcgtcttgatggtttctctggtatatgaggtcactgacaaatagtgatgaatagttttctattattgaggaacaaagagtaggaaaattctcgtgaactttattacaaggtcctcactggggtcagtgagaaagtacattttcctgtgcttctgtcaccgcgcctgttaacactaacacttttagcatttcactgttggtttttgtttgtttgtttgtttgtttgtttgatttttattagacactttgaacaggaaatggacggaagctcatggtatggattgatcacctgttgagagcagactcagaaccttccatcctgttaaatattcaggagggaagcatgattgtccccacttgtggggtcactaagacagggagtgttttcatggcatgtgtgataatggcagtcctttcggtgtggcatctgcctgagtttgtgcgactctgatcgccttgcttctagatcttccacaatggtgagtctggtgtttccttcaggtcacctccacatcttgtcccaggttcctgtcctgaagacattcactgtctcttgagaacaactgttcacgatccagtcagtcacttgtatgtccagagcaagcccatcagttgtgacactaaggctggcggaggcatgtctagtggtgcaacagatctgagccgcatgctttcttgccagagagaaaaagaaaaacaaaagcaagcaaaacattaccttataataaagataaaacttttaactcacgagtttgggctgccacagggatggcgagcacccaacagtgataggctgcatgaatagtccaccaggtaaattgactttgatccgcatttaacctgctggtgataagcctggcatctcctgctctggctataccacacccctttgtatttgcaagggttgattatgtgagcagttctagagaatttggaaaccatggagaactgcaacaaacaagcaacaaagaagctggaaaatcgcaacagacaagctcacccggctacattgcctcccaaacacaagccctggaaaagcttcggcaagccgcttccctgccctttcaaagggacgtttgtagctttatgcggttcagacatagactctttttcacttgccttgctgacaaacggtccttcctctcactgtatttctttcattgtggtaatatgtacataacatttatcattttaacctttttctaattttccctagcactaagtgtactcagttattcagccatcaacgttattaatttctggaacttttcattatgtattctatacctataaaatatatatcacaaatcacactgaatagctgagtaatattctgtcacatgcatttattgtatcctgtttacctgcaaacacatagtagagtctttttttgtgttcactgccagactttatgtctaagggagtaaacaaaatgcggtccaggggtcggtcagggctggagaggtgatggctcagcagtgaagggcactcactggctgctcttgtaggggaactgggttgggttccaagcacccccatggtggctcacaactgagtttccagggacctgatgccctcttctggcttccttgggcacctggcatgcatatgatgcatagacacaaatgtaggtaaaacatttgtaaatgtaaaaaggaataatgttaaaagtattaaaaatatggtgtgtgttctacaagactttagaactctaggaggaagtggccagcgtcagtcctggggtgctgtcagcacagggactgtgggagcttataaacgaggggaatttggcgtgaagtttcatctatgaagtcattcgttgattattataaatcgcatgcctcagctttttcattttataacgaattataattgtgagctatctgtcagtataaatctcaggccacatttcatagttagcctttgttttctccctaaaggaattcttgtcatcacccccaccccccacccccccaatgtgccactttgtatctctgtttggcctcaaaattactaccctcctgcttcctctgtgttccaatccctgacactgtagatgttgtctcctgcttctctgtaggacagcattaattttcagtgttaaaggtgtatctttagtggctggtggctggagtagtcacccgtcacgctggtgtgtacgtttctcattctctttggcccccagcccatatgctgcggagaggtctctgtatctcagctgcttcttatattggaaagtttctgtttccagaaaacagaaaaggtagtctaggacgccttgctcagctcatttagttgctttcgattttaagaggtaatacatagtctggtgatacagaaaatgcagggacctgtctttgaacaggatcatttttagacagagtgttagcatgggcggtttgagatccgacgaacacttttgatatattcctttcatgatagctgaaagataatgttaagctgttaacacgtacctctacacacccatgcacgtttgtgttagtgtacatgggtttttaggatatataattaatccgccctttaaggccaaattcacagagcaaaaaaaggtgtggaaatttgggtcatgggtagagtcacttgcttgacatgtgcaagaccgtcatcgggatcaccagcgttgcatacatgtagggtgttagcatggctgagttagacatggtgatatcctctttacttctgcataatggctctaaccacaggaccaggggctgtgatagcaagaatcagagggtctgggattctgggaacctgggagctctgtgtcaagtgtcgagcagctgggaaagttccaggtttaaattctagacagtttccggtaattcaaattgcaaagcctttcacagtgttctcaactgtttcatttgagagcggaaggagtgagtcctcgcttcttgttagttttttatgttggcaattccatccttaattaaaaaaaagcatcggcattttcattatgaaaatggctttcctgagtttacagctggaaccactacatttagttgtttaaaactcgctgccattagcctatgcagttacttttatgtaaaagcaacctcaaattgatttagggcattcagggtttggcaatttccattcgctcatgagtcacaggagactgggagagtcaggatgagccacggaagagtctcaggagtctcacaggtccactgccccgcaacaacgggaaaagcgtcacatgttcactgccccctgaagccaggaagagtcattgctgttcttgttcaaggagttgagtctgccttttcttcagttgttattagttgctacggcaaccgtaagagcatcccagaacaggtcttgaaacaacagatgcttcttttcatgcagccctggaaggcctaggtcaaggtgtcaggtcagcctccctgccggcacacagatgccctctcttgtatctctgtatggttttcctcagcacgcacacaggctctcggcacctcttcctgcagcaagaattcttctgactggtttagggtctaccctactagcctatgctaattagcataatctttaccttaaaggctgcctcttccagtagtcatctccgaaggagctgggtggtaggacttggacaccgggattgtgaggagttgccgtccccagccctctgtttaacacagtgttgctttgtttgcatgtggggagattaatataaagaagaaccccaaataaggctccgccaagttcgtgtctgttattaaaggggaaggaggccaggcggaggagaagagagttcagactgctgtgaaggagtttgaaggaaggacattctctctccgcgtgctcttctgccaagtgaccacctcctctgacctccgactttgcactttgcgttctggggcggcagttttctccatgtgttaatgtgtcataaggaggcatccatgcactgactggcctgagatactatgtagcaatccaagtgtgtgtgtgtgtgtgtgtgtgtgtgtgtgtgtgtgtgtgtgtgcctgagatactatgtagcaatccaagtaagtgtgtgtgtgtgtgtgtgtgtgtgtgtgtgtgtgcctgagatactatgtagcaatccaagtaagtgtgtgtgtgtgtgcctgagatactatgtagcaatccaagtaagtgtgtgtgtgtgtgtgtgtgtgtgtgtgtgtgcctgagatactatgtagcaatccaagtgtgtgtgtgtgtgtgtgtatatgtgtgcctgagatactatgtagcaatccaagtaagtgtgtgtgtgtgtgtgtgtgtgtgtgtgtgtgtgcctgagatactatgtagcaatccatcaagtgagtaagtcagtgtgtggggggttgggtggggggatggggttgtttggtcagctattagtgggcattcaggctgtttccggagccacccccactccaactcccaaagtggatagctggattccctttaaagccaagatggaaagaaccacttaataaaggcagtaggtctctgcctttggtgaaaacagtctttgtcttcgcttcctgtttattgttggctagcactgagagaaaaatcttccagcctctccagagaggcccatgctgcgcagggaggggttttccttggccactgaagtcatctcaaccctcagccagccgtgcccaggaataggggtcccgtctgagtcattaattagcaggagtgcccactttcagttaaacagtctttcttgtaaggacggctgtagcatgtgacccgcgcctttctgcctggtcctagtctggcaaggtggcaaggggccgcttcttatggaatgtgggcagtcgtacttctcatcaaagatctcagtgtaggccaggagggccagcaactcctgaggttagcaggtcccatgagccaaccgctgtggcttggatactaaggatggaacgctgctctgtgtggccctgagtttcccacttcagcctctcagccttaggcatcacctgcctttattgtataaactgtgccacagtggtgccgatgcgcttttggtttctggaagtggaaaggctgctcctccgaggctttctcttttattccaggcccacggagagttcattttcacctgggacttctagctgtgagaagggctggcagaggttagccctcttctaaagccatctttagcagtcccaaggaggttccgagatggcttgtgtgtccacgctcatgtttctgaggctctgattttatggacgctacggacatgttgtgcatatgggcttgggtgcaggaaacctgtaattcagcaaacgtttaaaaggctgtctgcagtgtttctaattactgtttgtttgctccaccagtgcctaataagtggatttaagtaacctcaggagcgaggagtgcaatgctcatgttacaggcaatcatgcaaatcaaattctgaccgagagttgcagagaacacactgcagagccattgttagagaagtatgccactgggttttaaatttagaacaagagcagtttggaactttcccacctgtcaggcaaggacgtgaaggacaaactcacctgaaatcaactgctgtctgcagaccatttataagtcaccagcagcctctggcatccggctgtcttcttaatttaacatgggaaggagggagggggagacttaccagcttcctcttcccttctttctcccatccatcattgcctgtataggaaccggaaatgcaggtccggaacactgggcgtcaaccttgggtacggcttggcaccagcttgggaattttcaggtgcccgggaaccgatccccaccccaaggtgctggcgtaatgtttgagatgcagtctacactgggattttaagacggtctcaggaggattattatataccaagattaagccggcagggatttgagaggttgcttcgagcgagcgagcgagagaaatctcagccctggtttacacgttggtaacagctggaggtttgggagagacaaagaggcccatccagtaaaaccgcattcctggatgtgggaaccaggcttctgaaaagctccgggctgggccgtcctggtgtgcagcaagagtctggcccactgaccgacctacctaaccaagttctaacgaaaggaaaatggagagcctggaaggttagaatgacttggtcaaggtcagacgcttgtcgcagagtcaggcctgggacccaggtctgacacctcttctgggctctctgttgcccaacgccagccgttatgtttgtttattgtatttattgatacctcctcgtccttcaggtgatgttcctgactccaggaggccttttctggctcctcatactcctctaccatccggtctgggtaagattcccctggttgtgtttgaacagcacttgtatgtaggtctcccctcacgtggccggttctggagaaaagcccataacgttcttgtgtactgtgtaacttgatggtacgtgtttgttagctccgaggcaccacttgttcaattgcactgccctaagttttggtccacatgggttgctaaaagtaatgagatgctatataggagcactaagtgtatttcctgtggcccactgcattatgggtcaggatccctctggggggaaatgttctgcaaggcaatgttaatgttggcatgattgaaaacaggattttggtgacctcggatgttgctcagggtgctttgaatggcatgctgctgtcagggtgctggtgtgaggatgtctgatggaaatactatttcatggaaccgtgctttaaatcatctttgtgttcatgctgaagatgtaattgtgagtggtcacaagccaaatagctgaattaaattttttggctccgtagatttttttaaatgacaaaaaaaaaaaaaatcgtgtctttcgctgtcatcctagatgtttagagtcatggttttcacggggaaagcattgccagctccgtgtgcttgtgtttccttgttgtggctctgtagcctataggttgccgtgtggctcagtgtaaatatcacacaaagaaatagctgtctttggtggaagattcagagctgaacttccttggaaccagggccactaactgggcagtgttgcgggtagacgcaaggatgttaaggtgttgaggaacaatggccaaaatgtgtagaactactttgccatctatataaacatgtttcacagattcgtggctagcaagggctgccacatccctgggaggtgtggaagcaaaaccatcacacatgagggaaataaaatatttttgttcgattgtcttctgagatggatgtcatgtccctgtgtctgaaggatgtccttaaatacttgagtttcctgtcccctacctccacagtactagatcatgagtgtgggccatcccacctcgctcccactgtaagacgtttccatagtatttcattttactatagtgtacaaaatgtattttgcatcactttaaaaaaatatctagaaaagtttctaccagttttttttttcatatttttggatgaaaaatatttaacaggccagaaaaagcctatcagtgagcaactgttcctgtcagaacttcagaggcatggccgtatattctagaataaaaaggaagagaacacttaatgttctaaacctataaggaacacggttcccacctaggtcacaccgatgaccatgtgtaactgccctgccatttaggactcaagttttacaagtacgtacacacacacacacacacacacacacacacacacacacacaccacatgggaacagttagaactggaatttaaacccaagtctttctgatttttaagtcctgtgtctttggccctgtgatgaggcctccaaatgagactacttattaactttgagcatttactatgttggaagaagagcgcttgcttcagtgtcttagaacttctattaagcaattggtaagttggtgagacgacgattgtgaggtgtggagaaaagcgaacacatgtatacctccatgggaatgtgaattgctgcgccattatgaaaaacagcatggtgggtcaaggaaaggttaagagtagaacttccgcactatcagacagtcgtagtatatacccagaggaaatgaagtcaagatctgcatttccacatgcattgaaggattatttgcagtagcttaaatatggaaatacccatctgttaatgataaatggattaagaaattatgggatatgtatgtatgtgtgtacatactcacttatgtgtgtgtatgtatgtacatgcctgtgactattatggggtatgtatttgtgtgtacatgcctatgagtattatgggatatatatgtgtgtatgtacatgcctatgactattatggaatatatattcatgtctgtatgtgtgtgtatgactattatgggatatgtatgtgtgtgtgtacatgcctatgagtattatggggatatgtatgcatgtgtgtatgtatgtgtatatatgcacatgcctattagtgttattcagccgtataaaaaaggaattgtgccatttgtgatagcatgtatgagtctgaaggacattgtgctaaataaataaggcagaaaggaaagccaaatactgtttatatgtggaatctgaaaatgtcaaactcactgaagcagagcgctgaaccgtggttgtcaggccctggaggagggggaatgggcaggtaccatcagctggttcttaaagttgaggtgagtgagttctaggggtgcggtgcccagcagggtgggaggtggtatatgtgctaatgaacttgactgcagtgatcgacccaggatgtatatgtgcagcgaagccttatggtccgtgaatgggttcggtctgtgccagttgcatattttaaaaggaccacctgtggtttaaagtcatgggtttagaaatttgtgattttattctcagatgtgtttgatttggaggaattggatgagcaaaatggttggtgatctgtgcttcatcgttgagaactgggatttgagaaccccacctctcctgtgtctctgcatcagccaaatgagacattctagcttcattgcattcctttcttcccacaggccctgagctagaaaaacacagcagccggataaaacagttctgccccgtgctcacaaaccttgttttctctgccaggacattgtctgcttccagcgtgggaagcttgcccatcagagccttttttggttcacaggtgggtcccagggtttcctggttgctctccaggagacctcttactaagcttggcgggatgggacgtccttgagggtcactattcgggatccttaggtcatcggaggaggatgagcaaaatggtcggtggtttgtgcttcatcgttgagaactggggtttgagaaccccacctctcctgtgtcccgtgttctagatgagcactctgagacagagtcctgtgcccctgcacagcgagtcacagtggcccgtgagtggaatcccggggttttcttctgtctcttttctacaatgctttatttccctagcttgggaatgctacttggattggatggatgctacttccttgaaactcactcagggctcacttccttcttgtaattacttcccaatttgtcttcccagttcctgctgtctattttctggtcctttgatagcatttccttctttgtaggatgttggaatggtgactttatttttttttcctgctatggttttgcgccccattttctctgcatattcttctgtgcccagggctttgatataacacttttgaactgttttgagcttcaaacactccatttgcctgcttctccaagaacgaagtctagatttgcttcatgtgtccctgactctatcctgcctcctattctggtaccttctctgtctgtggacggacagtgttacctcctccccatctccagagttgaaatactacctacatgaggtgggaaccggtccgggtttctcctttgatatctttttcttttttctttttggatatcttatttatttacatttcaaatgttattccctttcccagtttccactcctcaaacccccatcccatcgccttccctctgcttctgtgagggtgccccccccccgatcgccctagcattccccttcactggggcatcaacccttcacaggtccaagggcctccccttccactgatgccatcctctgttacatgtgcagctggagccatgggtcccaccatgtgtactcttttggtaccttcattccttccagaacctgagttctcctttcaaaatgatcttgactttgtcttctctgtctccacttcagtcaaccttgttagctgcccccaacagtagtctactggctggtgtgcgatgcccactcttgcatcaggcagctctgtgatgctggggtactctgctcttgtctgcctcgcagaatgcgtttcattggagtccatctggattcctctacttcagcttgttcctcttctctgccttcctttggggtcatattggctgggtattgagaggtgtatttgagggtggcctcttttctcttttatgttctttcagtcttggtgactgaccccaaggcattgtcgtgagcacacccaaaccttttctgcgattgcaccatcggtctcccctcctcccctaaagcttttctttttccccacagtcaacttctgtcccattctttcaggtttcagatgtcgttcctttccccaccctgccccaaatagttacctgagatatagtctgacatagcaacctgttaatgtccttcttttctctaagcagagtgagttcccacaaaggaacatcttatggttggtacactgatacatcttttgcatgtagcgtagggtccggcatattgtaggtactggctctcatgagatgtttgaagtgagcatgcactctctctctctttattttcttaggcttgatgattgaccccagagtgtacgtctgcttgtcaagtgctctaccaatgaactctttcttcctttttgtaaaaacgtgtttgtttatttgttctgtgtgtgaatatgtatatacctacatgagtttatgtgtactgtgtcctgaaggacaaaagagggcatctgcttcccctagaattagagttacaggcagttgtgagctgtcagggggtatcaggtgtgcctttctaatccacacactgacactgtaacttatctgtttctcaggtttaggcaccatcctttggtgccagcatttagtttgctttcatcccctcctgccccttgcttctcagttctcatttttttgccagctgtaatcatattgtaattgtactgtaatttggatgagatcaatatccagtgtttactttattgcaactgtggaatcttctccacagatgaaccgtttaatatagtttgatttacttttgcctctcatggttaggttgcacggccaatattgacttttttttcattgttaatctttgatatagttatgaataattcaacctcaaattctataccagttgtaaatctctcttcgatataaccagccacacagggattctgtcaaggtcatctttggaggaagagcctctggaaccttccattgctctcagggcagagaatggtttccacttagcaccttcctgccagctcctttaggctctgtcttgtaggagggccttgctatgtgttgtctttcctgttggttgagtgttccatggacacatttcccagggcctcacagaggaaggctggagttgcagagatggaagagacacgtctgaaaatgccttcctcttcctggattttaactgatgaccttgcactcaaggatgtttctccagctagttcttgacaagttctatgcatcagactctgatcttctgtatataaaccctttcctctgggattttgtgggcttttctttttgagtcctgatttagatcctgttaacatgtggaaacattagcagatccttcgctcctttttttgcctttccttttctttttttaactgttgtccttggctgacctggaactcactgactatgtagaccaatggttcccacgcttcccagggctgtgaccttttcatatattcctcatgttgtgctgaccccccagccagacatcatttttgttgctacttcatgactctcttgttgctacagttaaaattgtaatgtaaatatctgatactctaccctgggaaagggtcagtcagaccccaaaggggctgaggaccacagggtgagacccccatatagaccatgctgtccttgaactcccagcaatcggcctgcctcccaagtgctgggattaaaggtgtgcaccaccacgcctgaccactttttttgggggggggggagaaagtttaatttggggagcaaaatagcctttaattctagaaagaaaaaaaaagtgttatatgctgggatttttttttctttctctatctcagcttgtgaatacttctgtcatctgatattggctcccacactttgcacgattgctctttgatctcttgatccaacttaatgagcatacccggaattggatggctcaagcctgctggtgactttaatttctgccgcagtttgagttttcatagtttttttttttttctttttggtcctccaaatgcttcttgctttgtgtctctttttggtaatgtcttttgttctcgtgtggatgcatttgtctcagatgaccagtctgaagatgtgttcgttcctccctccattggcgtcccctccaacccccgaaccccgacttttatctagagaattttgctgattccccctgcagttccaggcttccttcaccgtgacttggctgcaccgtttgctgttagaaaccctcagtgctggtatttttagctctttattgccctcagctccagctatttatgaaatacttcaaccagagtacaagaggcgaagaagagagggaggaggtgggctgtgtgtgtgtgggctctaggcacttgtgcaggcttcttcctgcccttagcgtggactctctaacccttccaaggatggaggactcatgttagatttctatgagaaaacagaagcagttggagagcttggtagacatcttggactgtcttatctgtcccatcccatcccctgtcacatccccccccccccaacaacccaccagggtgggaaagagagaggggggaggggggaggaatattaactgagacaaagagggagaggtgatatgttaaatagtcccaggatttaaaacaagagataactgatttttagtggaatttggcttatccttctgccctctgccccaccttggccttcagttctagaagaacctgtgtggttgaaataaacttgcctctggcccttcctcatttaggatgggacttctccagtgcctaagccagttgctaagtgcctgtgtgttgtctttcaagcacaggtccccatgtcctctgcccttgttggtttatgtcctggtagttgaagactcactgaaggagtgtctcacagaaacaagctgggactgctgctgagcaggcatgcaatcacacttctgtgcaggccctgactccatttcactggctagggctctgttgaattgggaggagaggtgagtggaggctctgggccgttcctagattgagccccagctctgcaaacatgcccactctctccgagcctctctcctccctgccttaagaccaaggacatgaagcagatgagtgcaagtctctctttattcaccaggcttattttatttaaggaaattaaggtgctctgtaattgaacattagcacagggagcagagacctactgtagttgacagaagaaaacatgaaattaaagttttcctcatattactcaatgcactgattccaaaaacccttcaagttttaactaaaatggcaacccatggttcaggaatcaggaacttgtaaaaggttaaatattctgaaggttccccccaccctccccgccttgggcattgttagctgatggctaagcacactggattcatgttctcagtacccggatgaagtttatttcaattgggaaactaagaaagctaatagttgaggggtgagttttccctttgtcctctggcagtggagacatccccggtagcacctgccaggaactttccttcctgtgagggctctgtatgtggggataatcgccctatctgtagattcttttctctaagttacttttctcagttgagacggaaggcagtgggcatggtctgtctttgtggttttgcctggatggtttgatcattaacccagtagaggtcaccgcggtcagtacagtgactgaggggaaagctgggttgtgaagtcctttaccctgtgacctgaaaaccagagatatctttcctagggcagggttgcacaggttgatctttacagcagagccacccctagcccagttgtcagcccagactctccttggcaaactgcacggattattctgagagtttagcaagcggtggttatttatttgattcttgcactgacatttgggaaccattattttagggacgggaggccaaaaagcaactcagactctcaagtatttgcagaactcagggaaagaaaaacaagacaaaagaaacagaacaaaaaaaaaaaatccagtatgcctgatcagctgaccctctcctgtcaatcattgttcatacccatttctccttcgcagtgagatctccttgctcaaaggtggtagaaaggttgaggagccttgcctcagcatagctctccaaggtgtgtgtgtgtgtgtggtgccagggaaatgctagtgatcccctctcccccaaatagacaggagccggtctgatccaactcacagtagggtctttattctatttaagctaactcagggccccctcaatgcattgccatcatgcaggatggttttggtagtgggggagccccgaatgtctgtggggcaaggctttatagtaagcggcaagcaggagtgggtgtgcaagcatatgattggaaaagctactgtagcctttaacatgattggctggtgctgggagtcatatcataaatgtaatttctgctcccctctgcattggtggtcattaggcaggtttgttgggggaataacctggagatgctggtcttgttgatggtgtaacctggagatgctggtcttgttggggattagcctagagactggagctaagctcgggtttcgtgggggggggggggggaaggcagggggaggggcaacttggacactaaagctaggtaccagcctgttagtttacatgagttcaaaattcaggtcagggtctctgaaatggagtctgaatttaaaagctttggcctctcatgtgaataatacatatgtcatgtgtcatttgaatagtttcagtcacacacactttgtatttctctaagtgtaacgcatgtgtagtgggtggttgtagtatgatttctccgtctttcttgtttgaatgtttggacttgtgcacgtgtgcacatgtgtgtgtgtgtgtgtgtgtgtgtgtgtgtatttgctcctgtggctatgtgcatgtgccatgtgggtgtgtgtgcttgtgggggccagaggttaggtaccttcctctatctctccaccctggtggtttttgttttgttttgttttgttttggaccaggtctatcactgataagctaggttggatggcttctgagaagagtctgcctctctgtccccctgcccctcctccccccagccctcaggttacagataagtgccacaagtccttgtcctttcaagtagcctctagggatccaggctcatatccttgtgcttactgactgagccacctctcagctccctcagccccgttttacacgttaactttgtctcctgtctatgcctgctctcttcagtgaccccttccgttttcctttcactcttttctctgaatagatttgtgtgcgagagactattatcatatggatgcataaatatcatctgcaaagtcaatcgcaggaaagacttagagtctctttagctttatgactgtaaaggattctgcttcttgccattgattcagcttttttgccattgatcctttattagagatcaattagagtcgtatacaaagaccttggctgggccctgagggtctatctcaggctaggccctgagggtctatcttaggctaggccctgagggtctatctcaggatagatggatttaactgcttttctcaagacgcttttactctctcgttgaattctttttaaacttttaattgacattgtacttgcattcttatgggaaacagggtgacccacacacatgtgtacacaggtacacacacagtcaggtcagcatagctggtatgttgttgtttatgttggggacagtcagattggtattgtttttgcactgtgctgtggaacattggaaaaccttatctgatggtgaccctgtgcctactaacagccctcactaggatacattttggagtctctggcaaccacaattttgctctatttccatgagtccagcatctctactactgcatagaagtaaaaaaaaaaaaaaaaaagcatgcaggctgcctttctgtgcctggctaatctcacttaacatgatgtcctctagttctgtccctgttactgcaaatggcagaaatttcatttcagtgtggtaaatgtcacttatgtcattccacagtggtctttatccattggtggatatctagctgattttacatctgggctgttgtgacaagccttgctgtgtacacgagagaatggatgctatagggactcaggttccttctaattctttcctgaccctggcctcccccctcattatttctgagaatcgtgacaggatagcttacctactcatcggcattcctctctccaggtagcttagagtagccttaagttgcttattagcttaagttgctgcctccacctccctagggtcaggtctacaggcctgtgccatcacacccagttttaacagtttattttaaccagacttttttttttttaatgtaaaatttgcctcatttatttgaaagtcatttataacaaattgcatatatattttatgcactatattttattcactgtcccccttaataaaaaaaaatacacttttccattctctgatttctttttaagcttttttatggtaattaattgatgaattttttttaattgacaattatttttttatagaatatattctgcactgggcagtggtggcgcacacctttgactccagcacttgggaggcagaggcagatggatttctgagtttgaggccagcctggtctacagagtgagttccaggacagccagggctacacagagaaatcctgtctcaaaaaacaaaacaaaacaaaacaaagactatattctgatctcctccctcatcttctcccagatcctcccctcctcacactctgtccaaatccagccttcttttactctctctttagaaaacaaaaagacaggctggagagatggctagtgggttaagagcactaactgctcttccaaaagtctgagttcaattcccagcaaccacatggtggctcacaaccatctgcaatgtgatctgatgccctcttctggtgtgtctgaagacaattgcagtgtactcatatacataaaataaataaatcgcttaaaaaaaacaaaaacaaaaagacagacaaaccagaatgaaacaaaacaaacaaaaaaataacaaagacacacaaaatgcataaaaacataaaatgagaaaccccaacatataaacaaaagatcagtaaagtaaaaaaaaaaaaaaaaaaaaaaaaaaaagcccaaaaagctcattatgagacaaaataattcagaaataccattgagtttgttttgtattggccatgtctggctggacatggggcctgcctttaatcctgttaactagacttctatcaaaatggttgtcttagctttcttcattacagaaattccatgtgcttggtacaaattgcaaagtggttttcttcatagaaagccattaaagggtttacaacacaagactactttgtcagagttttgttttcaaaggtcacttagatagctaaaaggagatggggttaggaagagagtgagagtctctgacagacagattacaggtactcgtgttgtgcagagcagtgtgcagggaactggcagcatgagatctgagtgggagaccataggatgccgagtgtgcgggaataaggcagaggggagaggggagatggagaaaaaggagaaagcgcttgtgggttggagtgtgtggagatgtgactgtaggccctttgtaaaacctgatgccaggacatatctatgtggcagaatcacattgactaggggacataggaatctagagatgagaaatgaaacaggagcatgcactagagcagagatgctaacagctgccacggtagcgtgtgggggagctgaagggcttccagaaggggagggaccaagaaaagagtccagagagatagaaggacctcaggcacagaggacacccctgacatctcagcactggggaagccaaggagggagatcctgacttcaaggccggcctcagctactaaggagctgaaggccagggtgtggaaaaacccacaccagaaaacacaccgatggaacgacagcaagagtctttaaagactggcttggtcagctatgacagcgatcactgaggtctctgggaggcaagaaatgtaagacattgggcagaacagcataaaagccatggtcaacggttgccagagcaggttgggagcaaatgcccactggagggaggccagctgtacatggctactcagtatagtaaggacttggactatgggttgttttttttttttttccccttttctctttgtttgtttgtttctttgtctctttgtttctttctttgtttctttgtttctttgtttctctccctctctctgtttctctgtctctgtctctgtctcttcccttttccctgggtatcagtctaggaccttgctcatgctaagcaagcgtgccttcctccggagccatgctcccaacccttaggagtttggactgtgtcacagcacaataaactacatcgggaaaggctgattaaggttgttgttttaacttcttcagataaccttatctttattgttttattctgattataaagcagcatatacttaatgtaaaagctttaagacttaaaaacataaccgagattaacgtccataactattcttttatgtgtagccaccgtcgtttgggatatgccgttcaagattcccgtgagctaacatacgcatgcacacacacttgacaacactttacagtcagtttatggagatgcgggtgggctgcttgcttcctgtgagctgcgtgtgccattgaggattgcagggtcatgtcagacgtgcctccgcctgcagctgaggagtactgctcagttgtactgcagcgttttctggacgtctgagctttgtggtgacattctcatgctctcctatagctttacgctgggtacagttgtgtcttttccctgacagtcttgcaaaggtgccgaagtgagattgtgggttcaaagagcaagtacatgtgatggtttaataatgcttcattactgagaaggaggtgggttttgttgttgttgttgttgttttggtttggttttggttattattgttaaatatagagggaaggcctgtggccatgaaaagtgatggtgagaagaataaaaaatgagttggctctggtctgagatcagaggggaaagccacctgtactgtctggttttgtgtgtcagcttgacacaggctggagttatcactgagaaaggagccttccttgaggaaatacctccatgagatccagctgtaaggcattttctcaattagtgatcaagcggggtggggtgggcccattgtaggtgatgccatccctaggttggtagtcttgggttctataagaaagcaagctgagcaagccaggggaagcaagccagcaaggaatatccctccatgggctctgcatcagctcctgcttcctgacctgcttgagttccagtgctgacttcctttggtaatgaacagcagtatcaacatcagcagtatcaaagtataagctgaataaaccctttcctccccaacttgcttcttggtcatgatgttttctcaggaataaaaccctggctaagacaccacctatccttaaggaggagggcgcaggtgggctgagagacctaggatcctccacattcctgtatccaccgggcttgtctggtgcaggcattccaagaatttttctgcttagctgggtgaacaatcaaagttgctccttccagagagtttagtattgcttccatgtcagagctaaggactggggatttggaagcccattcttacatcatgaactctggcccaattcagagaagacacccaatctaatcattacaaatttgatgtttttattagcatatgttaattatacatagtgggtttcattatgctacttttggtatatgagcatgatgtatttaggtcatcttcatcctgcttgcctctctttctctcttctgacttctctcactgccagttttattttgtagttatgtgtgcacaagctcccattttacccagtgagtttagtttacaggagcgtgactgggagtttgtttacaagtcatgtgtcatacccatggttatcccactgtgggaggtctctccatacctgcataagagtcctcagagataggtaccccagctcctaccatgacaggttgatgacaaggccaatcttatggggatcatgtataagtaactagtaccaaagaccctatatatcttggtcacaggacataaagaaatcaaacacctatgggaggagatacagagaccaagtgtggagcagagactgaaggaacaaccatccagagacggccccacctggggatccatcctacatacagttaccaaacccagacactattatagatgccaacaaatgcttgctgacagtagcctgatatagctgtctcctgagaggctctgtcagagtctaacaaatacagaggtggatgctctcagccaaccattggactgaacacagggtccctagtggaggagctagagaaaggacccaaggagctgaaggggtttgcagccccattggaggaacaacaatgtgaaccaaccagtacccccagaacttccagggagtaaaccaccaaccagagtacacatggagggacccgtggctccagccacatatgtagcagaggatggccttatcagacatcaatgggaagaaaggcccttggtcctgtgaaggctcaatgccccagtgtaggggaatgagaggtcagggatagtgagcagggggaagggggatgggataggggattttcagatgggaaacgaggaaaggggataacatttgaaatataaataaagaaaattagtaataataataataataaagaacagaaaaaaagaaaccaatgtaaatcaatggatcattgagttcagtagtgtggcagccatgttatacccagaagtcaatgctctctgtgtccatggttccccaggtcttacagtctttccgccccttatctctgatggtcctaatgccctggaagagttgttaggaacatctcatttgtggccaggctcaccactgaccactacaaaaagcttctctagccaaagctggctggagccctagtgtaagggcacagattgctatgtcgaatgaaatttgacagggatatcaggtccacttagcaaaaactacagtagtaggttcctcaccaaggcctttgctctccccagccctaggcttttgactggctttataggccagatgtcagttttctcagaggtagcaagtctcaagtctaacctaattaaacagctggctactcccataacaaacggctactgttgctccttgtctgtgtggtcctcatcattgcacaaccacagaatccaagctgagcaaggctattgaagacagtttcgcgctgcagcccatacagcacctgttagctcaccagcaggagacttccagtccagatccactgacttacacggatttctctatcatgtgaccaaggtatagcgtgtcttcaggaataggatcttaccaactagtttcagtgggcaaccaagaacagtggtaattacccgtattgttttgagtctcaagtgtctccttaggaaacaactcaggtggaaggccagccctggagttttgtttaataacctgatggtttcccatagcagttttatctacctacacagaggacctctgttcaaacttttctcagctgaagtttgggctgatcagcttatcagcaatcaagatttctttttgtcctttatgtttatttattttattttattttttttagtttactctctttcccccctcccctcatctctctgctccctgttgtcttaaacctttaaccttttcttttcacttccagtttcccccttcaacctctataccacacattggtatttgcctcctacctttctctctctctttctctctctctctctctctctttccctccctctctccctccctcctacctccctctctcccttcctccttttcttttttttaagcaaagagcttcaaaagatttgcaggggcgaggagggagaagggtacaaatagattaacagatgatggatagatagatgatagatacatagatgatagacaggtagacagacagacagagagcacacacagttgacaggatgcagacagacaaacagatagacagacagagagcacacacagttgacaaaatgcattgtgggcccctccaggaagagttgctcttagactagacacctttaaccttcctttccaaccaacctgcaagacctgtgctgctcgtagctttgtgttgcaacactccattgacttcaactcatagctactgctgctctcattattttagtcccagccccagatttcttaccagcctgacctcttagacggtccctggttcctactaaagcgtcagtcagggcttggtttgagtgcctaagcactgtgcagccatctgccgtccatagatgtccattatttaaagccctcatgtgtgtgttggtagctgttgtatcttttctgtttccaaggtctactacagtaccaaccgagtactaaataagtgataatcaagttatgtgtgcaggtgcaatgatgaggtagacctggcacatgaaaagagcttctggggggtcggaggcaggaggatcagaagttttaggccagccggggtaatttagtggaactgtgtctcaaaataaaaaaggcaaaaagagagctgggtctggaagagcatttgtctagcatgtatgaggtcctaggttaaactttgagctgaaaatgtgtgaggtcatagtttaaatcaccagtactgaagggggagagagagagagagagagagagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagaagggagggataaatttataaggacaagagtagacattatataaactccaaaagggccatcatctgagaatgtttgtttgaccttgaaccaagtagcaggattattgctccctagggaagagtgacagcagtcatgtgtgttaacaaattaaattcatatttaataaatccagaatagctagaatctctaaggtgatatagctacattcacacacacacacccaccattaaaaatgtaaaacatactatattatattttgggtagacatatctgactttagctgcctctggcctgctaagaattattacaagattgaagtctcagttagggtttgcaaaataaatgaatgaattagtagtaatagtaacaataataaatatgtttgggggtcatccaattcagagcctggtggtcccaggcttttcttgttgcccccttggccaccgcagcaacaagaagagtaagaatgaccagctcccaactgccacctcagcaaaataaaaagagtggaaagttacaaaacacgattaaataagttaccagggaaaaagaggtacaaggagctggttggtttccagttttctaagaccttgcattcagggctgagaaatgctatcatcagaaggctacaaggataatcactcagagcccatacaccacagggacagtctctcgagagggctgcgggcatcgatggctctgaagcatcactcctggcacagggccagactctgtggcacacgccctaaccctccacccaagccttggttttcctcagaatggccagtttacccagggtgcttagttagctcccaggctaactgttaccacctccgcctcttcctttcctgaaagactggcaggagagctctgtgccctacatctgagaagttgcctttaggctattggtgggggcccaagaagctgggctgtagttttatgaccagcatcctaagttttgagtgatagcaacttgtgtgtggtggctgtctgagttgttcagttttattttctctgaaatattaacttgagtaaaagaaaaaaaaatgaacccttttagaaagaaccttttgttgtctgtctgagtctgttatttattaactagtggcttaaaatgtttccttatatccaaaactgagaaacgcatttggttggtgagtgcatgcaaatgggatttagatggaggtctctcatttgcgttcagttcattttagtgggggcatttacacgaatatagatgctttcttattttctgcagtacaggcttgaaacagcaccccgctgtgctctgccactgaactccacactcagccccatactttcttaaattttgctgtaacagggcatttaataagctgctggtagcatctcactcagcttatccctatggtatatttcttctcattagcagtatgaatacttgctgtgtatttcccatgtataggtaccaagctaaatattgaacacactatggcttattcaaaccaagccttaggggaaggacaattccattttaaatggtaacgacgatgcttagagaggttgagtttgctgcccagttcagttaggaagtagtaggtccgaggcctgagtgcagatctgtctgtctctaacaaccagcccaacaaagagtgtgcaatcttccgtggagccatccacaagaaatcacggagggcctaacagcccagctctaccttactcctgtctggctataaacaaggagaacacggtgccctcagaggacttggattcagtgtagacttaggacttagacgacaggagagagttcagagggaaggcgacagaatggtgtagagattggaaccccgagcccctggtttgagtgctaggactgaggcgtggctgctttatctaggaccctgggagaggagaagcagctgatttgtgcgtgcagcaccgtcacgtgatgaggcagcattgtcacgtgacgaggctcattgaggaagtggatgaagagaagaatggtagattcaggcgcgcatctgtaaggctctctgtgacaggcataagggagggtaggcgtgctaagatgaagttgcatctgaatgtgctaactttttagtctcataaagtcttaggtcatataattcagagaggctttgtttcatctttgaaaatagcactttcttggcagatggcccctggcagaggggaactttagaatcctgacaccctgtgaggtctccgcccattcccacccaccacggtgcaggtctccagcctgcagagggttctgattggggagggtggggcatggggctgagctaccctgtttctagacatttcctgctgcctgggacagtccaactgacaacaggttacagatgtttttaagccttctttcctcccttcattgtggtaaaatatatataatctaaaatgtaccatctcactgtttgtaattatatagctcagaggcataaaatacattcacactgtcagcaatcacccaagtccatcttctttcatcttggagactattttcatctcacacccatcaaacctcgctccccatgaacccccccccccacccacatgacaaccaccatgtcatgtctctgtggagttgatctctgtggtactccatataaatggagccatctatttatgattttatggcggcttattttacttagcggaatgtccccaagattctcccatgggtttccttccccttatgctagcatattctgtcttggccacgttttatctgtgtgtccatctgttggtagagttgggtagctcaactattcactgttttgtaaatgctgcattgctacacgcggtatggagatatctatttgaacttctgttttcagttttggggaaacaacccagtttcataatatagctcccctcccaacccccactgaaatacattaaattttttctgggtggctattctctaagttatttaaaaccacccaattttgttatcatacagctgtattctaaaagattcaagcacctaaatactgctttctttatgtactggctggttttgtgtgtcaacttgacacaagctggagttatcacagagaaaggagcctccattgaggaaatgcctccatgagatccagctgtaaggcattttctcatttagtgatcaagggtggaaaggcccattttgggtggtgccatccctggactaatagtcttgggttctataagcaggctgagcaagccaggggaagcaagccagtgagtaacatccctccatggcctctgcatcagctcctgcttcctgacctgcctgagttccagtcctgagttcctttgatgatgaacagcagtgtggaaatgtaagctgaataaaccctttcctccccaacttgcttcttggtcatgatgtttgtgcaggaatagaaaccctgactaagacacttaataattacaaaatcaagaagtataactaatattgaagatttctgtgatctatcaggttgctcaccaaactaaacacagccagtatatatgtgtcctctgacgatgcacgttttggtaacttttttttcctgctaatttaactatgaaaaatatagtatcatttctgatttttttttttcatttaactcaaatttaggatagagttgcttgtaggtgattggtaggtttgttgatggagcgggcactcagcctgtgagatggtgagagaatctggagccccttccctcttccggttggtgtctgttcttaggagctgtctggcttccctctctgcatgtctatggccgtctgctgtgatgggtttgcgctctgttgtcctgtgaggggaaacattcttagttcttacagaatcgtagttcctcaccataaaaactcagaaactgctagaaggaactgtctggtcatgcttttgattgctctgcccgacggatttgagcccacttagtgaagtgcttgtttaagggtgttgcgctaggaccggccgaggttgtcttagtctacagtgagtacgtgcatccgttcttccgtttatggattctgaagatgaaatgttttgttctagaaggtgtaaaatagggggatgtgaacctggttctttgtttgctgtcccctctcatttttttcaggctgtaataactgattttgatgtcaggcctactctggtagatgtagcatggcggtgtagtttgggttcatgggcagtagcagagtgagtggtgccttttttttttttttttttttccccatctcagggcatttatgtcactagacccaatcccacctgagctgcagccagcagcaaggtctggatggtgtgcactgagaaccctggtggccccaggggaccgaacccctcagatgtaaagcaactgtgagccttccaagatgtgattaggaggtgtttctgtaatgaagaccatttgtcttttctggagcctccgctttcacagccttgacttaaaaacaactcgaaaccagcacaattaaataacattacttttcagttatatagtagattattttaatttaaagatgtgtattaaatgagaaaagtttgtagcactgtaaacgtcgattatgtgtacttcagtgttccccaaagtgcccaagacagttggaggagtcacaggagctgattttaaaacttaatgcagagtcacatggagacacatgagtctagttctaggactcgggaggcagaggcagaggcagaggcagaggcagagaggcagaggcagaggcagaggcagaggcagaggcagaggcagaggcagagaggcagaggcagagaggcagaggcagagaggcagagaggcagagaggcagaggcagaggcagaggcaaaggcagagaggcagagaggggcagagaggcagaggcagagaggcagaggcagaggcagaggcagaggcagaggcagaggcagagaggcagagaggggcagagaggcagaggcagaggcagaggcagaggcagagaggcagagaggggcagagaggcagaggcagaggcagaggcagaggcagagaggcagagaggggcagagaggcagaggcagaggcagagaggcagaggcagaggcagaggcagagaggcagaggcagaggcagaggcagagaggcagaggcagaggcagagaggcagaggcagaaaggcagaggcagagaggcagaggcagagaggggcagagaggcagaggcagaggcagaggcagagaggcagaggcagagaggcagaggcagagaggggcagagaggcagaggcagagaggcagaggcagaggcgcagaggtagagaggggcagaggggcagagaggcagaggcgcagaggggcagaggggcagaggcgcagaggggcagaggcgcagagaggcagaggcagagaggcagaggcagaggtgcagaggcagagaggcagaggcagaggggcagaggcgcagaggggcagaggcgcagaggggcagaggtgcagagaggcagaggcagagaggcagaggcgcagaggcagagaggggcagaggcagagaggggcagaggggcagagggacagaggggcagagaggcagaggcgcaaaggggcagagaggcagaggcagagaggcagaggcagaggcgcagagggcagaggggcagaggggcagagcgcagaggggcagaggggcagaggggcagaggggcagaggggcagaggcgcagaggcgcagaggggcagaggggcagaggggcagaggggcagaggggcagaggggcagaggcgcagaggggcagaggggcaaaggcgcagaggggcagaggcgcagaggggcagaggggcagaggcagaggcaggtggatttctgtgagtttgaggccagcctgctctacagggctacacagagaaaccctatcttgaaaaataaaccaaaccaataactgcagaaaacttgatgcaaagccatggccatcagcagtgtggcagtgcagcagagtctgggtccagaagtgaagtcacgccttcatggctgcctgatctccacgagggcaaaagggagacaggggtctcttaacaagtgatgttgtgttaactggatgcacacacacaagaagactgatgctgggttcctacctcacactttatataaaaattaactcaaagtcaatcagtaatgtaagagtcaaaaccataaatccctcagaagaaaacagaaacaaatcaggtgaccctggatttgataacagcttcttggtgaaacacaaaaagctttagcaacagaaggagtataaagtagatcgttgaatttcatgagaaccttgtacactgagggatattactgagaaatgagacattttaggaatgataagcagaaatcatgtatacagtatgtctttaatagctcgggtatataaagaattcctaggctccacaaaaagacaacccataaaggtcttgagttgacaggtctctaaataatgtgcacagatgtgccagtagcaaatgaaacatatcacaggagcattgatcacgaaaggacatcgaattcaaacctcagtaccattttgcatctacctggatgtctgctgttgcaatgcagacacacacacacacacacacacacacacacacacacatgtatatatacacacatatatatgtatatgtatgtatatatgtgtgtatatatgtacgtatatatgtgctgatatatatagcggcaactgtggcaaactatttggtagctcctctaagagctaagaagtactgtttgacctaccaattctcgtcctaggttcctacttagaagcaaagtagggacttgggtggccactgatatccaccgaggcactgtctgtaagatcccaaagacggaagcaacccaggcatttgccagcagagaaccgagcaaacaaaatgtggtacatgcacatgtacaatggggtcaatcataagaaggatcataggtgggacttccaatcattgcagagtgaaatactgagatagacactagactgcagagatggctcagtggttaggagaactggctaatcgcccacaggacccagattcaattcccatcttccacattgtggctcacaaccatcttctatgccctcttctggcctctgtgggtactgtatgcacacagtgcacagacatactcacaggcaaagtactcatacacatgaaataataaatgcataattcctggtgcatgacatatgtggaagaaagcaactgaatcggaacagaaagatgttagagattgtcaggcagagggaaggggaacagggagttgttgcttcttggttacagactctctgaggtgattgattgggtaacagtggcaatggttgggtgacattgggagcgcagtcactgctactaaaaggtccgctggaaactggctaacatcacagttgggtatataagtgactgctagaaagcgtcagttggttaaagaaccatagactttagtatgtctattgatcgtgagttcacaacaccctgtggcgttctctgtaaagcattaaccagccacgtgggctgttgaacaaaccgcatgatggcgttctcagctttcctgaagcacatctgttgggcctaggatcttttcagtgctgagttactgcggaggggtgtggtgacagaatgtgcaaagagagtttcccctggaccccttctcgaggaggatgctgttcgtggatgaaagtcatctgcggaattagtttctcttagactgaaaccaggaaggacagaggctccctcctcattttgttctaccatggaatgccttgttctcctggctagggagtttggggacagagaatcaggtagggtgagaaggaacttgactcttttcctctggcaagtgtttgtcaagtatttgcagaatattgagtgagagacatattgccagtcctcctttgtgcatgcaaacctaaccctaaccctgtggcccagggcagcacgtttcttcttatgtgagtaactacacgcattaggaagacttctggggcaccgggagctcctcctagttttctgtggctgtaatagaacaccgtgaacagaagcaggggagggtggggtttctttgtgcttacagtttatatagttcaccgtagaggaaggcagggcaggagctcaaggcagaactgaagcgtacatcatggagaagtgctgcttacggacatactctccttgggttttcccagtttactttctaatacaccccaggcaccccaggactgcctgcccagggatgggaccccccccagggtgggctgggtcttctcacatcaatcatcagtgaagaaaatgccccacgggtaagtctggggcattttcaaaattgagatttttctagccgactctagcttgtgtcaagttggaaaaaaaaaaagcaaaaaactagcaaacacaattgactgcttgtcactacacacacacacacacacacacacacacacacatacacacacacacacacacacacacacacacacacacacttcactattaaagtataatcttccctttcttgctcatccaaagatgccatgttaatattacactattaagcagatgtttgaaagtcccacagtttttaaaggaaaactcaacactttaaaataaagttcagtttctttacaacatctaaagtctctcaactcttcctaaaaatacaatgtttcttaactgtgggctcctgtagaataagttgcatgcttatttcaagagggacgtgggagtgcatagctgagtctgaacaaaggaaaagcaaactgtaagccaaaccctgcagcttattgccttgcatctggggctcgttcatgatcttctggaaccaaagtgcgtgggcagctccagctgctgggccctgccatgcgcagttcacacagtacaccttagagtctccagcaggctcctctctgtaactgctgctatccttggtggtcacccaatagtcctggcatctctaacaggctgtgatatgtcacaggttacacctttaccagtgagactttacacctggcctctgagactctgaccctgccacagggtgctaagcctcagctgttctccaagacccttctgtcctggggtctccgcagctcctgaggctgtgtgtcttcaccagtggcttctcctggcctctcacagtgccaagtctcagctgttctccatgacccccttgtgctttcataactggtatcatgtaggggtggtaacagtcgggtaacttacacattacttaatccagctgccagcttcagcagctgcctcagctccctctggacacagcttccttctgtgtgctgacacggaggaacacttccagaagatgaccccccccccccagcctgactctgaggaacattcccagaagatgactccagagacactggtctcttcttaatcacaactgatttctcagctccagctgaccggatgcacatactcttgattcacaacagcactcaaaccaccccgattgagtctttcaagttttctctggatcttcacaagccaggcctctgtcttctgcactactcccagctttatcttccgagttccccccacagcagctcaataaactctgtttacttgatgactttttcaccccaaaattccaaacttctttttatagacatggcccccaaaacaacactgacaaaacctaaccactacactactaatatttttctcagttatcactctgagtgaccctattataaaaccctgtggtaactatctgtagccttgcaacctcctgatagtttgagagatggcattcattttgtcaccagagtacaggagatactgttaaactgagcacagagaaagagacttggaagctggagaccaaatgtgcaggtcaaggatggtgtgggatggataggctaggtggttaagtgacatgggagtgaggtggggcaggccagtgcttctggaaggcaaaggatgctgggaaaagtgttggaagtgtgttagcatggcggctggtgagggctggctttgcggtcaagtatcggatacccaaggatccaaattcctgaggcttctatcagctgggcccagaacattccaggtgtagaaagaacatcccggtcctgcctctacctcctgagtgctgggattccaggtctgtgccacctcacctggcgtgttactctgtttctatctggccatttgttggcatagttttttgttgacacttttgattgttacttacaatgttatcttaatttctcatcaactcacatttaatagggtatccatagaaacccagaagacaaaaattaatgtatcttaaagatgtataattctggaatcagacagatgcagaatccaattaattgttttacttttagttgttgatttgaagtgactgacaaccttaaatttattatttatgatctgaggagataaggaaaaattaggaatacgtatgatcgggatttttggaaatgccagcacatgccaggaaatgctccgtagtcttgcatttccatttttccacattgttgagtttgcatatgcaaactgaatttgtatttacatagtattcaatttaaaaaataatgactaaagtatgggtgttttgcctcctgcatgtttgtgtatcatgttggtatcagaagacggagggcattggatccccagagcttgcatcacagaactgagtgtgaggaactgaaccaggtgccctggaaggccagccagcacttttaactgtcaagccatctcaccagcccctcattttttttaaactgtcactagtatctttgtactgccctgcgatatcaccagggagatggttatcgccagcttgggacaaatatgctgaaagaaagcagactcagcaggtagcatgaggacttgagccctatcaggggcccttagtccaggccctttgcacttggttctgtcattgttactcttttatcccagtgctgggtgttgaacttggagcctcgcacatgctaggccagtgcttcatgccagagctacacccccagctcaggccaggcattacctgctgtcttatatatttactgtgggttttgtcatttcagtggcagccagtcaccttgatgaatgagtcagctagcctccgctcagtgcccatgcttgttcagtgcagtagatacattgtctcccagtacgttagctacattgtctcccattttaattacctttattccagagctctacataccagctactttgttccctcaaccccccatggactttctgagaggcggttttgtgttatctgatagggaataggttgtctgagctataagatgatagagaatggctctttattggctaccttgtatcacagtttcaatcactgttgtagtacaggttatatctgtttcgtaatctggggagtaaattccagtcactcttttttaattggtacacaagtaaccacacgactgtcacttctttcatgaggctgccaatgtctttttattaacccattaatatggccaaacctctacgctgttgtattgggtccttggttttacagtgctgaacaagccagaatagctccacctaaaaactttattacattaactatattgataaggttttaaaactatgcttagttcctttgatttaaactaattggtaggtacctggtttactgttaaatttataaaaagtgggtattttataagcttcttttgacctaaacattcaggtttttgatttttactcattataatccaatttataatattttatttattttacgtgtgtaagcatttttgcctccatgtatgtgtaccataaacatgcctagtgcctatggaggtcagaagtgggtatcagatcccctggaactttagttaaagagggttacagatcaccacatgggtgctgagaattgagtttgggtcttctgcaagaacagtcagtgctcttaactgcagagccatatctccagcgtctggttgacagtattcttatagttctctgtaaatctgtctagcctacaacttacaaatgattctgaagttagcatcaattatgtcttgaaaaggggtcttagtcgccttagggctttaaaccaaggttttggcattttctgtgtttgggtgagcctgatgctcagttgccgattcactgcgcctctgcacagaacgccattgatatgtcaagactttggcttgcgcctagaacactctctctagtttgcctttgataggtgggtaacatagatgtactcaggactttttatgttccaagttttgaaattaagtgaactgataagagcattcatggtagtttgcctactatttaatacaaagcttatgggcagtactgaaggcacattccaaaatctattaagtaatgtattattttaaagagagcatgtttgctttttcaaaagtttttcccccacccattgttttaataaattctcaggttttcatcttaattttaaaactattttttttttgcaaagaaatgatttttttccctgtttgtgttaggttatcagaaatgagagttccaaagacctcctgagccccctgaatagaggaagattaattattgcattagcatcacatatcacctacctcttagctgtgttaggtcctggggaaaatagctgaggctttgtcctgcccacacgggatgccaggaaagccatttttgtttttatttcctcagattacgtttttcttctgtgttgacattagctgcaactgtgttcattttcattacgagaacagtgagagctctaagccattctctacctccacaaacccattcttctgtctttgtgcctgggatttaacagagccctgggtcctaggtcttgtttcctctgctatatgaatgccttgttctgaacgccctcttaagtctatctgcctgggcagaggagaagagaaggaatgaaagcgaacacatggacctcggatccataatagacaaattgtacaggtcatactgtaagaatccagagaagatggcaaacagtcacgccacctgatttatagtggtcttataaaaatacgcacagtgtgatatttcattaactttctaaagcactagaccatacataccacgttttcagtatcttcactatctctgcagttaatgctgtacgaaggttaggtcttttattccagggtgtgaaaccaagctgcactccggctgtggggaacctctcacagcctggtgtacagacaaccgtgtgttaggacagtcgttctcatcctttctgatgccacgaccctttcatacagttcctcatgctgtggtgacccccaaccataaagttattttcattgctacttcattactttaatttttctactcttatgagtcacaatgtaactacctgctacgtaggatgtctgatacaagaccccggaggggtggagacatgggttgagaaccgctcttttaggacactgtgaaggtggttgcaggaatatagttatttgggacaactgttctttggctgttgaaatattcaactcactgtgaccctactctctgaactcaactggtcggatggaaattgcagacctcctgggcatcagagccactcgtcttgtcacctttgggagctgccttctctcgccttcgtttcctatttcttctctggtacttacatagagggtcctctgatggactcttcagaagaggtggccacctgcttgtgctggctgccatttctgctggcctttctcttcaggcatagggatactaacatgtacgttaagtgtgcaaacaaaggtattctgtgtgaatcaaatctgtaattccaatacggggatttttttattttattttattttattttattttattttaaaaaaaggtacaagtcctaagtaatgtggcagagaggagctgtctcaactcttggctgatgacttggctttgtaatgctctttcagtcagtctctcaggaatctccctatgcaagctgaggtggttttctgtttttgtttttgcactgaaaagaagaaaaaaaaattgcatcaataggaaccagtgatttcacaaatccttttaatgtagtcaagaaatcagctgtgtagtgactttgaaaattcatactactactacaggtagaattaaaggctgttcctagctgttctgtcaggagcatctgaggatgtgtgctgctaaatgtaacatgtacctcggctctcttcaaatccttaacctgtcgcttttcaggtcggtggcttattgaagagacgtggccctgtcgataaatgagaatgtctgtttagaccttttccaacagttgacgctctgtcagcaaacttaactatttaatgcctctttaagggtgtttctttctatataatcaaagttacatgattatatagtgacttctagtataatccaacactttcttgttatttgaatttttctgcctttttcaagtgaacacgaatgaacaaggcaagttctgctgattagcctccagcacagaacattttttctttttctttttttcattattggatattttctttatttacatttcaaatgttttcccctttccaggtgtccccttcagaaaccccctatcccatcccttctccccctgcctctatgagggtgctcccccccccccgcctctatgagggtgctccccccccaactcccatactcctgccctggcgttcccctacactggagcatcgaagaccctcatgcccaagggcctttcctcccaatgatgtccaacaaggccatcctctgccgcatatgtggccagtgctatgggtccctccatgtgtattctttggttgacggtccagtccccgggagctttggagggtctgactggttgacactgttgcacccccctacaccccccccatgggtctgcaaaccccctcaagctccttcagtcccttctccaaacactccattgaggatccctgagctcagaccaatggttggctacgagcatccgcctctgaatttgtcaggctctggcagagcctctcaggagacagccaggactgacaggaggaggctcctgtcagcaagcacttctgggcatccacaatagcacaccaggtttggtgactgtatatgagatggctaatgtccacttatcagtgagtgcatatcatgtgttcttttgtgactgggttacctcactcaggatgatattttcaagttcaatccatttgcctgtggtgattatggaggtctttacttcaggcttcttcaaggctatttgatctagaatccatagagtgcatagattggtctgcttcctcagggtccatcacactgggctgttctttcatttatgtcagggtcttaattccaacacaggggttgacatgatagaatgacccacctcctgaacttgactcttctacccaaccttacactgcagtcaccgaataccatggccagtagtctcctctggccgctgatcttttgacctctggctcatctattctgagatttgtattcataatagagcctggatccccaagacttagtccaagaaaaatgtaaaatagttcacggatgactcttaatatagactatattcatattattcaaatgtattcaaatgttgatgttttgctatggattaaattatactattataaaatagttcactagtaatttttaatatggactatgtttgaagtgttaatgtattattattggttaaattatgttattataattaacttcacttgtttgttattagatgaaagtatctactggaaatttttacttggctcccattaaaatgtctgtcagatactgctcttcaatatattttaaaacagaaactgactgccctcgtttgcctctccatcagtttcccgagagaccagcaggataatgacttccttagctgcactacaacatttaattgcagtggagaggctggtaattttccatgctagatgcagcctagagcattttgagacctagccacatgcatgaactagttgctgaagatgtcggtagtcggagcgctcaatcagctcaacctgcagacgggcctcggacgctgaggtccatcgctcccttgacctaacttatttactgtttctctgcagtgctggaaaactttgaccagacaattgtctgccccacctttggatcactggagaatcagcaggacttcaggactccagagtttgtaagtaacacatcttaaaattatttgtcagtaagatttttctttgagagacacattctattcttcagtggcttagtctgccacaggacccctcagggactattgagactttggtgtctctgaggcgcaggtgaactgacctccagcatcccagcatcctgagctctggatttgatttcgccccctgtatgtgatttcggacaggaactcatcccgtagtaaaagaacgaggcgatgtttgcaaagcttcctgcttcgttggctgatttctgttgctcttggtttctgctttcgataaccttggaaatcagtcttgactgagcacagatgatgctctgaccaatgcagttattcatagtgaagcggcctgtttctcgtttctgtcaggaaccttcagtaatgcaaccccagaaggactaggaatatcttactcgtttctaccaagagggaaactaatgttctcacggagtcagacattgaagattagccatggctcctaccctcaaggaattaaaaatcgtattagatgctactgtgattttattagtgccttgtttaaagaaaattaagcatgtaggatgtcttgcagaatgcctttcaaagcagattttatattagtctcctaaagtgcttgtctctctgactcacgccttattaaggcagcagagactcagggaagcatggcagccttgactggatttacctggtttttaccttcctgtgaatgactagtctaccatttgtattggcaacaaaagtgtgtgtgtgtgtgtgtgtgtgtgagagagagagagagagagagagagagagagagagagagagagagtatgtgtctctgtatgtgtgcatgcacgctcatgcttacatgtgcatgtgtgtctttgtacctgcgtgtatatgtgtatgcatatatcttttggagggtttattttcaaagtgtgatgatattaccttcaccgctccagcagttggcagagtgtgactgcaatactgattctgtgtgccccccctcagttacaaacttaattgtacagagtgcacaccatgctgtggactgagaaggactgcacataaaactgtacccacaatgcaggttcatttctgagtggggctcctgcagtatccttgcacagatggcctgctttgaaaagcacttgggtcgtaatatagagacctggcactcagtgactcctgttacagcctgtgtgagtgccagcgaaggggaactgagtacacccagtcgttccccatctcgaagggcagagcagtttgatgcaaaggcaggaagcgctgatacagactccgagagccactcgactgttatccttccgaacgtattctagttgaaactttgtaaggatcataactaatgtgacgaggggtgtgtgcagccaggggttggtgtgcctggaaacacacatgctttacacccattctctgcgtgaaaatgaaagttttctcagcagcttctagtgtactgagttgctggtgcttggctcgccccagcagcagctgcacggatagagggcagtgcacataacccgtgcatcatctaaagcagcagccttagtttcttgactttcatggttttcattcccaaagttagaagactggctagtctaagatcaaacgaccacaagcaaagtctagagtcaccaacggcggctgccttggagagacttatttccaccatggttctgaggactgaggaaccagaggggggctccccccccttttaaaataacctctgtttggcctcaagaatttctgcaagtcattttattagactatcctgttgataacaatatatacaattgccctgtaagtgtaccagataacatatctctgtgtccctgtgttctgattgctttttgcaaacttgactgagatcaagacacacccaaaaagagtgaatctcggttgaggaatcaatcgcctttattagattagtctccagccatgtctgtaaggcacttttcttaattgctagttgatgcaggagaaccataggctgctgtgtgcagggacctccctcagcaggtgggcatgagttgtagaagaaagagagccaaacaggccagttggttgggctctgccttggttcctgccttaagtgtcctgtcctgacttccctcagtgaggaactcttactgaatgcatgagctgagataaaccctttgcttaccaggctgcttttgatcagcgttttgtcaagcaacagaaagcctggttactgtctttctctaattacatgtgcttaccatgctcagggagcaattattttttaaaatatgttttaaagtttattcttgtaaaattttatatatatgtatgcatatatatgtgtgtgtgtgtatgtatatgtgtatatatagtatatatgtatgtatgttatatgcttgaatactatgtgtatgtgtatatgtatgtgtgtatgtatatattaaatgtatgtgtacatgtatgtatatatcatatgtctgtctgtatatatctatgtatgtatgtgtatatttcatatgtcagtatattatatgtactatgtatatgtgtatatatgatgtatgtttgtatgtatgtgtatatgtgtatatatgtgtgtatgtgtatatattgcatgtctgtatattatatgtatgtatgtatgatgtatgtttgtatgtgtacatgtatatatgtatgtatatatattgaatgtctgtatatgtatgtatatatgatgtatgtttgtatgtatgtgtatatgtgtatatatgtgtgtatgtgtatatattgtatgtctgtatattatttgtatgtatgatgtatgtttgtatgtatacatgtatatatgtatgtatatatgcatatatatattgaatgtctgtatatatatgtatatatgatgtatgtttgtatatatatgtttatatcatatccctgtacatattatatgtgtgtatacatatatatatatgtatatatgtatgtatatattataaatttgatcatatccaccttctacttccccccaccaacatctccctgacaaatcactaccatatctccctcccaacttcatttcttctttcccttcacctgttcactcaatccagttagtactttcagtgtggacatggatgtagggccttccactggcgtatggacagcttacagggggtagggcacatccctgagggaaacagactccccctcagccagcagccagcagctaataggttctctgctggtgtggggacttgggaaggatttctttatgttcccaggccagcctgtttgtgatgctcatgacacataagttcttgtgatgcctgtaaatagctccttgtgttttcctctcagcaccactgttgccagcactcctggccttataatcaacatagctaccttatgctgtctctgtggtaaacaaacaggtcacagaaggggatcccttgggactaggaccctccagggagctacagtgttatatttaagagaaggcctttatgtaggcaagagggtgcagcactggggaagacagtcctactgctagaggcaggtgagcctggctaatgccaggacatcaggtaagttgattgaaatctgattgttaaactggggccgatggtgggacctgggagtcagaggttttaatggcaaagcagcatctcaaacagtgctggaaaagagaaagagaggttggaaaagtcagtttcctaattttcttcccatctggcctttcggaggatcacttgctgcctgctgaattgaagggaggcagagcgcatgcttgcttgagccttattctcaaatagttgaggttttaggtggacacagagagagccattgctttctgtgtaacagtgtatttatctagtttgcttcacggggacaataaggtgctttcagagtgattgcttcagaagatagattttagagctctgttagttggccagccttggtctctggcatcagaaggaatgacacagctcatgagcactgtgattctcaggctgaggcagagtgtggtaattgagtagattggcagccctgtcagctgcctggggcctataggcagtagcagctccacctccctctcctcttcctccctgcagctctgtgtctctgccccccttgcccagaggtctgtccttgctctctcgcctactttgcaggtggcagctatcgaggtagccaaaatactagatggttaatgggtgatcatagatgcagatatgttctcagttatgtcagacacacgggagctggagacttgttgaaactagtaataacataccatcattgtaaggtgaggcagatgtgtgtgtggggagtcaatatgaaaaggatgtgactaaatactggtttacagagacacttggtgatcttgtacggtaggacaccatttcagtcctggtgcagttttgcttgaaaatgtaaaaatagttaacattatattatgaatgttttcccaatagtgctatctttaaaaaacaaacctcttggggctagagagatggttcagtggttaagagcactgactgctcttccagaggtcctgagtttaacttctagcaaccacatggtggctcacaaccatctgtaatgggatccgatgccctcttctggtgtgtctgaagacagtgtcagtgtacctacataaaacaaatctttaaagaaacaaacaagcaaacaacttgttactgttggtattgggaggggtcacaggtgccttggcactcatgtgcagaccagaggacatcgttgtggaggacacctttctcttcacctttatgttgggttctagggattaaacccaggtggtcaggatttcatgtcaggcagcaagaagctctgccaatgaagctgccttgcatcttgcagaggacttctgtgctcttgtattttttcagtattatctgatctcttccaccagtgaagcctgactcttcatgttatagttgctaaggcagttagttcatgatcaagagaaacagccatataagtaatggctatcatttggagcatggctgggaatagatgtgaggattatgattctggaactgggtgcctgagcctcaggtcatccagaagaggtcagaattagtagaaggcagggtagacaagatggcttagtgggtgagggcaccagcctccaagccaggtaacctgggtttgatccccaaaacccaggtggggggaggagagaaatgattctcacaggttgtcttcacacactcacgcacacactcactaagcataagaagaagacaaaccagccaacccagatgctattaagaacaggccacagagttagaacttagggttgattccatcctgctggcaatagaataatgttctgctccctgactcccagtcttgtatctggttatgagctctaagggctaaatccaagggctagtgagtcttgtctggccatgtagacttcacgcttaccccaagtggctagggagtcatggctggacctgtagacttcacactcgccccaagtgctaaggagtttgaagttagggtcaggagtggggagaggtcattgacccaggaacttatggtggtctgagcacacacagttgaagaaggggtgtgggggacgttgatctaacatcattacagccgtgatcaacatggaattacagggatggaaggttaagggactgcgctgtgatctgagctccaccatttcatccctaccagcctttgcagaacttgaagtttagggacaggaataattttaccacttctgatctcatgttaacttaagtttttcctcgttgcttagcttctaccaaatccggagtaaataataaaagctggactggctaaagaatgctacaataggataaaccaggaaggagaactgaagtcttaggacttaatagctagatggggaaacagactcagatggacgagtactgaagtggaagctgcctctctccttaattaaacatcatggtaccctcaggaaagcagagatgaagagtctgtctccatttaggatctggggggagctggctcctctttgaagggtagttattgcttgtgacatattgagtgagaatgtccccctataggctcctgtatttgaatagttgattcccagagggtgtgccctatttggcagaggggggggtgtcacccattccagttaactctccgccttgtggtcatctctcagtgtgtaagctcttagttactgctcccagcactatgactgcctatctgccgccatgccccttaccacagtggttagggactggaaccaccttctggaacagtgagccccaagttaaatgttttcttatgcacgttgcccttggttatgatgtcttagcatagaaatagaatggtaactaagacactgctgtcttctaagaattattgctaactctctgaaattctgatttaatcgtcttcaaccagctgaaaaatgtatggtcccaaggaagagttctaagtgtgaatttctccaacaaatatttatttggcttttattttaggtactataatgaatattcagaaaagatgaaaaatctatatcttaggagctaacactttggtaagagagacttaagatacaaagtaaataatacaatataagttataaaataatataaatagggaaaggtagtagggattgtatgagtgtgtgtgtgtgtgtgtgtgtgtgtgtgtgtaatgtatgtgtttcagcagttgtgggcgtataacagttgtaaatagagtattaaagtgtatcttactgagaattggaaatgcctgcgtgtggtactggagcaatctggaaggacagatgtctaagcaggagtcctagaaaggggactgaaacggacacgttagtgatacgtttgtggacatggaatgcagtccacctggctgtagtagattggcagatgggagaattgttggtttggggctttgtaggtgactgtcaagactctggtttccttgttaagctggaaagccattcagagtgaaccttctctggataaggagagagttctcagcagagccccgacctaagtggaggaattgtttttctgtgtgtccagaatggaccgtgaagaaaaaaaagcaaaagtggaagactgtcaggcatgccaactgtctgacattgcacatgatactgtcacttgtgcggttggtgctcaagaaccacacattccagctataagggaaagggaggggagaagaagaagaagaagaagaagaagaagaagaagaagaagaagannnnnnnnnnnnnnnnnnnnaggaggaaagtcaaagacgagcgagccagtgagaagtgctcacttgggtcattgtgcctcggtcggtattcacaaggagcattaacattgagcgagtaccacgcacccgggcaagaagcctgtgtgcacgtactctgcctgaccgtagaagaacgcttacgcgctctgtgtggctgatccagaggctgaacgcatggattgccagctcggaggagaatgagcagaagtcgacagacatgtaaagaggccattcacaaatctccgagtcacttctctggaatgcccagtatcttttcccagagagatggtagtaattggaccacaggaccagccaggccgtttaactcaaaatatttacaagttccattctgtaccttctgcaacattgtaatcattttttaaaatcattacttcaaagatgttaagataagccagtcctgttggcacaaggctggtcccgggcactttgtatgcagaggcaggcagtttgcaagttcaaggccaccctgggtaacttaaggagattctctctcaaataaaaggtgtgagggtctgggtcagagatagagtgacagcttaccatgcacatcactcctggttcaaatcccagtacccctttctacaactctgcagtaggtcaaagtccaaagttcggccagcaaatgcttagcgtgacaatatcgattaactgattgattaattgattgattgataacttttgagttatatagacgacaaagcagcagcagcagtaggccctgggggtgggggaggggaggacagtttcatgatggaggttaccaagcaaacaggttgtcgagcttctgcgaatgcgagtgagctctgttgaagtggttcagccctatcgagcagccacaggtgtccaggctgctcaaggatggtttcagagatggacacccgtaatctctgtcttgggatctgagacaggaagacaaggagttcgagaccacagtgagactgcctcaaaccacagcctcggaggggagccagatagattgcccccagatgagccagattgcccccagatgagccagattgcccccagatgagccagattgcccccagataagtttgagctttctggctggtgttgcttgtcagctatggtctccaaaagcaggagtactggttggtggaaccgcaatgagcagtcttgaggtgccagatgactaaagtgacaaatgaggctttaaaaaaaaaaaaataagtgtgtgtgtgggagggtgggagcacattgattagggaagacattgggcacagaccaaactgataaacgagtatgtcgaagccagagtgtttgtctcctagctgttacagaaggtctgtgagtagattgcttatgaatcttagaaagaggccaccaggagccagcatgaggttggtcatctcagcctgaacagaatctctgcctggacatgttgttattattatttttaaatggagttaattagacaggtagagtgggtgaaaggtactctatgtgttttgattttagtaagggaatatagaaggaaaaaaaaaacctgcctttaaatacaaaatgaagaaatgtggccctggggattgcactcaccaggtaattgatctttagaagaatgtgggataatggataaaaaccaatctgcggaggagacaaatcgataggaagcaaagtcaactcctgcccctgattcataaataccagctgtgtgaggagagaccacgagggtagaagctgatgatgtggaaggtccaggcattgggctaattaagcacagtaagaattgagtgtgtgatcacagtgacaggaagtcagtcactcacagtgacaggaagtccgtgggaatccaggccgcatccacaccggtcccagtgaagatgcggacccaggctcaggcttggtgaagctgcctcgcattctgagtgctccctttggagagggagctcactctccatattgagaggtgattcctgataactttccaagaacatgactccatcagnnnnnnnnnnnnnnnnnnnnnnnnnnnnnnnnnnnnnnnnnnnnnncccctccccttcccctccccttccttttccttctgtctagtttttaaataaaggacaacaattcattttttttaaaaagatttttttaaaaaatttaaattagaggtatatatgtgcctgcatgtatgcctgtgtgtgtgtttgtatgtctgtatgtgaatgcatgtgcatatttcacatgtgcatacttcagcatgtgctcacaggagtataagcatgcagagacccaaagaggccagaagtgtggcatccccttgagctggagttacaggcagttgtgaattgcccatcatgggtgctaggaactgagctggggtcctcttggcgggcaggatgttgtcctcttgaactcttttttttttttttttttttttggtttttcgagacagggtttctttgtatagtcctggctgtcctggaactcactctgtagaccaggctggcctcaaactcagaaatccgcctgcctctgcctcccaagtgctgggattaaaggcatgcaccaccacgcccaacccctcttgaactcttaagagccacctgggcagccctgagaagcatagttctaaggactgaatgggaggtaaggctagctgtcagactgtattccagtaggatggcttccctcagtggaaacacctgacatcccaggcatttggatgcagtcagatgaacaggaccagatggggctaatgaacacgtgagtcaggatgtgtctgtgggtgggaagacaggctgtggatggttcacatagagcgggactcaatagtgggatgtgtagaatgatgaagaccgactgtggctgtgagtatccgttgccttcgccttcgatgtggctcattgatgcatctgcttcatttcacattgtgttttgcccacactcaccctatagtgatcagcagccgaatcacctgaccgattaaaatcctcccttcctcataactgttcattctacctggttttacccccttcgttttcagaaacccgtgactgtaaatgccttgcgagtcttggctcacaaagtgtcacattggacattcagtgagtcttctgttgtgcagggatgtcaaaattaacttaacaaaaacatggcgaggcaaagcagaaaccctgggcattctgaacggtaaacagtaatgatgtctgcattttccatggacctcatccgattacagagcatctggaaacacaacacaggcacagccagggaagagcctgctggccagcaacctgaccatgccgtgacccgtcatagcaagagtatggagatctgtgataaataaaaaaatgtaaagagaaaacacaggatgtggcgggaatgcacacacactaggaattcacaggattcctagaaaattaaagaagaggaccagaggggttggcactgtgtctgtgtgtccccccatgttttacacatgttacatgcaaaagcttttaattttctaaaacctagttaactacagtttttactatttcaccgaatagagataaagggtgtgtcttcattataagccttaaattcttttttttttacatttatttatttattgtgagtgtgtgtgttgggggggggtcaatatgcatcttgttccgcatgtggcggtcacccctgtactctgagccatcttgctggtgctatgaaaaatcttttaagcattccttaagtgagtctctggtgagaaaccatagactcatttttaccttgaagacccaagtgcgtttatacttccttctaagtcaccttgtgaaatacagattaatgtgacctgacagattgtaattgctaccaaacagcatcttcattaattataatgagccaaccagccacagagtgttccattctgtggtgttaacatgaattggagtatatcaagactggacctgagttgttgctggggtaaagtttgatcgcagctaaatggtgtaaaacagaaagaggtcgtcagattccacaggaggtacagcgcggcttttgttccatgcagcttcaagtgctttttgttggtgctttatagacagggttcttactgttagcccaggctggcctagaacctttaatcctcctgccccagcattctgtgtgccgaaaccgcaggcatgaaccactttgccttgaaacataatgcatatttactgtaaatgtgtgacaggtgacctaagggggatgaagaagagatgagtgctttgagggacctctgggagtataaatgcatgttcagtccccaacaggaactgttcttttcctgtagcacaagctgttccacaaagctcctctaggaagtggagtctgaaatggaactgggcaccggaaccgtctgagcccggaactgtctgggcccggaaccatctgggcccggaaccatctgggcccggaaccatctgggcccggaaccttctgcgcccctgcgtggctctgccctctggctcctgtgggcagcttcctttttgtgttagctcttccatttccctatacattaaaagcaagaaggtcagtggcagatttcctcaccagtgtgtggtgcagcagctagctgcacagggattgagaggtgtttgagtgttgtggaaaacatgttcctaaagttatacagagccttagcttagttaggggtcatgaatgttgaaaaaagtatttgaatcccagccgggacctttactcttccttggaccatataaggaaggaagatatactcacagtctttatatatataataagccttaaacagcacagtagctgggcagctgcctaccctccatgctattagattctacgttcctactgataacttcccgaattattacttactatttactatgtttcaactcggctgctccaattgggctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttgctatctgtgcaagtgatgctggctggctgatggtcagaagtctgggaggtgcgatggagtgtttggtcagtcctactgtgcacacagaagagctgcctgtgaatcaggattaccctgatagtgctttcaacatagaaaggaccacaccgtatggtccttgatcctggatagaaccttagtgtgtccatgtaaaccttacaaagataacatactatatacctagattgtttttgcaggaagtagtaatattcttcagctcctttgttcccttcaccctgcttccttgaagccattctcccatcaccactgtgccatccactggtacccactcttgtaaatgcctcctttaaaaacgcaaaccaggcaggccatccctttccagtctagtggaatctctctcccattacttcatctgccccattgtaaaatgtcacagggtaaatgaggaattaatttcagttgatttatttaataatatttacccatttaatgtttctgaaattctcttgggaaatagcaatgaaaagatggcacagtctgtgtccccttggggcatacgttctagtgagagacaagacattgattaaaccattgcacaaatagctcaaccattagaatatgagacatgacatttaaggaaagggaaggtgctctgagctagggaacctcagcaggcaggcaagggaaaatcccgacgctttaccatggaaggtaaaggagaccctagaaaatggacccacgacacaaagatgaggggattaaacactgaagcccactgtgaatgggtgcagcgccatcagcctgaaatctcagctgcacaggagggtgtgaagcaggaggatctggagctcaaggcggtcccaagtgtcacagaaggagcctcagccccatcccaaatgagcaaaccaaagacataaaaatgtgaaggaatggagagaaactgggggctgcatcaagatggagttgctgcttgcctacatcatccacagcagtctccgcacacctgcaaggttagatagactgttggtcctgtcttttggcaactaagtataagactttaagcgagtggttacattaactaatttcactggaatatgttacatcaagttagtgcaacaagtatccattggattgcttttcccggtgttgcaggttcagagcaaaacagacttttccttctgaattatggtccaattaaagttactgatagtgtacccacaaagatctattatgttacacatgtatgccattatattatggtactttatatcatgcaatattagaattgtatagaactatagctctcaactttaaagtcttaacattttacactcaataacatgggcctacataatgttcagtacactagaccttaaaactgtgcactaaaacttaacacatttaatagtttaaatatgaccaacaataaaccaaagagtgctaattaaattaatactgaaccatgttaatatacattcgcatatattaatctagaatatgcagaagaaatgacattgttttatctaatttttaggtctgtgcaagagtagatagctggattttcttctttgcttatgtcgtagtaaatattggagattagcagctcttacaaaggtttacttgtttccttatgcaaaatgagagaaaaaaaaaaggtcacatttcctaacattaccttcagtctcaacaaaaagtcattattaggaagcaactggtcagtcaggatgcaaacaagtgtgctgcgttcttatacttgcttgaagttttaggatatagtcattaatggcaagtatgttttctcaacagtatctgtcagctacctaagtctctataattatattttagtcaatttcagtggcatagaaagaacccttcctggtgcacagggatatttgaggtcacagttcagaagcgcttttcccagggacttcggggaactctgatgtggagatagagaacagtgctttacgagaacttctgtctttacacagcatgttaaagagctgggaggtgagtgtgccaggtggtgaggctctgcaggaaggggagagtgtggctagggactgattgcaagcgcagtggggtcactgtgttcagcaaagcagtggtcttcacccttcatttttgtcttagtcagggcttctattcctgcacaaacatcatgaccaagaagcaagttggggaggaaagggtttattcagcttactcttccacattgctgttcatcaccaaaggaagtcaggactggaactcaagcaggtcagaaagcaggaactgatgcagaggccatagagggatgttacttactggcttgcttcccctggcttgctcagcctgctctcttatagaacccaagactaccagcccagagatggtcccacccacaaggggcctttcccccttgatcactaattgagaaaatgccttacagttggatctcatggaggcatttcttcaattgaagctcctttctctgtgataagttgacacaaaactagccagtatgattttgttttaaaccctttttattttatagatatgggtattttgcctgcatgtatgtctatactacaagcgtgtgtggtggaagaggagggtatgggatcctctgcaaccacagatgcagaggttgtaagccgctatgtgggtgccgggactcaaacccaggtcctctaggaagagtaaccagcactcctaactaccgagccatctcttcagcccacctccatcactcttaatcactgacctgcagatgttaacactagaaagataaacaccatcttctaagttatggaaatgttcttggcctttcagagaccctcccccaaagggtcaggagtcttcagaggtgtgtacagcacgtatgtactgacttagaaaacaaagccgaactagaatttgcataggtggttagagaaggatggggggagattacaagagcaagaagatggcagtcaaaaccctggttagaaaaagtaaggtcagactggatagttagaatagggaataacgtgtttataatctgtaggttatagtcagatcaagagccgtgttacgtacccagcagggacgcccaggctttccgtgaaatcactgggagcagctgaagggttttgtctcgtgtgggacttgagcatgtttgtttagaagtgttagtatggggtgaactggagagcagtgagtatgtagtgtgacttgtgattcagccactgagagcccagcacagggtgggtgataccccaagggtcctgagggttggggagacagctttagaaggaaacttgagatgaaactggagccagaaaggtcagaggttatctgcactgtattttatctccccagtccctgctaagggcattgttagagaaacagacacaatctgggcgtttctgtaaaaggtccccataatgactttgtcctcccagatgactgagaatgcttccttctgataacgcatttcctcttcatgctcctgccagaggcttccagccagtgttcattactagggtccaacagttgaagttgtcccagtggctagcacattttcttccacccgccttctctggcccaaccttttatctttattgactgttcattattgttcctgcactcactctccgtgacaatgacatgccttcttttagcgggttgctcctgccgggcagcacagcagttcagggttcatactgcttttgcagagctcttgggctcctttccagagcccatgtcaagtggctcgcactccctctaactccagcctcaggaaagccggtgaccacttccagccggcctcctagaaccctgaacgtacatgtagaaacctacactcaggtgcacgtgcatttacataataaagaataaatctttttttttttaaagtgtttttgaaatataccgaatggaagggcagagtacagtttagtggtaacctttatagccttagcatactttctttatttggggaacaggaccttccactttagtactttatttatttatggaacgggaccttcttccactttagttctattttcctcaaactgaagacaactaacgtgtctgataccacatactaaaacaccaaggctcagtttcatagaaattcatcaaatttaacctggattctacttcaaagtcagctagaagcagtgaatgatagagtgttacagtgcccactaaaggcagctcatagctaggaaaggcatgagagagagagagacagagagagagaaagagagagacagagacagacagagagacagatggagagaggggagaggggtggtaggtatgaacacccagggatgacaaggttcaggaaaggacacatttaagtagagagcaccgatgggtctcccttactgacctttgtctgtaccccagactttaggctgattgtctcagcatagaacacggtcttttcgccatggcgctaatcctgaaaggataacatgcatacaccaaggcatgtgactgattgtctgcaatagagttgggatttgagcctagatctcctggaccccaaagtcctcattcttttttctccttttggcttcctaagtaacagtatgcaatatcttgttttaagataccaaaaatgccatatactgtgagaaatattcaggcataaaagcttagccacttttaagaatgtgtgtgtatatgtatatatgaatatgcatatatatgtgtgtatataaacatacatattcatgtgtctgtttatgtgcacatatgtatatatgtttatgcatgcatgtgtgtatatatgtatattcatacatatgtatatatatatgcatatgcatacatatatgtgtatatatgcatgtattatatatatatatatatatatatatacacacacacatgaatgcacacatacatatacatacacacacatatatacacaactcctagccatctagccaatcagctgcctttagtgggtactgtaataccttatcattgactgtttctagctgactttgaagtagaagccaggttgaatttattgaattcctataaaactgagccttggtacattagtgtgagatatcagacactcctcagctcttgtcaacatatacatacataaacatatatatttaaatatatacacacatacgtatgcatgtgtatctttctgtgtgggtgtatgcgcatgtgaaatcaggtgcccagagaagccggaaggcattgggtcccctggaacagcatttacagatgtttgtgagctgcctgatgtggatgctgccaactgacctgtcatttgcaagagcagcaagtgcgttgaactctggctgtctccctggctctattgtgagcttgttcctttggagcatttaattcatagaccatttctaacaactgagtgaggttttatgaagtctcatttttattcttccgtgtgatgcattttaaatgctttcctgccattgtcataaatgagtcgttgggactgggtgttgtggatcccatccctgcacaaccagcagcacttctaagacggcctgagtcgaagggggaaagcagtatctctatgtgtctgacaaatacagagatggatgctcgcagccaaccattggactgagcacggggggtgggggggtgctccaatggaagagttaggggaaggactgaaggagctgaaggggtttgcaaccccataggaagaacaacaatatcaaccaaccagacccccccaccccccagagctcccagggactaaactttcaaccaaagagtacacatggagggctccatggctccagctgcgtatgtagcagaggatggccttgctgagtatcaatgggagaagaggcccttggtcctgtgaaggctccatgacccagtgtaggggaatgtgagggtggggaggtgggagtgggtggtagcgggtgggagaacaccctcatagaagcagggagggggatgggatggggattcctggggatgaaaccaggaaagggaataacatttgaaatataaataaagaaatatccaattaaaaaaaaaatcgcccaatgtatgctgacctacatggccctctgtttcctgagactctaggttttccttcctgttgatttcaatgaaattaaaaatatcagtttccacagtaaaggtcaatggcttgagaggagcgtggggcttagaaaaactgagggagagcacccctgctgagtaccctgagcagatgaagagcaccatagatatcttaccacgtcaagaaaacccttaggtgactgccaatctcatgtcaccaggggtgtgaccttaggtgactgccaatctcacgtcaccaggggtgtgaaagactgcaaccttgagggagtctgtggaagaagaattgcacaggagggaagatctgaagacttgctgtgttccaccatacccacagccgtgctctgcttagctcacagtcggtctggatagctgtatcaggaagagcacagtcagtctctggatagctgtatcaggaagctggaagtctagataactgactcagcaaactgcagcgttcatcctgagctgaggaacctgttggccagcgcctctttatttagaaacaaaacagagactattgacttgggagcactgacttgaacaatggagcaaagggggtgtcttagtcagggtttctattcctgcacagacatcatgaccaagaagcaagttggggaggaaagggtttattcggcttacacttccatactgctgttcatcaccaaaggatgcaggactggaactcaagcatgccagaaagcaggagctgatgcagaggccatggagggatgttctttactggcttgcttcccctggcttgctcagcctgctctcttataaaacccaagactaccagcccagagatggtcccacccacaaggggcctttcccccttgatcactaattgagaaaatgccttacagttggatctcatggaggcatttcctcaactgaagctcctttctctgtgataactccagctgtgtcaagttgacacaaaaccagccagtacaggggggcaatttgcaggtatgggtttgatgaatgggacctacggggtttaagatataacaaatgagatatgttaaaagtagttgagatatcactaactaagaaggaaaacacaggtgggtggggaaaaatatagagttacaaagtaacattgaaattattgtactgaagaccaagaatcctacgacttagcttacaggtagggcaccatgaaaatgcaccaagacaccaggaactggtgagcattgtttgggttccagctgattctggaatataaggtggggagctttttcttaaatgttcaaaagtgtaatgtagggacaaccatcttgtttgtggtggaaaccccacagcatccttctgaatatggtgtagactaagatttcagatggagtcaaggttttatgccagcggatggacaatgaacccagacatactgacctgggcgtctgagacctcaggaggccagcctccaggaggacagtccttctctctcacagcttggattgtaccagtcatcttcagctggatgctgcctcgtatctagagggcagtatgttggaaactccttgtagacacacactctctctctgtctctctgtctctctctctctgtctctctctctctctctctctctctcacacacacacacacacacacacacacacagctcttttgctcacactgccactgacagctgaaaataaacagatactggtttattctagaaaaggaaattatacaagagcttcctcgggcactttcacttttccttctcatcgtttgatgtttctttgctgttttatttcttgttttgaagactaaactgagattccccccacccaacaccccaaaggtggaaagcccataggaaaacaggaaattaaaaagaacgaagttgtgctgatgaaattggtcacactgaagcccccagggcttacgagaaggctgtgagggtagctccccgcccagcaggatggcacctgactggagtctcccataagactccatttatttccatagctagttaattctctatgtgtggtgctttgggtgggacccagggcggggctagtaacactgagtcatctccaggcctaatggattccttttaaggagattttatttcaaaggtctgtcttcattatgccttccagtctagttcagaaaatttaaggatatctaaaattgtgcaagaatgccactagacaaaagaactgagcccttgtcgtgagctggagggaaatggtaacagtgatgctggcaaacgcacacgccagatcaggaggccgtggcatgtaagaagacattgtaatgatacagtccgctatttacaggcgaccacatctgtgccttgtaagaaatagctgaaaatagcaagttctgccacttgggggaaaatgtggaaataatttacagctaaaagatagcatttttaagaacttgacatcaaatttaacttgaaaccaaaacctccatcagccaaataagtagaaagttctaaatatagagaaatgtatgggttggagcgcgtaaccaatgtttggtggttgtgagggtagcctgtaatctgtgatgaaaagtcagccggggccctggtgaccttctgaaatgagtttaatgtccagatgaaaataacggggtcagcgccgcggaacccagggcaggctgacggtgcctggagtttgtctcccttttcattccaggatgcacttgggacacatgagcactttccaaggtctctccctacacagttccctgtcttccccataaccacaggctgctgcctctctaacagtgtcttagccaagattactctgtgtcaggtagacaccagtgtccccagtggttacggaacactacttctgcagatagcttgctgggggcctccttcaagagtgcacaggcccctctgctggcccttccctcctatccccaccacggggacaccacctttgaagacatacaggtgctctccctgacttagcagtcctcttgtggccatggggttttcagactgaatcatataaaggttctgtgagtttgttctgtgctgttctggtgccctcttgcccctttccctgtgtggtctcagatttcaccaccaaagctcaagagaatctattaaagagtccagttaggtcaaaggtggcaatagatactacttaaaagtgtagtaattcctttgggcggggcctggaatcatgctagtgtcctgtagttacgaggagcaaaagaaaaaaaggaaaaacccaaaatacacggtttggctgcggtagtgggaaagtggaaggctgtaatctagggagggtggcgcccggcacactcacattcttacactgtgctggtgggtgtgtgatttgcatgatggcttagcgactcgtgtatcagacgcatttgaacaggccgtagcgcttagaaatctgcttccagaatttagcctaatgaaatagtaattgaacatgtgcacatatacatatgtacaagaaagcacactgcagcagtgtttatagaagcagaaaattggaagcaacttctgtgttcatcagtggaggaactgtttagctaaattatattgcagctattaaacatgatgattcagagctttatataaagctaggagatgtctctgatcgatgtttgtacaacagtgcgtgcgtgtggtgccattttagttcatgtggatgggagtgggcttggaagactactctgtaaaaatatttcaaatctcagctcatttctgagagctggggttacatatgacttttatttctcctttatactctaccatgttgcttgaagttattttgtattttgtaaggaacataatttttttttttccattaggagaaaaagagtctttgtagtttgggaggcgagggtgggaactctggggtcttaatacgtggagaggcccagcgtgtcaagtgctggtcatggccttgggaacagagagccaaggggagactgatttctgcagaaatccctgggtttttcctgagtgcatgttgattatcacagagtcaacaccacatgttcttggaacatcctggggtacactctaaaaacagccctcactccggggcctatcctcggagagtgggcgcctttgcttgtttctctgaagtcagcaatgtggaatgcctagtctggtcaaagagaagctcctgtatgccggctctgtgtgcccacagacttctgcttcccctgtgactaatctgttacgtccttctcttccctcccctgctttcttcaaatatttgtctttcccctcaaccctcagcctcctctcctgtagctgcaaccctgggacttttttggctccgtatttggcttatgacattgactgtggtcatttgcattttgatcaaaataaagggagtgaaatttgtcctgctttgtagcatgcttactatattgtacagaggaaaacacttcacttatttatatcttgtatctttctagttgttaggaaatggacctatgccattggtagtatgcaaatgaagttaagttcagtgttttgagatctgaataaaggcttttgcttgagctgaacttggtgtgtgtgtgtgtgtgtgagagagagagagagagagagagagagagagagagagaggtatttcagagtttctgcagaatggatggtactctatttttaatttagttctgttatgaactaaattatgccccttcctccccccacatggtctcagaattaactactttatttttctagtcatataaaccacagagagcagttcttgctaccctcatattgctctttaattatatgaaaattttaatatttttcactgtgcagcttctcagctattgtgggaaaacaaacctttcctacagcctgctttgtgtgacgtgaatgcagttaacccagatgagcttggggcactccagtgtttcaggatatcgggaaatttcttcagatgcagtcagtttcgtcgtccaaggcaaggaagggtcagacggcctcatgcataaggatgagtttgagcaaagattccaggagagccacatctcatcctgattgtgaataaataatttacagtcagcattttggacgataatagattctgctgcagtgaggtggggttcctaggcaggatttttaaagacccattttgatgatgtttgaagcatgtgagtctagaccagtgttgacaggttgttttgtagccgcagaaatactgacatcaaggatcctgggagtgtttaccagttccactctgcctgccctgagtgacacagagtacctgcacacatgcagtccttccctcaggcctgtgtcacccctacacccctgtccatccaggagacagactccacatggccctaccatttccctctggagtgatggtagcatcctctttaagggaaacctcaatgccacatttcaaccagattgctgaggtagatttccgcgccaagttgttactagaaaagattcacgtttgggacattgtctctcaggcactgccctgcagtaacctgcagttacacttgagccagtggcggggaagaggctctgcatgggcttccttagcaacagccaagaggacggacaggatttaccttctcaaattcacactcctttgaaggcactgggcaaaataactcaactttcttcttttaccctttgaaaattccatacatgacacgagatatcttgagagtgtcggttctttctctgtctcacccttcctacccccacccccatatctctgttcttattcccccaacccctgtcttctcccgagtccatgtcctatctctctcctagcatcatgaatatttaactgacctgacctaatgtaggtagccacagttgctattcaattcatgtgtccaatagctgtgtcctgttcagaggacagcacttcacaatagcctctgccttttataccacactccttaccttctgtgatgttgcttaagccttgggcaggggtgtggggtggtggtggttacatagatgtcctatctatggctgagcagttacagccttactctcagcactttgaacagtaatgagtctcaacattgaccactacctaccatatatatatatatatatatatatatatatatatatatatatacatatatatatatgtgtgtgtgtgtgtatgtatatatatatacacatacatatacatatatacatgcatatatacacatacatatatatacatacatatatacacacatatatacacatacatatatatacacatacatatatacacacatacacacatacatatatatacacacacatatatataattttccttattcttgaaagtgccatagatgtaaacaataaaatgtgatcatatccaataccccctccccatttctttctccaagcaactatcttagttgcttttctctagcttcaaagagacaacatgaccaagacagcaacttattaaaaaaacatttaatttggcacctatggttgtggatatggaaggttagagtacatgattgctgtggcagagagcataggaacaggcaggcatgaggctggaacagagagaaagagaaatatccaggaatggctagggttatgtggagtctgtctcctggatggacatggggtgtaggggtgagaggggcctgagggaaggactgcatgtgtgcaggtgctctgtgtcactcagggcaggcagagtggaacactccctcactggtaaacactcccaaggtccttgacatcagtatttctgtgacagcaggccttgcctcctaatccttcccaaacagttccaccaactgtggaccaaacattcacatatatcaacctataggaactattctattcaaactaccacagtcccccacccagcttcatggatgtgggagcatgcacagcacctacagtgagaaccagtggggaaagagtaattctctctcccacagcggctatcaacagccaagctctctgtcttaaagggtggagcttggagaatactttccctatctatgctggaattttggccggctttttcggcaggtagtcactgttgttatgagttcacgaatctaatacccacgtccaaatataaatatttagaaggtagttccctcaaagacatgaggttctcaaccttcctcacattgcaactcttgaatactgctcctcatgttatggtgaccccgcccccctccaccaacatccgaaatggggagcccacaacccatcagatgataattttttttggtcttactttggtgcaatgacaaatgagagtgtatgttgtggtttgcacccttatcaaagctgaatcaggttgggtggggttataaacagagtgcattatagacatgctgttgtaactagaagtctgcaaagctctttcaggaagaaggtgaatcatacagactagaaaggttgcttattgccttgacattgaaaacttatccccaagacttttggggtaaaagtttggggtctctttgatgaacttaagaattaaatgtcctcagtgagaaagctggtagctatatataagctcttgtcactaaaatgagtttacctaataaatcataaactttttctgtaagtatttctaaatttgagctgctaaaaaggaatggttgagcttcatacgtgttgactgttagtttctgtgtcattaggctcaggcaaaaagaataaacaattcagtagacaacaacaagatgattggtctgtctatgaattttcagtcacttaaaaaattatcaatgtttgtttggagaaacttaaatttttccttcttctagaaaagtaaaactttgggaaaaaaatattttttaggttgcctgtgatttttaacgggctactacatgagttaggcctgtaagtgaaatttacactgaaaaaaatccaaatttttttttcccagaaaaaaaaaatgtttctgttctcctttttttctttttctccctttctttctttcctttctttctttcctttctttctttctttcctttcctttctttctttctttctttctttctttctttctttctcccttccttccttccttcctttctttctttctttctttctttctttctttctttctttctttctttctctctttctttcttaaatttaaacttgtttgttccttacagttacctggtagtgtgtcttctgccaagagctgagagatctggactttgcagcagtaggtagttagttggcacccttttcctggcagccatcctaagttccgtatcacaccttaccatttgcttcacacaggtagctgttgacaactgatggagtcttcatacaaacaaagagctttggtcttatatcccatgcaagaggtttttgtgcccactggctgatttgggaggtagttgccaccctgtcccactatgcaggggtggtgcctgactagcctgggccactgtgtaagggtgatgcatgggcaacgtgggccactatgcaggggtgactcatggccagtgtgtgtcactgtgcaggggtgatgtctgaccaacatgtgtcaccatgcaggggtgaagcatggccagtgtgtgtcactgtgcaggggtgatgtctgaccaacatgtgtcaccatgcaggggtgaagcatggccagtgtgtgtcactgtgcaggggtgatgtctgaccaacatgtgtcaccatgcaggggtgaagcaaggccagtgtgtgtcactgtgcaggggtgatgtctgaccaacatgtgtcaccatgcagggatgactcatggccagtgtgtgtcactgtgcaggggtgatgtctgaccaacatgtgtcaccatgcagggatgactcatggccagtgtgtgtcactgtgcaggggtgatgtctgaccaacatgtgtcaccatgcaggggtgaagcatggccagtgtgtgtcactgtggaggggtgatgatgcatggtcacttgccctgtggtgctgtacactccaggcctggttctctagcacctcagtgagctgctggctccaccgaagtctctggagagcaggttgtcttgtgcacttctcagatgtctataataaccaggctttcctgtcatatgctatcaatttcccattctgagaaatcactcccggttttccctttctcaggccctttcctcccagaagctgccgtgtgcatcacccgtcatttacctggggtaaaacccccatcaaagggaagatttggaggcacctgaaaagcctgtggttgaaatgaaaaccacagagtttagcatttccatataactttattcttcaggctcattagtttaaataactgaaatgggaaatgaaaaaataaaaaaggcagtaatgagccagagccagagcccagagcccagagcccagagcccagagcccagagcccagagcccagagcccagagcccagagcccagagcccagagcccagagcccagagcccagagcccagagcccaaagccaggaatgtgtgttgcttccctggacattctgtgccccggacaagaacaatccctaagcagaaccatcctgttcatgacagcccttagtgcgagggttctcaacctatgggtcgtgaccccttgtgagttaaaatgacctctttataggcatcacctaagactaccagaaaatgtgacatttatattacaattcataagagtagcaaaataacaggctatgaagcagcagtgaagtaactttaccgtttggaggtcaccacaacttgaggaaccttactcatgtgtcacagctttaggatggctgaggaccgctgccttggagggaggtggggctggaggtggctacacttggcggtgctgcctctgcgggttgggtagcctgtcagcgacagtgagaagcctccatgcaccctgcttaggagagaggaaatgaaggacgcgcaagcgggttttatgagttgcaaagattacatcttctcagaagtgtggagaaaaggaggtgctgggatggtttctgtgctaattgatgctgaacgcagtcgagaattaatcacggttaatgaacatagtgtgctggtcgttccatcaaatgattgccaggcacaattccctatttgtttttaatgggagaaatctcaaaaccatcacttaccagttaaaaagcagcctggttcttaaacaacgaagttgacataagcatttttttttataggctgtgaggatatcgactcttctcacagctgattaaaccaactatgtctgtgtgttgaggatctgagggatagcggttgctttaattacatatgtgttaaattatacgtacaaatataatttaattctattaagcccatcttttgctgtaacatcttatttgttgccatagtcattctcctgtgtacccttctttttgagagagagcatcccattgtagcccaggctggcctgtgggtcctcctgcttcaggtagtgttggaatcacagtagcttgtaccaccgtatgcagctcacaatacaatcttttaagctattaattaaagactcagtttattaccatagaaatttacaatgtctaaggttttcttctcctgcgtcagggccaccgcttgtgggcttgtaggcaaacaccaatgactaatgtgactttgtgtacatggtagctccttttctcacctgtttaaagtgataccgtgggtgaagtaatgatgtccagagagatgtcatgaaaaccaatcagaagctaggagataagacagacaggtgatgaggcccccaccggtagtattaagtctcatagttttcttcttgctaaccaattcagtccctcatccaggaagttctcattactgagtttctttccagctctgactcccctctgttatccaggcaggtagaatctgggatgattggatcctgcacgtaatactgcctgttcccaagcattctaggctactgccattcacagacatcccccaaccaagaacagacacactgtagagattaggtaactcggtatgactgtatctctctccccctcagagagctcatctgtgagccagtgagagtcaagaggtacatacctgccagtcattacctttccaataattcaccttaccgctgttttccctcttctacacacaggaagaatttaacgggaagcccgactccctctttttcaccgatggccagaggcgaatcgacttcatcctcgtgtatgaagatgagagcaaaaaggagaacaataagaaagggacaaatgagaaacagaaggtaggacttgcattccatttaatttctctttttattccctttaggattgtaaagtgaacagcgtgctggttttaggtaagcaggcaggtgataatgatgtggagtaccgtgaaccagacatccctccgatgttctctcagcctcagatccttcaaggcatggtagcaggaaatttcgttgatttgaaacagaagcttgctcggggcccttccccagtcagtttcatacggaagggactttgctgggttgtgcagagcagatttgcatgaaggcacaccaggcaggcaggtggcctttacctggcctggagaggaggctgatgactaaggacaagtgtaggacctcctagtgttccctgtgcgctcggatcactcacttctgctgccaggggtgtgggctcttccttcatggcttttcttttctctcatttcactcttagcacacacacgagctgggctcagtcatcacaccgtttgtgcatgagagtttgtggtagagaagccagataatcacccacgaccgtgggtgcttcgtctattcagggcagagagacacgctcagcctctcggcttgaatccagaccccacttccgaccctcgggcctcctctcaccttcttttcctcttttgcacctacaggcagctatgctgcttcctacctttccgttgctcctgcctcttgcagaaacaaaaccattcttttaattcatttattcatttacatcccagccgttgcccactcctggttccacctcccacagttcctcatcccattcctcctcccccttgccttcccactccctggagcctcaaatttctcaagggttatgataccttctccccactgaggtcagaccaggcagtcctctgctctatatgtggctggggccttggaccagccctgtatgctgcccggttggtggctcagtctctggggtctggttaagttgagactgctggtcttcctatggggttgctctccccttcagcttcttcaatcttctccctaattgaaccacaggggtctctgacttcagtccaatagttaggtgtaagtatatatgcatctgtctcagtcagctgccttgttgggcctctcagaggacagccttgccaggctcctgtctgtaagcccaacatagcatcagtaacagtgtcaggccttggagcctctccttgagatggatcccaagttggggctgtcactggactccattttttatccctacacttcttttatacagggacaagtttgggtcagaaactttgactgtgggttggtaaccccatccctccacatgaggccctgtttattcttactttgagaaattaaaaagcaagccagggttagcacagacatccggaacctctttattgcgacacaagctgcactgaacttacggagggcaaaaggatgtattcatggatctttacataaatgctggaactcactgcaccgctaccctccccatcccgtgtgtgccaattgggggggaggggctggcgagatggctcagcgggtaagagcactgactgctcttccaaaggtcctgagttcaagagctgacgccctcttctggtgtgtctgaagacagcaacagtgtacttacatatataataaataaataaatcttaaaaaagagagagagagagagagagagagaaactctcttaaaaaaaaaaaaaaaagaaccgtgtgtgccatggcatgcacacagctttcagggtccttgtctatgcagtattcacagactatacccatctttaaccttttaagttctccttattcattggaagcaagtggaaaaacttttttttttttttgtaaaatgaaacaaataactgtttcattcatgtgttcaaacttttgagggttaagtttgaagtctgtccagaataaggccaggatttagaaactgacattcagattccaatttagccactgtcctagctggagtagtttcagttatatggaacaattctcccaggtaattggcttcacccaaaagaaagggtcaggggaggggggatgcatttatcagttacaccaaagtagaaagtggcggttctccttcagcacatagcttagggttgaggctgtgcggcatgtggtcatttgggaacctaggctgaaacagaggctctgatgtattcattaggcagttccagaatcaaccggggcatcaacacaaggagcagagacgatgacagagtgagtgaaggagctcctggggcgtcactgctgggacccggcagtgactgcagccactgtgctcagtggtgtccagcagagctcagcactggcaggagtggggttgtgtctcaggcaaatctccctgccattctgtaacctttccccccacacctacacgcacatttagacttcttagcgtttacattacatcttacaaataggttatcataattttatagttggttgaatgtttttttttcttattggtttataaaatgttggttcatcgtataatcagtggcatcatagatgctacagaacagggctccaacacctaccatgtggctataattaaaactaaataaaataccatatgcaggcatcatgtagattttctaatacacataagtcacaaatgttaataatgttgtgctttctcttttttatttggtgagatcctaaggcaatggtctgatataaaaggcatgactgccttgctacccggctctatcactgaagtagctagtggacttgatcatgtcccccggctgctgtagtaattggtgcttccacatttactattatcaaattgtcatggaccagccgtctaccgatagctgggctgggtttgtgtaaagcaagttaaacagaacaaatccaagaagtataaaggagtcagtctgactttagcaaagagctttgctgctgcgctgaagggcaccgggagctactcacattattaataagttcttcatttgctttagacgggaacgtaggtctcagggtgactctcattacaccagggggaaaaaagttgtcattaatttgggcaatcctccaacccagtgagtgataccttcgtgttgctgttcataagctgggctttgaagtgttttcagcttgcatttgtatatatttcttaattttataatctgtcaaatttcagcacccagctttggaaccacattttttaattaattggacagacgtttctgagctttgttgtgttccgtgtcggggcttagtggggatttagaatgacgcctcggaaaggcaacttcaaagtcccgttttccctaaaaggaaaaggtttggtgtatgccacattgatttcctaaatcaacaccgtgattgactttgccggaactgatgaaaggagttctgtaaacaagttttagggccgtggaactacaggtaccctgaagactcacagagacttaaaacccgtgtatcctcgggaacaagagaaaattctggtctagcctagcctttaaatactatgttactctacccgtttatatggctgaagtcatgtcctaagtttgacataagatgtttgcttttgcacgttgtgtggaggtgattgtaaattggttcagctggccttcttcggcttatgctacactttgcacagaatcagtttggatgattttactgcaagtcacaagaaaacaacgtttcagatgtcttcattgctagaaggaaatgattatgtaactgatcaggagggagagccatttctgaggcaggtgatcttccagcttaatgaagccatcccatcctgctgccctgatcctcaaaacaaacatctcctgggtaatgggtgacagctgagactccaggcagccagattgagaggaatatgtctcttttgaaagataagctcctgtggaaggaccctgtacagactttccactgtagctccctgtctagcgtgggtcatcgtctctttcttcctaacctccatcctcattccttccctctccgcttctctttcttcctttgttaagatcctggtgtagcctagattcatcttaaattcactgtgtagcgatgaccttgaacttctggtctccctgcctatacctcttaaatattgggattgtagattagtgccaccaggccagaagtggtggcttatcttggttggcaacctgacacgcctcacaagagatcccctcaattaaggaatagcctttgtcagtttggcctataagcaagtcttcaggtgtggggatggaggtgggggtaattctccattgctaattgatgaaacagggtgtcacctaatgtgggccacgctatccctcagcaagtagacctgaggtgtgttacacagacgcagatgcagggagcaagccagagagcagcattcattcatggcctctgcttcagtttcttctgtaagcgcttgccttggcctcccttgatgatggatggactctaacctgtaagataaaccctttcctccccaagctgtttttcatggtgtgtttaccacagcagcagaagccaaactaagacagcaggtttattgattagggggaagggaacccaaggcatcatgcaggctaagcaagcattttctaattgagttgcactcccacgccacctcatagactgttacagttcaacaatagccacccttctaggtccattggctctacgtccatgcatttagtcagtcacagattataaaaaaaaaaaagttcagaacggagctgagagatgtctccgtgattaaatgtacttgatgctcttacaaagcccctcactttctcagcacccatagagtggctgacaaccatccacagctatagtttcaggccatctaatagtctctttcaatctctgtgggcactagacatgcacagcagacatgtgcagacctccaagcagacagaacactcacacccataaaataaataaatctaaattttttttaaaaaggtttcagaaaaaaaacttggcttctgttgagcacgttcaagtgtattcttttttcattattctctaaggtgtacaatataaacaaccatttatattatgctaagttaaatagcaattgaaaagggttcaaaatatatggggtgtgtatacaggtgatactcaaacactgtgccattttatgtcagagccacttcagtgtccatggagtctgttctccatggacactctagaatccatgcatgtgtctgccgccggggctggactagtaaggtcaggggaatgtttcattgacccaagatagtcgggattggtccagtttatttcctgcatcgcaggaccacctagtatcagaaaagtgtttagggttttctttggaatggtggagggagagatagccgtcagtaagctgccatcggtgtccagagtccaaacatctgctactaagtatgtctgacctgtgttgtgatgagcagagatgttttaagtaaaacagatccctgtgcgggacaccaattcttacatcacagtctgggtagcgacggcttctttcccgttttaaggctggcctgctttgatttcgctttgtctggcacttgcctcccatcgggtactcctgttcctgaccacgtgaggatgttattggatgacggtggaagcgggaagaggaagtgtgtaggcagaactaaagcagtccacgtggtcctgaataagttttatttcgtttctatctgttcctagtaattgatggaaactcagctcccttagactcgaggaaaggtgtacacatgaaaggcagatgcttgaatttcacattcaccttagaaattctctagaaaggtctggttcagagactgacacataaaaattttaagtaaggatcaagctaacttatataataaatgcagatattagttttccatattgtgagcctttaaaattgttgggcgttgctcaggtgagtcacccctggcagaatagtttcccatagaagctggatgagttcgctttagaaatgctttcacgttcatgagacgtctagtgttatactgtaatagttgagaagaatttatgtcctttagtgattttttttatggtactcatgcgagttttcctatgtttttgttagattttcttagttattctaattttttattgctgttgtcaaaatatgttaaattatagtttgtgacgtgttttatataaaacttttgatttttaagggtctgtacaggtattttgataaactctttagttctaatgtatcactgcttcttctaatattatttttcagatgaagaccgtattgtctatgaattataatagtttgttttgtttcaagacagtactgtctattcaagaccatattatctataaattataacagtttgttttgtgtctctgtgtagccctggctgtcctggaactcactctgtagaccaggctggctttgaactcagatccgcccacctctgcttacctagtgttggaattaaatgcgcataccaccactgcccagcttactacagttttgattttcctttgccttcttatgggtctttcttatttctcattgacatataattgctaggacttctgaagtaaaactagcaactcatagtagcaatggttgtattacttatggttttaacaggaatggctgcaaaaattcaccagtaaatataattataccagtgtaaattctggtagagtcctttttagaagttaagttgttatcttttagttttaagtgtccttatagtaactaaggtttgaacattatcttaagtacttaaaaaaaaatctagtgaaaacctgggtgtggtaggggcattcctttaatcctagcacttgggaggcaggcaaaggcacagctctgtaagttcaatgccagcctgggctatatgatgtgttccaagccagcatggattataaagtgagaccccatctcaaaaattttaataaaatctattgaagtgcttggctgcttattaagcaaattctaaggtatattaatttcaagtgcaaagatagactatacatatacccagtagttgattccaatgtaccattggataccaagacgtgagggtgctcgagtctcttatataaaatggtgctccggcaccatttttgcatatttgcatataatcccatatatttctaagtgctttccctcatcacccaatataaacacagcacaacataagtagctgttaaactgtgttgtttaggaacaacgaggggaaagactgtctgagtggttccagatgcacgcccctgccccaataattcccatcttaatttagttggatctgtaaatgaagaacctacagatgggaagaatggactatctggggctgtttgtggccagtaagacaacagagagcaatgtagatcacacaaaaccatttcttactgcctgtaaaatgctacatggcttcatatttattagctccctgcttatttataacactacactaaatagtttgtggttggaaagacttggcagttctctggagtattaaaagttaagctcatagatgaagaaattaggatgggcttcccagacctttgtgtgagtagaaggtgtgggaagatgtttggcagtgggtagaacattttttttttggttgggaagaataatttcaagacatcttttgtatattgatagagaccatagtgcagatactgtgttcttgcaaatgagaatagtgttcatttcctaagataaggaagagataatcaattgccaagtagttgaaagttagccttccacatgtataaatatgtggagtgcatttagggtagatgataaatccgtatgattctgtcagctaaagcatgatggtcattttctaccgattaccttctcgtcccatccctggggagccctttgttctaaactacaaccccctgactcttcttgttctgttttctgtgtgagcatttggaggatggtatttactggaccagggacaacttaacaggggctgtatccctgaagaaaaggacccctcttcctctagccactgataactgccaatggcccctcagggaaagacaggccccttgagtccctcctccacccttgatagactgctgacaggaccatcatgtgcaactcttccgtaggcaagcacagcctctgtgagttcgtgagtagaacagccgtgtgaattagacagccctctctctctccatcctctggacagcaatatttgaccggatctaggttgacctggttgaagattcctttgccccttctcatcgctcctgaaaccagcagttctagatcagtggttcccagccttcttaacactgagaccctttaacacagttcctcatgttatggtgacctcctgaattgcaaaattattgtgttgctactttataactgtagttttgcaacatttaggagttataatgtaggcacttggtatgcaagatatctgccacccctgtgaaagggttgttccctgcccaccacccccacaggttgcaactgttgttcctcactgaaggcctgggattgtatttgaaaatagctctccaaattgtttttagaagctgttaagggcagaaaccacctcacatcccttgcttcttttttttagtagtagattataggccatttgccttctgatgtagctttgacccataatgactgtgtatttcttttttattatatcaaaatattaatttaaaagtaaaatttgaaactgaacttcatctaaatattcacttcacttatgcttgtcattgggaaccgctcatctgcttctggcccttcacgaacacacattacccgcttgagtgaattcctcatcacagcggtccaccaacgttaaatgtatcaccagcacgtgaatataaattaagtggcaattaattagtttatgtattctacttaccaaaccgtttggagcatatgctatgtaactaataaattagcacatgaagtaattaataatttttacatgaattaagagcctttgactcatttctcatgaatctttgtaggctttgcagagattagccagatgaaaataaaatatgaaaatagaataacagagccattggtactttgcttaacagagttacaaggatattagaagttaatctacatatatctcatagagtcttttcccagtgtccttcactctctgactccgtagtctcctcagtccctgctttttccactgacaaggcaggttctgtgtcctgtttacaatcaggatttgtacagtgtggttcacaggtacgtactgtagagcagtcacttcacgaagccagtgagacatgaagtcagtaatccacggtgttgagggacagaaggcgtctttaattatgtcagtctgtcctttgcagctttaatctctgaattctttatttccctgacagcttcattagtctcacgaaggtggtataaataaattgcgtttctggagggtgggtgggagctgccctctcccttcactttttgctgtgagcctactctcccggatggtgagagacgcgtgtgtgcttgttctcacgagggacacatcgtgacaatgagtagccactttgtctttactggaattctgtatgtaaggaaggtggatctcgttgccttgctgatggatttggcttccatagagatgtaggaattcacagggcaacttactttaatgacttgattaaaaaaaaaaagactgtaagtctaattttttttcctggcaaatacaaatcggagagcatagtgaacggttagatttcatatgtaagatttcccagcgagcccctgagatgaatttctgttaaacctatgtcttcagataatcatttattcaacaaatatttactgagcattggctgtgccagtcactatgcaatattaattgtctttggtcttaacgtagaagacattccgcactagtgtttcagttgtcaagagcggttactgacgcagtgtgcgttcgttctactgagaagtgcagatgacggtttcacaggctgacttcagaagcctttgaagtgagcggccccttcccgcttctcgcctgtttgacaaatagagtacacactcgtgccttcgcttccgttgcctgacacaaggagtaaaagtggttagatcaatttttaaaatatgccactggttctttgagaattggcataggatctgtcttgttaaagcgacaccaggtttattagcgtgttcaagcaaacgtaaatgccctgtccttgagtcaactgctgaggtatttattatgctttgtggggaggcatttaaaggcaactccaagctccaccaactatgtgaagacaaggcaggtaaatatcttgtgagctctttgtaaagaaccaaataaggacaaaaacaagataaattagtgcaaccttcctggagggcagcatggctgtatgtggtgaaggactttgaatcacacttgatcgaacagttctacttctgggattttgcccagaggaagtaacaaaaggtgcatgaagactatttcataaggatttttataacagggaagaattaaaaacaatctaaatatctaatgctttgaggttggctaaataaaattagcccatctcctctgagagaatattattaaggcatttaaatgagatggaaggatgcttttatgttttctgcatctgtgatgggcccatgggcaacactatctcgtggccttggggcactcagacgggaggcagaagagttgaggatacatcatttccccaagaggatggaaagaatacacacttattagatatcaaagacgtagttcaaagatcaagatcaggatggccacaaaagcacagaaggcagaggaccaggtcactgaaggttaagatctgttcgaagtatgtctgtagaatggcccaggtacctcagtggagggaccgggctcattgggtgtacagtgtagaggcagagtggatggttagttactgccagtcttttcagatttctggcattggagaggagaggtgatattcttgacgtcctgaagaatatcagtgactgggtaccaggtgtcatgtgttacactgaatcccattagtcatattaatctttaaccctagagtgaagcgatttctccactgactcaagagataaaaacagtgagcgatgatcctgatctcaaattatcacctagcatcacagacgtggtaggtgggagagctaagatttgaatcttgccccaaacccagggataaagagaaatccaaattatgagagccgaaggggtgtgtgtgtgtggtagaattgcatctaagaggagcgggcctgtgaaactagtgaggaggtgtagccgccattcagaacatctgtgggaaaatggaccacatctggtttgctacattcaatatataatacccgtgactggtgcagtggacagtgcagtttgtttggttgtatctgatgagagaacagcccagctctcagaaccttattgttaaactctctggcatgtctatgagcctccactgccctgctctctctgatattggggtactccaagataaaactctacctctcctcctccaccatatcttgcaatacccacatgaaggaagccagttgttacactgtagcattccaacaggccagttgatctctgcatagcagggagccattaatctagagtgcgctcagtttattcattcatcaaacatttatggtgtgcatactattttacaggcctatattaagtactgatgatactgataataaaacatcaacatctctaggggcaggagtggtaataaaagtccagaggaccatgggagatgtgatggtcatagaaaggaaagcatttgaattgatttgtggccaaccagtaaggacagtgagaaaacagaaggcgtttcccgggaagctcaagacatgggtggatttcagctgccatgaagagagatggtagcagcaattaatgggcggggaggaagaaacctgtgggtgtgcagtgagtggccaccattgtctcgatgaggaaggagcctagcccacagagaatagggttctgctggttaggtgccaagcaagaggggaagctccctagttcacggctggtggccagaaaggaaacagctgaacattgttatgggtctaactgtagtggaggaggggatttgtaacagagccaatcactgttgatttgttttctacccgtatttaagtattaaaacactccttaaactatgggagatgacccacctctggctgactccacagctgtccctaagacctagatacttgagcctgagtcttcacacatgttagatttttgaactgaaatacctcccacacacacataccagctcatgttccctggcttgtagaggtgttttagaaagctgtggaactctcagaaagttaggacatggctggcagagggagggtcacgagggacaggatcttgcaggtcgtgctcacctttggttctggtctgcacttcctatccactgccatataaacaggccactactacacactcccacccccagaagcaccagcatgccttcactgtttaactctccttcctcccttaagttatttctgctgagttttgtcacactgacagaaaaggaactagttaaacattggttgaaatccccaccaccactagggtagccaacagcttcctgttaagtctctggagttggcatccatcgcatctctccacagtaagttcttcctcaagtggcaacacatggtttccaattcagggtgtcatagttagggattctgttgctgcaatgaacaccatgactaaatttaattttttcaaatcctatttttaatgatggtccttaaatgctttaacctcccttgtagcccaccacccaccagaggtcatgggaaagaaagggtgcgggggaagtggacctgtttagaaaggttcgttggagcagctcccgtctgcgtcgtctggaaattggcagttcagttcacaggtcagcagcagcagcttgatcggatcgcaaacgcttcacagatacaccagcagtccagttaggtagagtcgggatagcgaacacaaatcagcagtgattgtggtactgcctagcaacgacagctaagcctcagccttggcaggagtcagcaggagggaccagggccaacaggaacaccaggaaaagttcttggctgtgcctctctcagcaaagtgaagatcagcaaagatgcaagacccacaagcattgcacagctagctcaataagcaagccaaggtcagcctccatcactgttcattgagtcctttttacattccctccaaacatcatgggcttccctcagcacttgcatctgtctcagctgacatcactctgccaatcagtctacgtccttgaaaacggcaagaagctgtggcacaccaggtgtttgccccagcaaaataccattcaatacaactgactttccaaagaaaactcaattttccacttccataccccagcaactgagggagatggtggtgggaacagaaagtgggaaacctagaagcaagaactgatgcagagccatggaggatactgcctgcttactggcttgttcttcatagcttattctgactactatcttattgaacccaggactgtctgtccaagtatggccccacccgcagtgggtggggcccttccacatcaattatcaaccaaggaaatgccctacagatttgccttacaagcaatctactgggagcatattctcagttgagggcccctctctcatatgattgtaacttgtgttaacttggaagaagaagaagaggtgaaagaggagtaaaagaaggaaggaggaggaagaagaagaaggaggaggagaaggagaagagggaggaggaagaggaaaaagaagctcacaacaactgcaataacaaaagaacccctcaggacacagggtctggagtattgctgaacttgaccagtcactagggcagtgcttttcaacctgtgggttgcaacccctttgggaattgaatgaccctttcacagaggtcgcatatcagatatttacatcacaattcgaaacagcaaaattacagttatgaagtagcaatgaaataattttatggttgggagtcaccacaacacgagaaactgtattgaagggtcacagcattgggaaggttgagagccactgaactagggagagtaagaataggtacgcatgcctactgtagtggatacaggttctgcaatgacctgaaatgttggatgtccaacaggcacctgctgcattgcctggaaacatgtgtttctgccttaatgtggaagaaagtctgatgtcatggacagtttctctgtagatcttctattgcacacatggaaaactattctttgtgttttgagaagtttgtaatttccctgaaaaaaaaaaaacagaaccttagtaagcatttatataagaagctaataaatgcagagtgcagtgctcgcccctcatctgtgaggggagcccaccaccccaagggatgtcccaagtcttagtaccaaataccaaactctgcacacatgtgcatgcgtgcacacactcacaggtctcacacacacacacgcacagacacagatgacagactccacataatgctttctcactaacttcctcatatcctgtggctctcacatctgtggtgtgaattagtatgaatttcagcaaactagcatgaatttctctccctttcacaatttcatggaagattcattctcaccacacatcttagcaactccagcctgttattttcttggtatagttaagactttccgggggctggagagatggctcagtggttaagagcactgactactcttccaaaggtcctgagttcaattcccagcaaccacatggtggctcacaaccatctgtaatgagatctgacgccctcttctggagtgtctgaagacagctacagtgtactcacatataataaaaataaataaatctttaaaaaaaaagaatccccatctttttatacacacacacacacacacacacaaggggttagagaggctgactgactgactgactgactgactgacgtgcctgtgctcaaaccatgcccttgagagtgacagacccccttcaaacgaggccacgcctcttaacccttcccaaacagttctatgaattgggaaccgaacattcaaatatatgtacctatgagggccgttctcattccagctctacataatccaaatgtctgtcttcattggtaaagaagtggtcaggaataaggtctcattgccctaagagaacaaacctgagcattagactctagataaagaaatgctgtggagataagagctactccccaaggtgagctggaaataagacaggccatgggtagaaaagatcaaaaacacccaaagactattcggggagatggtgaggctgccctcagagggtcctagcatgtgctgggacacaggtcagaaagcagcaccttgagccttttcatggttttgagtccagggcttccagctagccaagtgctcctctctaggatattctagcacttgcttcagtggctccctcttctaggttatgtctcatgtatgcaaagtagtatttgcttattattagaactgtgggattacagactacaaataaaaccatattcagttttggcatttctgtagaatgtcaccagggacattccatatggacacagggttagccacatactgggtgttcacaacttattaatgggatttttctgtgtttgggggcacagcacctcagggccttctcacaggggcaagtcaggagtggtgctctctgagtaaagtggctgactgctacccctggactgttatggcctttgtccagcagcatggggctgttgcaaaaacaagcaaaacaaaacacaatacaacacaacacaacaaacaaaacaagacaatacaaaagaattccaaaaacctcattcacccttctcatctgtcatcagtgagagagctgtgttgtgcgtagttttaaagtcatactattgccttagcacgggagctgtgaccgagttaccagctcctcctgcctctcttttgttcctcccagcctagctctgggatcaaacactccagcccactcccaagactcttgttccagaaggggtttcagggctgcctcatgaatgggaattcagccccacccaagatccttgatccttgaattcgcagataaaagagacacactcagtttgtcactttatagcttgtctcttgtggcacaattgttgtgcacagatatctcccacctggaaagacatgccctcgccaatttataatcttcataatctttataatcttctgccctaaacctactggttttcccctgccaaacatgtttgaccacccgccgcaggctctagctgccctaagatccaacatgattgtggtgtgttacgcaaagcatgacaaaaaaaaaaaaaaaagcccctttctcttttcctgcatctccttctcctcttgggaccagacggtcccacttgtacctttcgtcttacaattggctccctcgtcttctttattgacaagtcaagaaccaattggggaaaaagaccttagccacagaaccctccccttacaggactgcctcaagaatgggaattcagatctatgtacatcagatagtttaccttacccttgtgtggaaattcctcctgaagtatgaccagatgaaaaggcagggcataggggtcctccatttcctcctgtgggctgtggagatgatcacatgcagtcggggctccagcccagttcgcgctgtgttcttcagcccctgtgtgttcacccatctgttgccctgacagcagagctgcttcctaagtgttctctttccttgttactgctttgctcaacaccatggccagaagcaatgtgagcaaggaaggatttattttagtttcttcctctcagtacaccatgaagggctctcagggcagaagtccgcacgtctacctggtttcttgtgtcctggtcctctgtctgcagattcctagccatatagaataaaatggtacatttattgtatccagcaaaagtaaagtcatagatctgcagatgattatacattttttgcttaaagataattctttggtttgaattaagaaacgtaagacttgtagtttcttaaatacttattaagttttatttccattcatatgtatgcgtgtacatcttgggagttggccttgtaacttaggagtggcacgatatcaccagatagttccttgtttatataacatcttgttttataaacatctctaagagatgtttggctttatgaccatttcattgcaaatcctttgaatcttattaacgttttatgtattgttgtattgtcttagttaaggcatgcatggagtgtgtgtgtgtgtgtgtctgtgtgtctgtgtctatgtataagcctacatgcatctaatattgaatcatttgaatatataatgtagaaataaaaatttaatatctggaatctttaactctagaaaattaacatcaatgaatgaaactcaaaaagttccttttctgtactatctcaggagccagagattatgtaacagcaatttttatagatgcctaatggaccaaagtcccacaagagattctaagagaatgcagggaatccattaaacacccttgcattctcttgtaggctaacacctctgttaaactagagggctcgctacttttgttccattttgagcaaatatgtctcttcaaggtcaatagatttttaagaaaatagtttcttaaaaaagttttaaggaaaaaaattagtcttttctgccaagcctggcagtctatctaacatgtattccatttcttttgtcagaggaaaagacaagcatacgaatctaaccttatctgccatgggctgcagctggaagcaacaagatctgtaagtggtagtttctttgaaaccatggctaaccactgtgcctgagatcttatgcatctcctggaatggggggcttgacacaggaaatacagccagagtgggaaaggaggcaaacagagcctgtaccacaggatggtgagatggctccatgtgcaaagaaccctccacaaaaccctgatggcccaagttcagtcccgggattacatggctgggaatgagggctggccactgagagtcaccctctgacttccacatgtgtgaccaaagggtacaccacatatacacttctttcttcgaaaaagggatcacttcagttttataacttgctttttcctttaatacaaatactacatatatatagcaacaaggtataatctcttgacatcaatggccatatatatatagcacaatggatagatataatttaagcagcccatttacaggcttagaattttttttcattcgtattacactgccatgaatatgttattccaagtcactaacagattgtgtgctgacaaatatacagtgtgcttttctcacttaaaatattacgaggttgagccttgggggatggctcggcatttaggaacatttgctactcctgtggaggaccaacgttcagttcccagcacatctgcctgtaacgctatgctagctccatggaatctggcactctctcctggctgctatgggccacctgcatgcatgtgcccgcacatagtgtgcttgcacgagtgctcatacctgacatgcactcacagataagacttaaaaaataaatatttaaaaattactggtcttatgtttcttaactcaaactaaagatttatctttaagtttatatacacatatataatcatttatagagctgatgtcttcactttggctaatgtcctgtttacatggatttttattttaaaacctactggaacaggggccaggaagctgtgccttcaacttgtaaaagtcgtcgtttgggttctgttgtcccttcataggtttctgatgacaagcttgtgttcgtaaaagtgcacgcgccctgggaagtgctgtgcacctatgctgagatcatgcacatcaaactcccgctaaagccaaacgacctgaaaacgcgctcgccctttggcaacctcaactggttcaccaaggtcctccgggtgaacgagagtgtcatcaagccagagcaggagttcttcactgccccttttgagaagagccggatgaatgatttctacatcctcgatagagattccttcttcaaccctgccaccagaagccgcattgtacgtccaaacccaatggggtttttgttttgctgtgacttgaaacctattgcatagctgtggttttgtttttagaaatagaagcctgctaactattattagcagtgttggtatgatttcagtgctgacggttttctgctatagtaacaaacaatggtcgcatgggctggttctatcgtaaaaagacacatagtctgttttgtcatcttttttaggtttatttcatcctctctcgggtcaaataccaagtgatgaacaacgttaacaaatttgggattaatagactggtcagctctggaatctacaaagcagcgtttcctctgcacgacgtaagtcaaatggcaaaacctaaggtgtccatgagtactcggtgagacagggaaggagtcaacttcttgacattctgtctcttcctcagtaagacagagatgatgtcatgaaagatcacaagctgatccagggcaagaaagatgcagagagccttctctgatggagcccaggggtagagacggtgctgggttttaaggactagggggaatggacggttccctgccgtgagcaacgtggcaacaacacttcatacagggcagcactcactctgtgtcagaaagcaaagctctactctcggtccccagctcaatgcccttgtgacacgtctattctccctgctccctcatgtctttatcagtgaggaatgcattgtaactgttgctacctcatggagttgtttcaagagtcaattagatttatgtaaactattagtcccggtcatataaatggtagctagtttcataagtactgacagatgtctgtcattaccagaaaaaaagcagggctatttgtttgtttgtttgtaaagaaaacatgttagaaattctcatttggcattttctgtaaagagacttttcccccttgaaatactatttccaggctgtatcgtggcttttaaaatagggcttatcggggttcatgtcaacagtgacaaagcaccatgttattggcactaaggaaggactgttcaaggggtatagcggcccattgggttcaggagtatgtataaggctgccaacatatctcttatggactgaatcttttaagtacgatcactccagcccttcagggccacctatatgtgaggccattatatatccaaaagtgtttactgtgtcctgtcattgaattatgctaaataccacactgatcccattgttacttcgttgcacttattaccaatctgtctaaatctctgcaaccaaagaaaactaaacactttgtttgaccattgctactttgtgttatgtactgtgggggttgaagacaatcttgaagtgcacaatgtgtccaaacaaacccagaacatcaaacaagtgcttgactcacatggataagcagagagtgggagggggtggagatggcaaggacggagtctccagggagacccagtggccaccaggcctgacagtttgttctatttttgtgccccagcagaattagcagtggaaacttatgaacctctgggacagttgcatattgttctctggctgttagtgtgggacaccaccatcctagaatgttcggttgacatttgtctgtgctcccaatcttccctgtctctaagtctgaagtaatcctgtggtggaagtaggagccaaacaaagaccagggctctcaccaaggatgggttttgtgatactgcggttctgtacatgaataggagaatgggtcagacaggagaacaggagcttggattcaaacagagtctggaggctctgtttcttgggtgactctgctacttattttccatgtattgtcaatataactgctgaactgagtgacattgaaggaccggctttagcagtgacctgccgttcaccagccagtgttctggtctccccaccatccaagatggggtaggctttcagacagatgttccttgattgggagaacctacagtcttgagtggtcctgtttctcatcgattagcacagccttacttcagggcatcagcatccttggggctcctaccacctggctgccttgctctctaggagtgacagctgctagcatcaccatccaagcatccattgctatctctattcccaaacaacttccaggggcaacaatgatcatcacccttattatagaatcactaattattaaatggcatgtctgtcccttctgggagggggatggggggcagttccctcagtggccattagtgccctatttaagaatcagatttgtaaactgagggaggaccctgaccctcatttctttctttctttctgcttctcagtgcagattcaactatgagtcggaggacatcagttgtcctagcgagcgttacctcctgtacagagaatgggctcaccctcggagtatatacaagaagcagcccttggatcttatcaggtgagcaggagagagtagtccactgagaaacactcagagatgccctgaggtatgtgcagggcagctgtcacacaccattgccaaccagaggagttcacccagctttgtgttacccataggtttctcatcccagggtgtcttatgttcccacagaagatggatcataacttatgtgtctcagtgtctgctcttaaatcagggctgaaacctgccctggatttgatccctggtactgaacataagatccagtcccttcttgccctgtggtccaacggtctcactggtctcacagcccagcttgattgacagtcatagatgggtcttctgggcctggccgactctctctggagtcatctcgtgggcacactctcttggccccagcattttagtgggcagaaagtatcagtgtgttcccgccacgaatggaaagattcccttcactttcaggaaatgcccagggattagagattacctgtcagggacttagaattctttttttgcacaggagtaagtgttattaactcatcgtgtgctgttagatgttatttcattacctcataggaaatcgtgactgcatggggcttgtgtcttagaacatttcctattagaagcaggtagtttgggcgctgtgatgttgaagcatgcctctgtcctgtgtgtctgctgcagtgacatcatccctgtctaatgacttgacctgctttgtgcagggatacttgacatgtagcatcgtgtgctcctgttggcatggtttcctgtttcctctgtctttgtgaaggcaaaggaattgagtggtccagtttatcgttggttagcatggcctcacttcagggcatcaacatcctcggggctcccaccacctgctgcttgctgtctctattccccaataacctccgaaggcaatagcgatcactcattaaaaatcatttgttagattaattatctcataaagactcatttaattatttcattgggtcctctatagtcctgcctcgtttaatattatctggactattctcacacaggtgtacttctgtgaactctgattaccctgtagataaaatagtatgtggatgtaggcatgtagacagtttccctgggcatccatgagggacctctggatccagaggtatccagagcctctgagaataaggaaacctgtttgtaagaataaggaaaccctttgtaaaaggacatcatcacctttacatggcctgtgcccttcctcccatgtaccttaaatcatttttcaatcactcctaattcctaggatggtgtaaatgacatgtatgtgggtggatgctcttctgtgccatgtaaaaaggcaggaagaaaagtctcaatatgatgaatgcagatgggagttctgccccccccccatccccaccccgtgtcttcaggccagactgggtgcagtcagcatggtagagctgtggactccccacccccacccctgtgttatcagttaccagttgactgaatccctgggtgtggaacccacagatggagggctcactatatttgaggttgtcatttgtgtgacgtttctgttttgttaatgaccttacataggaaatcagttgtgtagatggcacagcaagcagtaggttgaacgggctcttattttcttttttttttttcattttccttctaatttattgactcagattttttattttataaaattatgaatttgattttgtggtgggcatacagcactgaatgttaaccaacagaaattaaccactctcccaccaatactctgtactaaccaacttttgttcttcctcaatcacgtttcccttccctccgaccctctccataatctggctctaaaatataaaaataatataaaatatttttttgtttctttttttttaattttttttattaggtattttcctcatttacattttcaatactatcccaaaggtcccccatatccacccccccatcccctacccacccactcccccttttggccctggcgttcccctgtactggggcatttaaagttggcaagtccaatgggcctctctttgcagtgatggccgactaggccatctttcgatgcatatgcagctagagacaagagctccggggtattggttagttcatattgttgttccacctatagggttgcagttccctttagctccttgggtaatatctctagctcctgcattgggtgccgtgtgatccatccaatagctgactgtgagcatccacttctgtgtttgctaggccccggcatagtctcacaagagagagctatatctgggtcctttcagcaaaattttgctagtgtgtgcaatggtgtcagcgtttggaagctgattatgggatggatccctgcatacggcaatcactagatggtccatctttttgtcacagctccaaattttgtcaataaaccaattgcatttgttaactgctcctaccccgttctaacagtttcctttctttgcttctccagttacctcctgagcactcaggttgacaacctttgcctataatttcatgggatcatcaaaagggcgaaatataaccaggcggtggtggcacacgcctttagtcccaggacttgggaggtagaggcaggcagatctctgtgagttcaaggccagcctggtctacatagtaagttctaggatagccagggctacatagtgagagaccttacctcagaaacagggggagggggattctttctgtaaaagtgaaccgaggaaatgagaaaaggcttccagcccacaagccctttggcatcacttaagcctctttcgaagtacagtaagaatatgttaaagacaggacaaaatgacagggtcttacctccaggcaccatcccaagcctgctattttctggctatctaagagccagacaccaagcccctgtcatacgaaagtgtcaccttatgctcctctcatgtcctaattcttctccatgtgggtgccagccttcccttggagcctgtggcactgggctgacctctgacctgggatctggtccagcctcctggggatctaggctatgcttctagatggattccctactagatgagagtcttagtgagggttttactgctgtgaacagacaccatgaccaaggcaactcttgtaaggacaacatttaattggggctggcttacggcttcagaggttcagtccattatcatcaaggcaggaagatgacaacatcccggcaggcatggtgcaggaggagctgagagttctacatctcgtcatctgaaggcggctagaagtctgactttcaggcagctaggatgagggtcttaagcccatgcccacagtgacacacctactccaacagggccacaccttctaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgctttgcacagctttgcagacctgggccagtaaaagctctgaattcttagggtccccgtgagaaagctggtgcatttccatgtttagaaatgactttttcttaaattaagagatgtatgattgaaaactcaagtggctttgtggttttgttgtcttacttgtacgagcttatcccatataatgtcggaagggggaataacgcagtacctcataacctgtttgcattgggtactggaatttaaatgctagctgcatcttagatagtggttctcaacctgtgggtcgcgatcccttggggttaaatgacctttgcacaggggtcatttaagaccatcagaaaacatagatatttacattatgattcataactagcaaaattacagttatgaggtagcaacaaaaatgattttatgactacactttttatcactacaacaaatgaggaactgtattaaagggttatagtacaagggaagttgagaaccactgatctaagggggggttgctgggtgctgggaacacttgcttttgaggtgctcttgttaattgtattatcatgcatctgcttttggtgttctctgttgtctcctgatggactggcctctgtccaggtgtaattgggtagatggtggctcacgggcttcagtgctgaggtgatgacatttttcaagccctgagcatgtgagactggctctgaggctggatggttgtcggcctgatatagagaaacattgcctgttccactgacaggccacagaacccgtgtgcccaagatggctgttggaagtcttgtctctttatgcgaaaaagaatctgcaactgaggtctgaactctgctgcctgctccctccatttgtcttctgcttcttcgttgggctaatgttgggctaactcctacttggcatcccagaatagatcttcagaatgagagggcttcacttttgtagtgtccatttgtgtatgcatatctgtatgcactggatggtgacgatggtggtggtggtggtggtggtggtggtggtggtgtgtgtgtgtgtgtgtgtgtgtgtgtgtgtgcctgtgtgtgtgtgtgtgtgtgtgtgcctgtgtgtgtgtgtgtatgtgtatgtatgtgtgtgtgtgtgcctgtgtgtgtgcctgtgtgtgtgtgtgtgcgcctgtgtgtgtgtgtgtgcctgtgtgtgtgtgtgcctgtgtgtatgtgtgtgcctgtgtgtgtgtgtgcctgtgtgtgtgtgtatgtgtgtgtgtgtgtgtgtgtgtgtgtgtgtgtgtgcgcctgtgtgtgtgtgtgtgtgtgtgtgtgtgttagataagttggatgttggctgtggtccatgcacatgaatacaggagcatgtagaagccagagcagaacttgtatcttcctcgcttgctgtcagtcttaccatcttgagacagcatccctcgctgacccagaagctcacccgtttcctaaactgactcagcactgagtttctgggatcctactgtctctctcccccagtactggaatataggtatgtgcagccatcattaagtgggtgcaggaagtccgacttgacactgttgttcacacagtgctggctttggcggctaaaagatgaaagagagagagggtatggcctcttcctccacagtttctgaaagccacccaggcacaggcagagtggggaagagccgggtattttttgcatgaaggccctgagggtgttttgtgaaactgagaaagaaaagtcttgattacaggggagagcccatgaggcggaagatgccagagccatgagatatctaccaggaagagctgcatgcagcgagtgcaagcattccaggaggcttgtcccttgcagccagcagaactggataggaagagtcatccaagcactttgaaagcaaagtctaagacagcagattcagaactatgggatctgtagtttcccctgctgggtcctggtctgtctttggtccgttatttcttcactgtgcccctgtgcctctcccttcagatgtataatctgtaccattataggatgaaagtgtgtggtttgctttttgattctttggaggaggtgcaattaagggttcgccttaattctcaaacgaaacattgggtttaggacttggaaatttctgtaaagcctatggagatttttgaggttgggttaaatgcattttgctttatgatgcatccgtaagcctatgggggccaaggagtggaatgtggtggtttgaatgagagctgtttcccagtggctcagtcatcttaacactttgtccctagcggctggcgctgttgggggaggtttaagaagtgtggctctacaggaggatattactgggatgggctttgagagtttagagtctcaccccacttccagtttgctccctgtgcatcatgcttgtggttgagatgtgatctctcagctcctggatcctgccacgtgcagacatgcctctgccgtaaggaacacctctctggagctgtaagccaaattaaactctcctataagctaccgtggtcatggtatttatcacagcaacagaaaagtaaccaagacaacccccaaagaagctagtgacccactagcagtgatctcctgagtggccattcccttaggctctagaaagcactaatgtacttgtttctatagatctgtggatattctataggtatctgagaatattctatagttcttatggatattgtgtaagtcaagctatgcagtgcgtggtctatcatgattatatggcctctggtgattatgtggcgtctcatgattgctttctaccactcacgctgtctcgaagtcctttgttgatgtatttattaacaccccaatcccttttggtgccaaatgatatcccgttgcatgggtatgctacattcccaatctgtacatcaactgatggatgctgggatgctcaggaatattatgtctgctgagaacatttacttgacgggttgtcacggggacaaaggtttcatgtctcttgaggatataccaaggggcggggtttctgggctatatataaagtctctgtttgacattgggagacactaccaaagtactgtccagatgcctgctgttttacatccccaccagtcacctgtagggactccagattctccagggaccaatgggtactttctttggttttgtttttgttttggaattggctgtgatggtttgtatatgctcattccagggagtggcactattaggaggtgtgaacctgttgtgtagatgcgtcactgtgggtgtgggctataagaccctcatcttagctacctggaagtcagtcttccacctgcagccttcagatgaagatgtagaactctcagctcttcctgcaccgtgcctgtctagatgctgccacgctcccaccttgatgataatggattgaacctctgacgctgtaagccagccccggtgaaatgttgtcctttttaagacttgacttgatcatggagtgtgttcagcagtaaaaccctaagatattggccatctcattcggtgtaagtggtatctcatggctgttgtgggttttcccaacctagactggtgctgagcatcttctctgagtttatcactggtgtgactttagagaaacgtctcttggaatcttctgcctgtaattgtgttgacttggaattaatagttctctgtgtgctcagcatagaagccccttgtcagatcctgtcttcttctgtttcaaataatatcacaacagacaggggagtttgtgagtaatgagctttttttctcacaattttgcgtgttaggagctcaacttggtgtctcttgggggctgggcagagtttggaaggagtcaatattgtatcctacctggcctgagagcccagtggttggtttgtttgtttgtttgtttgtttgtctttaacttacatgagttcctccttcattcttgatgactggcttcacaggtgtagaatctgggtacacagcttgcttttatgacttagcaaacactgtcccactctttctggaccctgggtttctgacagggagtcgtgttttctttctggtgagctttctgggtggccagtcatgtctgcctctgtctctgtctctgtctctgtctctgtctctgtctctgtctctctctctctctctctcgctcgctcgctccattctttcctaggactctctctctctctgtgtgccctttgagtatggtgtccctaggtttgaatctccttgagtgtatctttctacaatcttgccgagtttctcggatgtaaagatgaaagcattcatcaaagtttggaggtcgggctcatccttcaatggttccttccctgtatgcgacttgcccagtgcatgtgctgacggtgtgtctgatagagttccctggtatttgaagctgacttttcaggtctttcctactcctttttctttccatttttcagactgtatagcctgaagagatacattaagtttcttgtctgcagaggagagcctttcaggacttccgcattgctgttactgtgcttggcttcaatgtcttgttctcgttagcatactgctttcctcattcagtgagacgccgtcacatcgtttctttaatgcccgaggtgtgacttcctttagttctgagttcatatttgctcactcctgattctgatgcaccttcgacgggcacattgagaatttgacattttaagtattacactgtaagagccatgggaatcagatttccccctctgggtttattgctacttcttgttgcaattcctctgccacccttgttcctttcctagactgattccatggtctgtgttccctgccttgtatgggcactgaagtctgtgtgtgcaatagatcactacacgccaggtagattcagtgattccatccatgctgggtcctgtcctttctccttgccatgtgtatcgggaatgtgtctgacactccaacagactgaattctgttctcctaaggcttcctttctggcttaggcagaaggccagggtcagcctccaggatctttcagacctgtccaggcttatgcactcttatctagaacatatgcacgtggcctcctgcatcacacagatatcttaaaggtttggggactgtggttacaccatacccacttcttccttttaggtttcattagggctgatatggccacttcagacacgcttcccatacccatgttcctctgggttatttgcaaggtcacctgggcagctgtaatgccgttcgtcccccattctctcagtgttcatctgaaatgtcatcccctctcagagcagtctacaatcccctggtctattttcattaaatctcaaatgtgtcggtaacttcctctgtggttttcgtttccatggtgacagcatttctccttatcctaagattgttgagatattcttttgttgttatagtctcttaaaaacatttcttttattttcaattacatgtgtgtgttgatagcacaggtgcccgcctcccccttgccccccaaagccagaaagggtatcaggtcccctggagctagagttacaggcagttgtgtgctgctctctgtaggtgctgggatccgaactcaggtcttctacaagagcagtatgttctcttacctttgaagctcagctctccagccctgtctgtttctttttcatattctgtagctgtcattcttgtttctcaaatagaattgacttttatgtgacacaatggggcttatttgcattcatgttctatcatgtatcatgaattgagctgtctgttcctattgcctaaatcgggggccagatctttggatatacgtagaaacctttgcatgttttattttatgctgctgttggtggtttaggctgtgtcagctatgtctaattggtctggtatggactttgggtcttctgtgtgatttgtagag

SEQ ID NO: 1052 - DNA, 231 bp, Mus musculus
ggtttatttcatcctctctcgggtcaaataccaagtgatgaacaacgttaacaaatttgggattaatagactggtcagctctggaatctacaaagcagcgtttcctctgcacgactgcagattcaactatgagtcggaggacatcagttgtcctagcgagcgttacctcctgtacagagaatgggctcaccctcggagtatatacaagaagcagcccttggatcttatcag

SEQ ID NO: 1053 - protein, 77 aa, Mus musculus
  VARIANT (1)...(77): Xaa = Any Amino Acid
VYFILSRVKYQVMNNVNKFGINRLVSSGIYKAAFPLHDCRFNYESEDISCPSERYLLYREWAHPRSIYKKQPLDLIX

SEQ ID NO: 1054 - DNA, 66312 bp, Homo sapiens
tgctcgttgcagcattattcacaatagccaaaaggtggaaacaacacccgtgtccatccacagatgaatggggtaaatacagcgtagtatatctgtacaacgaagtattattctgtcatagaaaggaacaaagttctgatatatgctacaacttggatataacttgaaaacattatactaagtgaaataagccagaaacaaaaggacaaatattgtataactctatttatatgaaatatattaaataggcaaattcatagagatagaaaaaagattagagataactagggactggggaaaaggggaaggggaaatggggaattcgtgcttaatggttagagtttctggggtgatcagaaacattttggaaatagtggtgatggctgtgcaacattgtgaatgtaattattgccactgaattatatattttaaatggctaaagtggcaaactttatgcttatatattacgttactgcaataaatttttttaagatggtaagagaactaatgaattcacagtgaatctgataggtttgcagtgtacattgagtttttctataaaagcattaggtaatccagttgtgtgtgagaatcagtaatgtgatagttgtttccagctcttccaaaggacgcatgtttaacttctagatgtatttttagagctgaactgttggggcagaggaggcttgtaggaataggggaagagttcataagcagagctgaaacaacaccaaacatggaaatgttacaaggtggagaaattgtgcttactgaaactcttctcagaaatattgctgtttgtggatgatagaaatcttcagagttgtcacttaaggtagaggtaggagggtaagaagcgtcaaggactcaccgaattgtccattcccccttttgttctgctgtggaatgttttgtgctgctggtaagaacatgttcctatttggtgagttgctggaacagtgagcagtgggcagagtgccggggaggctccttttttataaatattgtccaaatatttgatgagtatttggtcttgaagggacactgtattattagtctgctttgtgtgtgtgtcacagtatggtgcagtgcaatatggttctggaaatagaagcactctcttattatctaagcaattacattttgaggaattgaagagcactagtaactgtactggagtgacaaatttataattaatttcatcatttgtttattttctcatttattgagcatctataatatgcaaggtattgtttcaggttcttggaatatagagttgaataagacaatggcttgccctctaggagctcatggactagtggagaagaaaaacaatgaccacacagttttcttgtgataagaaggatcaacacctatcttttccccagattttatcttctatagtggtgggtagttgtcaaaaagtaaccatgtgataattttgaattctgttcaatgtgagctgcaaattttgcttataaaaatcactctttaaaaaaaaaaacctttttcctataactggatgtccaactgaaaaaaatactgtattatattatattttatttttttgagacagtctcgctctgttgccaggctggagtgcagtggcatgatctcagctcactgcaagctccgcctcccaggttcacaccattctcctgcatcagcctcctgagtagctgggactacaggtgcctgccaccatgcctggctaatgtttttttttttttttttttttttttttgtatttttagtagagacagggtttcaccgtgttagccaggatggtctcgatctcctgacctcatgatccacccatctcggcctcccaaagtgctgggattacaagcgtgagccactgcgcccggccaaaatactgtattttaatagccaataatgcaatgattttttggctccacctataataatgtggcaggttttactagacatccaaattagtgctataggagcatgaagtggaggcaagtaacttaacctggcacataagcagtgacattgaaagaaaaatttgaagaaagagtaacacaggggatatgggaatgtgcattccaggtaggtagaaaacacttaagatgaggttgaaaataagaaggatataatttagtgacttaccaaaatattgatagtgaaggaaagagaaaggtcaagaatggctcccgcttttggattggggaattgaactgatgataatacattattcaagaagggtagcacagcaaaggggaaccttttgaggaaaagcattttttaccagaatgcggagagaatatttattaattttctaaattgccaaatgtatagtactggaccctggccatgagtaaaaaatgttcttaccctgacaaagtttacatcttcatgaatgactttctttttccttctttgttttagaagcagtggctgaagtggtaataattgtagaaatatctttgttgagaagggggccaggtgcagggagggagggaaagctcctgtcttaagatagatgggaaagacagagaactgtaatgaaaactatcaatttgaatttggaatttgcattctagaaatgattagaagagactgccactttttttgttaatgtaaatagtaagtcattgagtttacttgccagtaacaaactgggtaagagactgatccatccagattcagacatttcctgattgacatttcttttcattagaaacaagtaaccaacattgcccagaacgttgtagttattcgaaaatgattgctgaattaatgttatccctttctatgcttaaatttattttaatatttaaaaaggaaatgaaggacagggattgtcaagatagaagtcagaaggaaaaattggtgcctaatgaggcaaaggatgataaaacgtattaaaaattgaagtgaaaaattatgatagccaatatttatatagtacttaagagtcttcacgtcagtttcatatatatgtcagcttattctccacagtaaccttctgatgtaggcattataatctgcattttattgatgaggaaacagacttagcgttaagtgaggtgcctgagcctcagggctaaaccatgtagcgctcttatgattcaagtccattgtcctgtgtagcaatacatagccatcatgctcttgaaagctacgcttttggctttgtattttatgttttattactaacattctttgcattaataatgactgagtggctctattttaaaatctcgttgtaatatcacaaggcctatactctgcaagcctacaacctcttgctaatataggaagtagaatttctctcacctcattgttcaccaaaatatggcaaatcctgttaaactgaggccagagaaagagatgttggaaccccttagaacaattatgactaccagagaatgatggaggagcagcggggcggggatagactcagctgaagtgatgtggggagtgagactgggcaggcccagcaatctggaaagcatgaagcgacgggaaatggtgggccctgtatgtggctgcttttactctcttttttatttgtttattttgttttgtttttgagacagagtcttactcggttgcccaggctggagtgcaggggtacaggggcccaatttcggctcactgcaacctctgcttcctgggtcaagcaattctcctgcctcagcctccagagtagctagcgttacaggcatgtaccactatggctggctaattttttaatttttagtagagacggggtttcaccactttagccagggtggtctcgaactccttacctcaagtgatccgtccacctggcctcccaaagtgctgtgattacaggcgctttttaaatttttttatttttatttttatttttatttttgaaacagagtctctgtcactcaggaagctggagtgcagtggtgcggtctcagctcactgcaacttcagcctcctggttcaagtgattcttgtgcctcagcctcctgagtagctgggactacaggcatgcaccactatgcccagctaatttttgtatttttagtagagacggggtttcactacattgcccaggctggtcttgaactcctggtgtcaggtgatccaaccgtgtggttgcttttaaaataatgactggtgagtgctggcattcaggtcaaatattagatgtatgctgagatccagttttcagaatggaaagaagagtttcaggtacaagacagcgtggcagatctctagatatcgtgcccaatctggatatgtgaacatgtcctcattctcaaggtgatatgggccattcctttgacatttctttagttgtgtacgttgactagatcatagaattcctgaggttagattctgtaccctccttatcttgatatctgtgcttacatcatctagctcaatccctggcacacgaatgtctttaaccacttgccagagtattgtatctgtttaccctgtggagctttcccattagttctaattgcgaatgctatataaatttcactacattgtttttttcttttttttcttttttccaaattgtattagtctgttatatctctatctggctatattgaagcagttatttgctgatttttaaaatttatatacaatactattctaatttcttctaaacttatatctaacatcaggagttctttggattattcacagcagctcaggagacaaattaatgtattttaaaagatgtgcaactttggaatcaggtttagattcccattgtgtcactttgcttggttaacttcatgcagccaataaccttaattattcttcatctgtgaaaacgagggacaaaaataggattaaataagataagacatttagaagtaccaggcacaaaatagtaggtacatttctgattacgtgacttcatatcattgagtctgttacatgaacttaatttgtatttatatagtgctttatttttttttaacaacatgcttgtgaattgtcatttatatctttgcccaactttgtgagataaccagggaaagtaacgttatcactagcattagataaataaacttgagaataagcattgccaaggatcatgcagctaagaaattacagaatcagaacttgaacccagtcagtcccctcagtctatacccagtgccctttgtgccaggccttggtatacttttacttgctctctctctatatattcactatctttgataattttaatggcaaccaatccctgtaacagatgagtcattggacccaaccacctgccatgctagtgctaagttggataaattgttgatgcctaattctgattatctttattcctagggcactacctattaggtatttggggttttaaccaagagtttcctgagatcattttgtgttttctcatagataatagattgtctgagttataaacttgtagacaatggctctttttattggccagtttatataagtctcaaacaactttgctgtatagattttctctttattttacaattgggacaatggatgttagttactccatttctaattggtagacaagtaatcatgtgaactgcagctttctgtagaggcttccagtgttgcattattaatatgactgggcctctagaaaattcttttgggctgttgattttagactatcaaataagtcagaagcagtaccaccaaggactttattgcttcaatttcactatactaattgcattgataaaaatttttaaagtatgctcttttatttttcactgtgttatataattaattctattgaatttaggaaaggtagctatttagtgggtttcttttgaccgaaatcatcaattattcaatgtttacctatagtaatccaattgatagtattcttacagtactccataaatctgtctagtgtggcacttagaaatgacactaaaattaacattaattatgtctctggtttctttcttcaagaaaacggaaccttgtctggttcttcttggcttccctagggccttaccacacagtgtgcaaaatataaagtagattttgatgtttgttgaacctgattttgaactgcactttcattgtgcatccatgcgaaatcccactgacgtatcaagaccaaggtttctgtcatcatattagaataactattttttgttttctagtcagccgtttgatgaacagataacatagaggtctcaagtactgttgttccaagtgctgaaattaaatgaactaaacatgatgccactgaagatagtacttttgctgtataaggctgaggcatagtgacaggactaaaaatacatttcaacatattacgttaagaaaaacatgatttatataaggaaagaaatgaaattaacatatttgcctttttagaattttgtcttgattctgctcattttaatacaaaccctcagtcaccttgattttgactattttatttttgctgagaaatgaactttttcagttgtgttagattaccataaatgagaatatcaaacagtaactagagcccctcagtagtgggggtagaattatattggcctcataaatcatttgcttcccagcactctatcaggtcatgagagcaagagctgtggctttgttctacctagatgatgtttcaataaagccatttctgtttttattcactcagatttacagttttttctttgtattgacattaactagtgaatctattagtttccattaccagcagactaactaaaactataaatagttctaatttctttcacaaatccattcaagctacatagataccgtttattggatagaacatctgggtaatcttgtttgtcctgtctttaggcaaaatgcatactttcttaagcttgtcttttcatttagaaaaaagaaaaaaatcaactttagcagctccgtctgttgaccttagataacagataaattgggtatctaatcatctaggaatctagataagatgccaagtcactccatcggatttataatactggtgtaaaaaaaaaaacaaaaaccccacagtattatgtttccttgtttgctggttctgccaaaaaccaaaatatcataaataccatagatataatttttttaacatctgtcttaatactataaaaagattaggtcttttcttccaaatgtaaagcaagctgcccagcactaacttagaacacacttatcatagcctagcatataagcacattttagcaagttttaaagatggtctgtaggagtgtaattatcttggacaactgttgtactggaataaccagtttagtatgttacaactctctcagtgtaacagactgtgtggtgattactatagccctccaggagttctcagaggcaagcaccttaattttggcaatggttgcagctcttcaagcctttgctcatctcatctgttttctgtttctgctttggttcacacatagggtgtcctctaatgaactcagtttttcagaagagttagaatcacttgattgtactgtcatttctactggcatttcttttcaattcataagtatacaaagatgtgaggtattttttcctcagattctgtgtgaacctaaaattgaatccaggccggaagcggtgactcacatctgtaatcccagcactttgggaggccgaggcaggcagatcatgaggtcaggagttcaagaccagcctggccagtatggtgaaaacgcttctctactaaaaatacaaaaaaaactagccaggtgtagtggcacgcctgtagtcccagctacttgggaggctgaggcaggagaattgcttgaacccaggaggcagaggttgcagtgagcccagattgcgctactgcactccagcctgggcagtcaaggaagactccatctcaaaaaaaagaaaaagaaaaagaaaaaaaattgaatccaaatattaggagatttcttagtgaggtgccaaacctaagtatttggtaactgaattggctaaattattggctgatattttggttttgtaaacaatcacatagagatctcttatgattctgccctatatgaatgttgagttttcttcttttgggtcactgaatgtttctagatcaataggaacccagccttctcttctataaaagcttttaatggattaagggaaaacatagtatgcatttttaaaagtcactacaaagccgagataaatcacacacaataaaattaaagcattatttatttctttctttttgagacagaatcttgctctgtcacccaggctagagtgcagctgcatgatcacagtcactgtagcctcaacctcccaggctcaagcaatctttccacctcaacctcctgagtagctgggaatacaggtgcacaccatcacgcccggctaattaaaaaaggtttttgtaaagatgtctcaccatgtttcccaggctggtctcaaactcctgggcttgtgcactcctcccaccttggcctccaaagtgctaggattacaagtgtgagttatcatgcccagccaaaaataattttttatagttttatacttattccatactcaaactctccagttttgaaaaataagtcctttataactggtttgtccaagttaggatccagttgaggaccctatattgctagtggttatgtcctttagggctctttaaatctgatctccctttttaatgtcattgacttgttaaagaggctggacctattgataaatgagaatatttatttaaacttacttaaacattaaatctttaagcttacttaaatatttaagaatatctctttacatttattcagaacattttcttacatagcaaaaattctattcaaatttttgcaagttaaaaataaaaaagttctttgcatctcatttgtttaaaccaggatccaatccagaaccacatgctgcaaatgattgttttgttaacttggaacaattcgttttattcatgtcagtaacttgttgacaagatgaaactatagcgtcttacagaatgacctaccttcttgatttggtttctctatccctctaacatggcacttgtccaatatggtagccactagtcacaaatggctattgagcttttgaaatgtggctagtctgaactgagatgcactgtgagtataaaatatacactggattgctaagacttaacacaaaagaggtaaaatatttcataaatagtttttacactgattacatgttcaaatgataattagggtagtatgggttaaataaattatgttattaaaattaatttcacctgtttctttttttttaaaacgtctctactagtaaattctatctggctcccattatatttctatcagatttaaaatagccaggcatggtagctcattcctgtaatctcagcacgttgggaggctgagacaggagaatcgcttgaggctaggagtttgagactgattagcctgggcaacatagggatacccctgtctctacaaaagaaaaaaaaatgttttttaatgttttttaattagtcaggcatggtaatatacacctgtggtctcagctacttgggagactgaggtgggaggatcacttgagcccaggaggtcgaggctgcagtgagctgtgatcgtgccactgcactccagcctgggtgacagagtgagaccttgtctcaaaaaaaaaaaaaaaagaaaaagaagattgctacccacaaagggacttcacagcagtaccctgtaatagaaaacagaacatcagtaaagtgtttcttagttagacttttgtaacatttgcttgctgtgtaccagttaaatgattttcagtggtagaccttgcctagagaattttaagacctagtgttctacaaccctggcatcgtctggtagatccaatagatgaaacagctgctacatattttttaatatatctgatagctgaaagggttaaataatataaacctgtcaatgtgctaccaatgttaataacccggtgctgctgatttaaaagtacagaactacgtgagccagtgcaggttcatgcttcatttgtttatatattcattcgtttttagtgttggaaaaccttggacagacaattgtccccgatttgggatcactggaaagtcagcatgattttcgaaccccggagtttgtgagtactattcctttatcttaaatttgtattcttaagctaagagatttttcacaaaatgagaaaaaagttcttttatgaattcattccttcaatggctgtagatcctacatagatcttattgcagggactgtgcgttcagagctctggtgtctcttgggaataggttgctgaacttgattgtgtaagcatcatggtctataggtttgttcttcatattgttcatgtaattgcaaatgggagttcactttgtaataaaatagcatcttgtttctgaaactcctgttccattcattgataccattgctatcagtatctgttgttagtaactctggaaagcagtctttaagcatatacaggtatattgaccagtgccagtcactggtagcgaacatagtctactttccctttcatcctggagctttcagtgatacaacctacatgtatcttgtagggctaggaatattctgttggttgtttctaccagaagggaactaaatgctcccattaaattggactcattaaagattagccatggttcctacccttaaggaattaaaaatcttattagaagctactatgattttattaatgccttttttaaagaaaattaagcacataggatgccttgtgcaaaatatccttagtaaatagatttttacattaggctcatttggagggcggggatgggaacaagtgtttctgtgactcatgtaccatattattgcaccagatatgtaggaaaaacatgccaggatccacttacatttcctgatttttgtccctgctgcaaatggcctaccactttaggagtgcagaaatgtttttttatttattttcaatgtgatatacaatcaccactccagtaattggcagagcacaattgtattattggtaaagaccaaaaaaacctcattatgtgctttttctgttcttgctcactctttatggattgcctagtcaattcaaccaagagtaaagaaactagagagtgctctggactgaaaagggatggcacataaaactgtatccacaatgccattttatttcaaagtgtgggactcctgtggtgtactagcagattgcctactgtgaaaatcacctggatataatagaaagacgtagtattcaatgacttccctattatattcaataagatttctggtaaagggaaattgtgcatgcccaccaatattcctgcatcttaaagtagcagagcaattttgtgggttttctaacttttgcagttagagaccaaaagcagaattgacacagatatttcacatttgagtatgatactggtagacactcatgaagctgcctcttttttttgttgttttatttttggctccttttgttgatacttttcaagcaacatatctaatctaaaaagaactgtgtgcaacaaggtgttggtgcgcctggtaaacctatacatagttcgcaccaattccctatgtgaaaataaaagtattttcctcaagaacagccttgagtgtattgcgatgttgcagactggcaagtctcggcagtttgttgccacagataaggcagatacactgataatcttcctccaccttcagcattaacttcttgagtaccacattttccttttcaaagtggaagaagacagctagtctaagctagaatgcccaggggtggaactccgggctcacagaatacatttaccttattgaaagacttgttttcacagtgaatctgagaacacccaagctggaaggagattcttgggctaaatccccacttttttatttttcagtctcacgcttacagaattattgagagtcatattgttagactgcattgatggcattgaaaactgttaatcacaatatccctgtatgtgtggttgataacagatttctgtatcctggctattatctttctctagttatgggttcataacatgttcgggagagaatctgggattttcttgtgcttcgtagattttcacacatctgatgctcattaaggtcacttctttgtgtaacatgtaaatagctgctgtgttttctccttagcatcagcttagccagtgtactcccagttccacagtaaacataaactgctgtctccatggtaaacaaacagaaggtgtagaagtggtgccttgagaacagggtgcccagaggaatcaagcattatatttaagctcagctctttttgtaggcagaagcttacagcgtcagtgaaaatgggtggctcccattgtataggcaggcaaatgccaggacaaaatcaggtaagttgattcaagccacattttaaaatcagaaatgagtgtcacagtacaaacctgagagcagaaagaacccaaaggcaaagcaaaattgaagaaagaagactgaaaagaggaataaaaggaggtgaaaaatcaatattctgtttttctccatctggcattttggaaggtccaactgcagtttgtggagttgaaccgaaataaagcaaagcctagttcatgtttactcgggccttatcctcaaatagttcagattttagaaggatcaagagcctagtgtttttatacaatggggtgtatttatagagtttggctaacagggaaactaaaatgcttatcattattagttcatttccttcagaatttctgtttttctttcctttgaaacgaggcctaagagaacattgccagttgaatagtcttggccgctggcatcataagcacattcaagttttccttcacagctgaggtgtctctaatgtgactagttaggtaaagccagcactgctgtatagtgtgcatatatcacagtgaaataaatgctgctgtgaacctcccacgtggcctggagaccacagcctaccttgctcttggcagcatccccagtggcttcttctctcacttgctgcggagtttgtccattgattacatgtcacctgcatatctgtgttgctcttctccagctcctgccccactttgcagactgaggcagataagtttagctaaactatgcaaaaatggtaagtggtgaatagagatgtgaacataaggtgcatgtgttcttgctaccccaaagcttaggagctgggaatgtgttgaaactagaaactgtgacatagacacactccaaagtaagatgggtgtgtgggtaagagtccaggtgaaagggacccggcaaatactggcattagaaagtaacttgatgatcttgctgtggtgggaaactgtcccaatcctggttcagttttttgtttaagcacaatgaaatctgttttataactcgtttcattaacattttatcttgaacgttttcccacactgttttgttttctccaacattgttattgtctctgacattatttgttgaatatattgataagcataactaatccattgttactttgaaagcagttagttcaaggaggatgtagtcaggaaaatggtggcatagccagatgttctggaactatgtgaatggtgactatcatttggggacatggatgaaaatagattaggtgcatgatgactctggggaagggaatcagttaaagtgaggctgggaactgaggaccagagactcagataaccttgtagagttccgtcttaaaagtagagacttcagaaataggccatgtgattgaaactgaggatggggaggcgtccacatggtgatggagcagataaatgttgttctgcatgtggttgcatgcaggatatcccacacttcccttagtttgcccaatcccaggtctggttaagagcaaaggagatctaaggggcagtcatggcgggcccattagaccccaggttgattccaagccccaaggagttgaaaaaaaaataactggaggtgcagggggagcagtaatggtcaaggctatttctagaaactctgactctgttgacattgacccaggaactcagatgggccagttgcctgagtacacatgagctgagggatggggtgtgggaaaggattctgatctagcagtagtgaatctgcttgcagcaagctggaagatactgccatggatagaaatcaggctgtggtcaacatgaaaacacaaggaaagagaaggccaaggaattacgttttatgatctgagactgacattttccagcctttctagaactcgaggttatatataaccctactgacttttgagaagctggaagattcttcttgcctctgatctcatgccaaccgaggatgtttttcattgcttagtctctacgaaatttggaataaataataagaaagaatttgggatggcaaaagagtattaggtttataataggataaatcagggaagatgatgagaaaccataggatttagaaaggctaaatagaaaaataggctcaggaagatgaagattaaaggagaacaaatatatgtcccattaattaagtgtcacagatacacagagaaggaagtctgaagagtaattatccccctgagattttgtgtaactgactccctttttgaaggaagatactactttatagaaaaatatttttgattccctgaaattcaatttttgattatcttcaaccatatgaaaacacatgtgatcccaaggaagagttaaaatattaatttactaaaatattcattcgatatctactattttaggtgaagaaacaggaaaaaaaaaatccctgcacttgtgaagctaacattttgatgggggagacataaaacacaaacgtcagataatcctgtagagaaaaagtagggattatttgtgtgtatgtgttgggggggtggtgacagttttaaatagggtgtttagggaatatctcactgagaagttccaagtgaaaaaacctcaaggtgctgctggagcaagttctttggaaatctggaggaagagcattcccagcagaaggagtagcataaacaggtttcgaggtaggtgagtttgttagatacatttaaggaaatggaagaccactgtggctggagtagaatgaaagatcgagagaataatagatatgaggacttcataggccattgtaaagactttggttttactctgagttgggaagtcatttgagggtgagcctttggagggtaaactggcagattttgagcagaggagcaacctgaactgccctgttttcataggatcccttgggctgtcctgagaatagattatggaggagcagagcaggggcagagagacctattagactttctcaggaatccaaatgagagatggtggtgggttggtcctgagtgttagttatggtgatagagagacatactcaaattctgaatacattctgagggtagaagcaatagaatttgttgacagatcaaatgtgagctgtgcgagaaagagcagtcaaggaatgactctaagtttttgacccagaagtctgtggaaggagcagtttggggagaggatatgcaggagaaaaatcaaaattctgttttggatatgtaaagtttgagacattcaggtggagaagtcagtatgcagtgggatatgtgaacctggagtaagagttaaagaggggggcccaacccccgatgtgagagttgtcagcacacaggtgatgtttaaagccatgggacgaaatgagagcagcaaggaaaggagtgagatagaatagagaggagatgctggactgagcccgggggcaccagtgtttacaggtcacggagatgaggaaaaatcagcaggacaagctgagccaggaggagccagtgaggtgggaggaaagtgaagagtcttggaagccaagtgaagaaagtataaagtaggaaggaatgaccacattctgatgatggagaattgaccattgtatttaacaatagggaaaagaccatgacaggaggggtttgggttgagtggtagaatccaaaccttattagaaaggattcaaaacagaatggaagaagaggaactggatacagagaatttaggtaacacttccgtgtgtgtgtctgtgtgtgtgtgtgtaattttttttttttttttttttttttgccaagcaagaacacagagaaaaggggtagtacccggaagggtgattaccgtgaagagagttttaagatggcaggaattactgtttgtcaggtagtgggagcagttcagtagggagagaaaatctgatgatgcaagagtgagagggaaggattactggaataatgtccctgagagggcaagaagggaatcccgtctataagtggagggattggccatagctgtagggactgttccttcttagaagtaagagggaagccagcatattgggacacagatgaaattagttcagtagatttgataggagattgcggaagctttttcttgattggttttcattcaccagtgaaatggaaagcaaggcattagctaagattgaagagggaaatgggatccgaagtgaggagaaaggggtgagacactcatctggaagagtgggaaagtgaatgcacaggggaaatggaatgtcattgctggcagcgatgagagcctactcaatggtagtggtcatggtcagggttgggtggttgtgtgtttttcccattcaaatccagcttgaggggagcaagtgtagaataggcagagtttgatttaaccaatttggagagtgagagagtaggctaactagagcaacctggaaaaagttttaggatttctgggctgtggccagggcctgtgtggggctgatgatcctgaatttatagtcctaccacactgccctgctgtgtggctttctccagcatcattcagacagcaagaaagcagatagcagccctcagccagagttggggctttgtagatggacattatggagagtacaatattggcaagatgtcactgaaacagtgtgctctggaatgtggccctaaagatggaaggaagggaagaaagaagagggttggcagattgattagaaaaagtcgaggggcccctggggtcttgtgaaatgagtaggtaatgtagttgtggtcagaaagagggattcttaaataagttctttttgaatatttcttaaataaatgcttcttgaatttttcaggatggcaagggctggggtgggactatggcattagtgcatgaaagggagaaggtgattggcagtaagaagtgaggctactgagaggccagaatgcattggtcatgtcatgtctctggatgcataggtcctggtctgatgaaggacacacattggagaggaacatgtgagcccagaatcagaatttcagtgaaccaggagcagcagctgggaatttggaaattatagactttaggaagctttggggttgtattctattcacatggacctgaaatgaattttcttccaagaacattgaggagtaatggtctggaagtggcacttgggaaaagaacattaatcttacttccttgccctgaggtgtgaaaggtatgagagaatcagagccagctacccacaggtctacaaatttttacttgcaggttttgtctcaaagtgggttcaaggatctattttcacctttttttttttcccctgagtagtccagactttgttttggttatttctgaagcaactgaattggtgttagggctattgaaaaatattttggtctattttatggtcaatccaagacctttcttggctaatcccagaaaccaactaaactctcaaggtctgcccacagacttccagatcttcaggatcagaaagtctgagaataaggcagtaccctcttggttaagcattttttcacttggacttacaaagaaatatgatgactttgccttgtgtctttggccttaagcttgccaaactaaaaaagaaactcaaccaaaaaagaaaaccaaacaaaggaacattaatttggcaaaaggactctgaaaagggggaaatgagatcagagagaaactggctagtaagaattgctaaattggcccatttgctgtggtaggaattcacatggcatctcaaggctgaaagctttttgtgcattcaagaaccgaaggtgatggaatgtgcatttttgtctgaatatggaggaatatttatttgctgtatgtggctgagtcaaaagctaaatttatggatttgttaggattggggagtatgagcaaaagtgcagcagtttaacatgtgaagatgtcatttagaaattttttggaatacagaatgttattttcccagagaaacagtcataaatggtgattaagttgctgggcccagccagacaagacctgctaaagccaatttaactcagaaggctaacaaatgatcattctgtactaatagtcctcttgaacactctaatcttattttttccattcttagcctaaaaatgtgagtgtaaaatgaaagtcctgagtaagtgagtcaaggcttgtgaaaaaatgcttagcatgatcagagagattgattgatttttgagttatgtgagatgatgaagaagcagtggtcagcccacagtttaaggaagtcagtttaactgtatgagatgaatgagaaaacagcttactagcttctatattacttttgtcttttctgttagtgaaagtgaactttagattgataatggttaaaggtctggtgaagtctacagaagctcatgctgcccaagaatattttagaaaggagtataattgttccaaatgagttaaccagggtattaaaagagcttgtagatttgctttgggaagtgcagccggtcatctcaaggtgatacagggactgggacagctgccagaatctagtggggcaaatgtgacagttctcaaaaaggggtgaagttagggtagaagttgggcataggctaaattcccataaatggagacactggagctgaagcactaatctccatattccagaatgagatgtttaagcagatggtttgtgaatattagaaaaaaggtcattaggagccaacatgatgagttcaataaaataagtcatcccaaactgaatacattacttttttttcaatggaggttgttagattgacagaataggagagggccacagacatttttggtgttttgattttagcaagatgtgtggggaaaaaatgtatttaaatacaaaatgaagaaatgtgtgcctggtgacagcatgcttatctgggcagttattcttaaaactgtggaataatggatgaaaatcaatctctagaggagacaaaaatcaatatgaattaaagtaaattcctgcccctaattcataaatatcagctgtttaagtaaatagcctaagagcagagagtaatgatggatcacatgaaatggctgggtatttggttaacgaagctccgtgtgaattgagcatgtgataacaatgtcaaaaggttaatgaaaatctaggtcgcatttgtacctgtgtccagaataaaggaaatactaggcttttcctgctcagtattggtaaagctgcctctcattctgagtgctgactttaaaaggggagcatattgagagggaatgatcagcatggtagaagatcccgatatttaggcaagaacatgacagcaagatttaaatatttgtcaagagtaattggtggatggcattgcaaaatgtagcattaagacccatgaatagaaggtatatatgagcaactagatttcatttcagtagaaagattttctcataattaaaatacctcacaccttggaggagatgaaatacagatgaaatggataacaatctagcatggagataatgaatgcttgaaccaggccatgtcagtgggacatgacaattggcaatttctaattgattaacttggtaactgatagaaagtggggaatgagggaaaagaggtttctgtgacatctcaccctattgagttttatgcagttcattgatgtatttgcattgctccattttatgtttttttcctcatttaacatattattagcagccaaatgatgtaattgattaaaaccctttctccatataacagtgttcattctacctggttttattccactatttccagaaatcctttgctgtaaaatgtctcatgaattcccaccccacaaagtatcacatttgaaattcagcaagctatttgttatctggggaatgtcaaaattaatttgacaaaaacatgggtgaggaaagcagggagccctggacattctgaacaaagatgtgatatcagtatttaccatggaactcatttgattataagtcatctagaagcataatcacaataatggccaggaaagccacagaagcaaaataattgagttaaagttgagagtttgctggcaaataacctcatcgtatcatgacctaaaaagcagcatggatgtaaaatgttgtaataaaaatttaaagagaaagacagaacttggtgggcatggacacacaatgtgaattcacaagattcccagaaaattgaaaaggagagaccagtgggatttcagcttctgccatccctcctgtattttgaactcttaattaatttggaaggctgaagggctttggaaagatgatttgaaatctttttatttctgaggtcccattagttaactgtagttttccttattttaacaaataataataaaaagtacatctttactataagtctcaaatgtattcctcaagtatgtctctagtaagaaactataaatatgcttttacccagaaaactcttaatggcttcttcaaaaggaacaagtgtttacagctccttctcccaagtcactctttgaaatgtagaataatgtgacctgacagattataataactaccaaacagcatctccattaattgtaatgggcaaaccaataatatggatctttatgatgttaacatgtattataatatatcaagtcaagaccatacttgtagctggaataaaatttgattgcaaatttgtgtgttttgtaaaatgcaggatgtgtggaaaaattgtagattttttcctgacttccttaaaataaaaacaaataatgaaaattttgacaggtcattcagtgatgctaatggtatcactaccatgtcatgtactttcatctaccttaagtgtttttaaaaagcaaatataccatctgtgagatatgaaggaagaagattaaaaagaggtgaattagatgaggtacttctgagactttggaagtgtttttacttatttttaattttccttttttgtaggtgaaagctattctgaaggttgccctaggaagttgaacataagatggactccagggaattagaaaccctgtttttccatgcaaccctgctctcagacctctgtggacaagtcgcttttccttttagaacctcagtttcctcatatataaaaagcagaaagatcagcagtagatatcctcactggagtgttgttcagtgactgcacggtgactgagaaacattttagctatcttaaaatgatgttcataataatatagtgaatagtcttatctaacatttatggatgcttgtggttggctaagcacattacagggaaagggctacctaggattgaaatggccacagccctacattactcagccctgccataccccgtatcattccctttcaaatgaaatcagagtgtgttggtatcaggaattagttctgttcttcttagaagagcaggcaagagctttgatgacttgtgtgcctgagaaagtacagttacagacacttaagtacctaccaaattatcaagaggttgagaattaatcatacccagcaatattataaaataccaacagcacaacctatcaataaataaatatgttgagcacttacacgtgctaatgtaattttcaatgaactagaaataggctatttaagttatgtactattttgagtaagcgactattagcttcactaaattttggagtaaaattttcattaaatatttattaatcagtatgcttagagaaatacaaagcagtctatctcaactttacccacagggccaagagcgggcatactgttcacctcaggctcctgcatcatcttattgtctgacagtgttagtcgtgcagttgacgctggttggttggttgattgaatgaaagactataaggcagtgtgtactgtttaatgagttctgttaggcacttaggaagtgctagaggagttcagttagggttgtagttcttgccctggctgtgcatcagaattacctagagtgtgcttttgaaatatgaaggcccaagctccactttcatgtgcttatcttggtcttagtagaacctaagtgtgtttatataacatttaaaagatgaccataatgtacacccaggtttaagaatcattgccttagaaaaatcaggtttgggctggaggcctataatcctagcattttgggaggccaagacaagagaattgcttgagctcaggagttcaaaaccagcctgggcaacataatgagaccttatctctacaaaaaaaaaaattatatatatattatataacacacacacacacacatatatacatatatacacatatgtgtatatatctaccaaatatatatatacacatatatgtgtacatatacatatatgtgtatatctatataaaatcaggtttgtatttttgaaggaaatggtatatagctcaaccttgaagactacattttgggaggtactgaaatctgtgccagaatctatatattgatataatcaggattttaccaggtcttttgactgacctctggagaatgcccacacagaaatggagagtaatctcctttacttgaaagtcacctgattgtggatgttaaccacatctacaaaatacctttacagcaacaccttgattagtatttgactgcataataaatgagtaccatagcctagccaagctgatatctaactatcacagtggatgtattacaggagggtgcccaaatagcattacatgaacatatcagtgaaggtggaaatgagtgggtgtgcccagtttgcattgagcctagagttgatcttgggaagtgggaggagaggatgttggaaagataatgtggaatgtagaaatgttggactaaagagtttgggcttttgagcagaagagagaaagcaatgctgtagcagtgctgtccaacagaactttttctcatggtggaaatgttctgcctctgtgctaacacgatagccactgaccacacatgggtatggagacaacttgtgatgcagctattgaggccaaagaactgaatttttaattaattcttattcatgtaatttcaatagccatgtgtggctcatggctactgtgtgggaaagcaccactgtagagggagtattctggtgggaggatgcatgacgaactgggggagaagcaacgtgcagacagtccagttaggagatgaccataatagtcccagtggggactgggcagaagcagggaatatggaaaggagagttgggggtgagggagaagcgaatcaaagatagtcttacattgaccatttctctttctggccactcccgtttcacttcctgccctatgtcacccaagcacttcctatccgttagattcctcagagctgagccccactcatcttttctcacttactcactctcctcctcacactcacttcctcagcttccatgatgagctctgtgttgacaactcccaagtttatccttttcttaaatcttttctctcagccctgcatgctgatactgccacatagaaacctcagggacttagtcttttcctcctaatcttttttctcttccagttctctgaatgttgataaatgtaatcatcatcctctcagccgctcaagccagaaacctcaggatctttgacaccctgttgataactgaggctctctcacccccgtccagttaatcaccagggtctgctgattctaggtataaattatagcttcaatctgtcccttacttctcatctccattgctaacctcctcaggtaggctccacctttcttccctggactcatagtcttcccattaccacttttgccacacactgagctgttctctaaataattcctttaaaaataaaaatcagatttatttatttcttctgtgaggtgtaatggaattttcccggtaatttatctgccacattacagaatgtcacaggataaagggttaattaatttcagttaatttatttaataatatttgtccatttaatgtttccatagccctgttgagcaggtactgttgggaaatatcactaaaaagatggcacagtctatatccctttgaggcatatattccaatgagaaagacagacattaatcaaataattacacaaataactcaacaattaaagttgtgagaagtgacatttaaggagaagtataaggtgtgctgtgagcatataaggagtaaacctcagctagctgcgggaccagggaatatctccatgaagaggaaacggagcaaaggagattctaggaagggggaactgcatgtgcaaagataggagggaaatacttttcttcaatggaatacaatttaaaatgttaatagaatatagaaactgacaactgcatttagatggaatggagtcttgaattttctggaaacgacttagtctattgccacctaattatgaaacttgaataaaatggttatattaaatacttggacatgttacctcaagtcaattcaataatctgttggctcactttcttaggtgttatagattaaaagtaagtattttttccttcagtattatattccaattaagatgatactatatgtacataaaaatatatgacatatatatgtattatactattataacatatgatgtaaaattaagagccaaaatggtataaaaaagcagttctaaatttttaatattcttacacttcacactctaaatagaaaagtatcgacctcagagtttttttttaatgtggatatatctgttgatatctactatattagaacttaaaacacttaaaactgagaaatttaaaaaatatgtattaattcatgtaaatataacatacacattaatataaatatgtagaatgtcttctaaaacagtaagaagggtatcattttttatacattttgcagatctctttaagaaaagacagctggattctttttatatgtatatatatatatatatatttattatactttaagttccagggtacatgtgcacaacctgcaggtttgttacatatgtatacatgtgccatgttggtgtgctgcatccagtaactcgtaatttatattaggtgtatctcctaatgctatccctcccccctccccccaccccacaacaggcccccgtgtgtgatgttccccttcctgtgtccaggtgttctcattgttcaattcccacctatgagtgagaacatgaagtgtttggttttttgtccttgcgatagtttgctgagaatgatggtttccagcttcaaccatgtccctgcaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttgtagcagcatgatttatattcctttgggtatatacccagtaatgggatggctgggtcaaatggtatttctagttctagatccctgaggaatcgccacactgacttccacaatggttgaactagtttacagtcccaccaactgtgtaaaagtgttgctatttctccacatccactccagcacctgttgcttcctgactttttaatgatcgccattctaactggtgtgagatgatacctcactgtggttttgatttgcatttctctgatggccagtgatgatgagcattttttcctgtgtctgttggctgcataaatgtcttcttttgagaagtgtcagttcatatcctttgcccactttttgatggggttgtttgtttgttttcttgtaaatttgtttgagttctttgtagattttggatattagccctttgtcagatgagtagattgcaaaaattttctcccattctgtaggttgcttgttcactctgatggtaatttcttttgctgtgcagaagctctttagttgaattagatcccatttgtcaattttggcttttgctgccattgcttttggtgttttagacatgaagtccctgcccatgcctatgtcctgaatggtattgcctaggttttcttctagggtttttatggttttaggtctaacatttaagtctttaatccatcttgaattaatttttgtataaggcgtaaggaagggatccagtttcagctctctacatatggctagccaattttcccagcaccatttattaaatagggaatcctttccccattgcttgtttttctcaggtttgtcaaagatcaaatagttgtagatgtgtggtattatttctaagggctctgttctgttccattggtcgatatctctgttttggtaccagtaccatgccgttttgattactgtagccttgtagtatagtttgaagtcaggtaatgtgatgcctccagctttgttcttttggcttaggattgacttggcaatgcgggcttttttttggttccatatgaactttaaagtagttttttccaattctgtgaagaaagtcattggtagcttgatggggatggcattgaatctataaattaccttgggcagtatggccattttcatgatattgattcttcctacccatgagcatggaatgttcttccatttgtttgtgtcctcttttatttcattgagcagtggtttgtagttctccttgaggaggtccttcacatcccttttaagttggattcctaggtattctctttgaagcaattgtgaatgggagttcactcatgatttggctctctgtctgttattggtgtataagaatgcttgtgatttttgtacattgattttgtatcctgagactttgctgaagttgcttatcagcttaaggagattttgaactgagccgatggggttttctagatatacaatcatgtcatctgcaaacagggacaatttgacttcctgttttcctaattgaatgtcctttatttctttctcctgcctgattgccctggccagaacttccaacactatgtcgaataggagtggtgagagagggcatccctgtcttgtgccaggtttcaaagggaatgcttccagtttttgcccattcagtatgatattggctgtgggtttgtcataaatagctcttatcattttgagatacattccatcaatacctagttgattcagagtttttagcatgaagagctgttgaattttgtcgaaggccttttctgcatctattgagataatcatgtggtttttgtctttggttctgtttatatgctggattacgtttattgatttgtatatgttgaaccagccttgcatcccagggatgaagcctacttgatcacagtggataagctttttgatgtgctgctggatttggtttgccagtattttattgaggattttcacatcgatgttcatcagggatattggtctaaaattctttttttgttgttgtgtctctgccaggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattaattattgccttaatttcagatcctgttattgatctattgagcgattcaacttcttcctggtttagtcttgggagggtgaatgtgtccaggaatttatccatttcttctagattttctagtttattggcgtagaagtgtttgtagtattctctgatggtagtttgtatttctgtgggattggtggtgatatcccctttatcattttttatcgtgtctatttgattcttctctcttttattccttattagtcttgctagcggtctatcagttttgttgatcatttcaaaaaaccagctcctggattcattgatttttttgaagggttatttgtgtttctatctccttcagttcttctctgatcttagttatttcttgccttctgctagcttttgaatgtgtttgctcttgcttctctagttcttttaattgtgatgttagggtatcaattttagatctttcctgctttctcttgtgggcatttagtgctaataatttccctctatgcactgctttaaatgtgtcccagagattctggtatgttgtgtcttttttctcgttggtttcaaagaacatctttatttctgccttcatttcgttatgtacccagtagtcattcaggagcaggttgttcagtttccatgtagttgagcggttttgagtgagtttcttaatcctgagttctaatttgattgcactgtggtctgagagacagtttgttataatttctgttcttttacatttgctgaggagtgctttacttccaactacgtggtcagttttggaataggtgcggtgtggtgctgagaagaatgtatattctgttgatttggggtggagagttctgtagctatctattaggtccacttggtgcagagctgaattcagttcctggatatccttgttaatttctgtctcgttgatctgtctaatgttgacagtggggtgttaaagtctcccattattattgtgtgggtgtctaagtctctttgtaggtctctaaggacttgctttatgaatctgggtgctcctgtattgggtggatatatatttaggatagttagctcttctcgttgaattaatccctttaccattatgtaatggccttctttgtctcttttgatctttgttggtttaaagtctgttttatcagagactaggattgcaacccctgccgttttttgttttccatttgcttggtagatcttcctccatccctttattttgagcctatgtgtgtctctgcacgtgagatgggtttcctgaatacagcacactgatgggtcttaactctttatccaatttgccagtctggaaagacagctggattcttatatctgcttctgcacttaaaagttgcaatatattgttttggttgaagtaaatgaagatgattcagtcttacatagacaggtagtcagtaaaaggaagcgtattttaaagccttttcagataattgtggatgttcttcttggattgcacaatgaaactcaacaagtggtagtttataaaggttagttgcaatgtggaatgttgaaactgtattaataaattttcgctacttgccttgcgttttgaaaggacctttacccaagcatgatttttgccaccatgcttaggtcagttggaaggtatcgattcactaagttaagtagattttacaaatgtttattcatttcattatatgatatgaaaaaaaatcacatgtgttaacattaccttcagtctcaacggaaaagtcattgacaattaagaagctgtcaaattcacagtggtgaatttaattgtcctaaattctaatatttggttgaaaacttgtattttgtcactaacaggaaatgttgtcagttgttttccttgaaatgacagtcgcgtgttgttcattttcgagaaagtatctgctaaatactcgtctgtgtaaccaagttttgtgtcagtcatctgtcaagtaaaaatggtattctgtgggaaaaaaaaggcagttttaatgcacaactcaaaaatcctgcaatccctttcccttgagacaatcatcatacttctgtgtgcaacagaaatgctgaatgggtacttccatttctccccacagaatattaaaaagatgtgtactcaatgctcaagatttagtaaagttagtacttattactgcgccatcaagaacattcttaagggaagtgacaacttgtttttttcactgtgagcatgtggtggtgaagaatgcctggtagtccagtctggtgccaatgtgggattgtgctaaggtgctggcagttttacccaccatgacttttgcaccatcattgcagatggtaatgcagttagaaaggcaaataacatctagtattattatgaaaatggttttgatcttgcaggttccccagaggtctgtggagcacacatccattggcacagagggtgatacgagaagagagaaagaaacatgaacccaagttggtaggaaggcttggaagttcttccaaggaagaactgagctggaccttaaaggagagttaagatttggaggtggtaagggtaggtggttaggagagcaggagaggatttcaggacagagaaaccatgggagcaaaggagtagagagaggaaggaccatgacatagtcaaaagactaatgagaaagatagttgggttggaaggttgggaatggggagtaatggtttataaaatgtggcatataatcagattataaggcatttgaaaagtttggacttcctctagaggttgctgagagtaactaatggtttttgaccccttctgtgacttgctgagcatattggtttaggaacatctttctggtggcagtgtaaaaggtaagttggtgaacaggagaactggatgcaaggagaccaatgggttgttaattgtaacctcattagtagcggtcaagagcacagactagaacgatggcaatagatggaacagattgaaagctaaagtaactgcctcagaggtagaggcaatatgagaactaaagatgaaaaagtcaaaggtcacctatattttatattgcataaccccaactgcttgccaaggacattgtctattagggaaatgtaaaaaaaattgggtgcttttatatatggtcccacatatgactttatcctcccaaaaaatcagaatgcttccttttttccaatagcaggactatatcattgaacgtattttccttttgccctgctgccaagaggctttgtgccagttttcatgttaagatcacgacaactacaattgtctcaatggttagtacattttcttcctcctaccttctctggctctggttctgtttataattctttaatggtattgtatttattcttcttgacaccagatgtcttacgtcttcttttgaaagaggctaggagaaggggagaatacaatttaatcgctcttaacatattctattcttttgtggaataaggccctcctctttatcacactttactcagaatctgaagaaagactaaaagcctctgatgtccaaaaccaaagcactactccttaatttgagagaatttcaacaaattcagttaatctggttgcccaattcaaagcatgttagaagcagcaggtaatagggtaacacaacacctattaaagacagctaaaagaagtaatccctgataatctgagtaacagcagagagaagaagcaagatgcaggtggaagtttctgatgattatgagctatgtgaatgtacccaacacaggtagtaatgaataaagaacggttacctattaaggtagagaataccattgtgaaagctcacatttattgagcttttactatattccaggttttgtgccattgccttgcatgcatcatctcacttaatcttcacaattaccctgcctttctatgattttccctttttacaaatgagtcagtttagttttaaagagatacaatatacacacaaaggcacatggctagttgtacatggcatagttaaggtttgaagctagtagctctgccagataccaaagtctgtgttctttattctcattttggactcttttcatttacctgctaaataataatagcttatgttcaatatatcctcttttaagagagttttgtaaggtttttttttatttactatctatagtcagctgaaaacattttttcatcactgtttttttttgttgttgttgttgtatttttttttttttttttttgagacagaattttgctcttggtgcccaggctggagtgcaatggcacgatcttggctcactgcaacctccgcctcccaggttcaagcaattctcctgcctcagcctcccgagtagctgggattacagacatgcaccaccacgcctggctaattttgtatttttagtagagacggagtttctccatgttgaggctggtctcgaactcctgacctcaggtgatccgccacctcgacctcccaaagtgctgggattacaggcgtgagtcaccacgcttggcctgcaccactgttttaaatgagacattcattttttaaaattgtgttttggaaacatctgtgcatccctatttccacaccacaaagaacagccattcttgtaaactgctttttgagttaaaggaagaaaagtaatatctatataaaacatgaatcaactggtaggaattgtcacaatcctttgctttgctgggcactaggtactctgatttgtttttcttcctctagctttgaatgaagttgcaaacgttgatttccagagcagtcgtctgagattatggcccaggggtacatgtgacataagcggttgactagggaattacagattatgacagcactcttgagtagctgaaaagctaaaaatagcccagggcagttctaagactggaaatggaaacctactgtaaaagatgagttcaccaaagaaattgtaccaggaaaaacccttagatgactttcaaacatgtgtcactatgggagtgacagattgtaacattaagggaagctgcagaagaattatctgagaacctagtaaagaacccaagacttcctactttggttatgcccccacttacaccttacttatcttcttcatctcagcttaagtctaaatagctatagcttaaaatttgagggactgctaacctgacacaggtgtctactaacttgacacagtcacatgtgacacaggtgacttagaaaaggtgggcaattcacagctatcgatttggtgactgatttggtatttgtgagtcgtgaccagttttgtggtctaagaaccaaacataggtaagctaaagatagttgaagtatataaataagaagaatcagaggatgagcagaggggaacatacagttacgaagtcaagctacatttgttgttccataaaactaaggatcttaaagtttgtggatagaatattgtgaaagttcactaaatcataaagaatctggttgtagcaatattattttggttccaactgattccagaatataagattggagctatttctttaaaagtttagaaatgtaatttaggacaactctcttgtctaagtggaaaacctacagatcattattcctcaggagacggtacaaactggaaatgctcacagggtcaaaaaagcttgaagtaagcatggctggatattaagtccatagtggatattaaagcaagatgccttgaggatatttgaaccttaagagtttagcctctaggaggataatcattcactctcacaaatgtccttttttaccacctgtcttgttttattatatctatcttttgtaatgctttattgggaatatcttaaagtttgatctctcctacatttcttttaccaacattaccacttccagatgagaacagtgcaaatggatgatgatgtcttctagaaaaggagagtataaaaacaaccactataggcattttcacatttttttcttttcatttattgactatttattgttctgcttttctgcagatcacctctaaggaaggctaaattgagatttttaaaatgatcaaaagtctgtgggaaaacaggaaagccaaatatatatatatttagtcatgctaatgaaaattacaattataactctgtgggtttacgaaaaagattcagtaagagtcctctaccccataagaaggctcctaactcagcatcttccacccttgttaattaatgacatttaaggaagttttattttaaatgtcatttcaaagttctgttttcatatttcctctaccctttttcagaaatttaaagaatactgaaaatcctatgagaactccatttgataaaagtactgcttccttggcatgaactagagggaaatatttaatactcattatgctcaaggcattgcgccttcatccttaccagggtctaaaatgtggtattctaatgatagaactctagagtttaacacaggcaaatggaaacagaggtaaaatcaggaagccattgatatgtgaacattcccttgcatacaaggcatttcatggcacaatctaatggtatttataagtgaactacatctatccttgatgagaaatgactgaaaataacaagttcaggactagttatagccatttacttatataaaacacaagactgttttttaagaatttctacatattttaacttgcaacagaaattatttgtgtaccaataataagtagtatgttttgaatctaaagaaatatgtgagtcaaaatacacaattgataacctggtagttatgcaggcggcatgtaaattataatggaaagtcggtcaacaggctggtgcccttctaaaattagcatgccacattccagttgagtgtccacattacagaaaacatgctcaccttgctaaacccagggctgcttgacggtgccctgaaatatttctcccttttccttttgggactaatttagtaaaaatgaactctttcaaggtcactgtatacatcatttcctattttgtttttcatgaccacaaccccagattgtgctgggacaccatccactcccagcagctgctgccccttctgaagctgtcttattcagccacctgttcaaatggataccagggttcacagtggctgtaaatcacaccatttctgggtttggattgcttggtgcaagcaccatccagggatgcataggaacctctcataaccagtctctccataactcaggttgagtgcttacctttgaagagatatttggtgccctcccccacttagcagtcttctcttagcagacagaagtcccatactgaaccacatggaatcatataggcctagtctgtattgccctttaccccacttactcagttacctgtgtggttttcaggatttcatcagtaagaagacccaagacaatctactgaaaagtgtttaaataataagattgttcaaataagtgaaagatagtaataagcactccacaaaaaaaaagagtatttcatttgggcagtatccatagcaaagttagagctctctagttaaaaggtgtacatgaaaaaaacaaaatacatattttgactatcatattgggaaaagtagaaaacactgaagtcaaatgagggtggagcaaagcactcataccctctggtggatacgttgattttataaatattttggatgacagtttagcaaccagtgtatcaaaagcttttaaaaaggctgtgccacttaaaatctgcttctggaatttagtaattgaacatgtgcacagatacatatgtacaaagatgctcattgcagcagtgtttataaaggcagaaaattggagactacttctgtgctcatcagtggaggaactgttttactaaattatattgcagctattacacatgttgtaaagctttctataaagctagcaagtgtctataatagatgtttataaaacagtatgtataatatggtatcattttggttagtgtgtttgtgtgctcttgcatgcatgtatgtccatctaagcctgaaaggatgtactccaaaattttaagaaacttagctcatgtctaggagatgggattacatatgacttttattttttctgtatacatttttggatcttcagaatttttttgtgttgagtatatattttatcagaaaaaaaaattttattctaagaaaaaaataaacctgagcccttgagttctcagcagagaactcacggtgaacaagccagacctggccactaatcttcagaagctgatagtgtggtttaacagggcaggaagcagacagtgtgacttgtacaaaaatcattctgggccattcctgagtacaccttgatcatcatagagtcacaaccaagggatgttcttggaacatcctgacacatttgactctaaaacagacttggagtccaagcttcaggatgcattttcatccttgaatgggctccttttccactgtgcttctttgctgtctgcacattcctgaatgcctggtcaggtcaaaaacaagctcatttactccctacagcacacaccatttactgagctgacttcctgtgtggctcccctgtgtgtccagagttactatgttacttcctttcctccccaccccagcttccacaatacttgtctttccaccttcggaagtcagccttccatacctgcagttcttggcacttttttggctcaattattactgtttttcttgaactttgtagtttgcattttgataaaaatgaaaaaaatttgatctagtgtcttctatctctgcaatatttttgcaccgttttgttggaaaaaacgttctacttattactcatgccttgactctgatgcctgagctctgcaacagttaggaaaaacacttaggaatatgtgtcattcataactgcatagcatgtaaataaaattttattatgtttcatattttgagaaatctaaatatttacgtaaaggcttttgcttctaatcttttgtttccctagaacttgctatgtacctggattcacaatttactgaaaaatagaagattccatatttttactttagtagttgtctattattacagtttttttccctttgtgttcttcttggaattaactactttttcttgtcttaaaaattgtagagagccccatgttttttccatatttgcacatcagttacaattcaaattatgtgaatgttttgatacttacttttcgtagtgtaattcttcaactttattgttagacagtaaacctttcttgcatcctgctaggcgtaaaggttgagagaccattaacccaaatgagcctggaatactctccaatctcagtaaatgacaaccgtgtcaggggaggaataggctatttgggaattcccatacagtaagtcaatctcacttgctgtccaaggcaactttcaaacacccttacacatgaacaagaatttgagcaaagatcctaatctgactgcttttattcagatcttggacaaataatttaacttcagcattttaactatctgtttttatttaggccagttctgttatttgttacatattctttccaggctagtgatattagtttctccctttttccccattatgtggtagaatgtcttctgccaagagataggaaacctggatttcacagcagtagagactggcactcttttctctagtattgcattctaatagtaccatattggagtttgacctacttattacacacaggcaaatgttgccaagtcagtgaggttttcctccaaataaagggccatggtcttgcatcacacatgggaggtttgcatgcagaccagattatctgggagctaactgccaacctgtgccactgtgcaagggaagagtgcctggagccatgtacagatgtggttctcattccaggcctaattcttcagaacttaacttccgtgagctcctgctggactccaccaaaggcaacagaatgtgggctacagagaacaagttgctttttgtacatttttcagatgtttgcaatgatgaccaggttttcctgactatattccactggaccccacttcccctttgttcttctgagaaattatatatatatatttttctccatgcacaattttcctctagcaatagccctggttgtcacccatagtatagtcctcattgaaagtaagagaaattgaatggacctaaaggactctgtggctgaaatgaaaaagacatggctcagcattttcatatagttttaaatactcttaaagtttattgatttgaaataactgaaattgcaaatataagaattggatagtgatatcagcctaagacatggatgtgtctttgttttcctagccctttattgccctggataggaaaggtctcatggcagtcacgctgtttgtgcttagaattcctggttaaatgcactggatgaaggtgcattgagatgggttacatcagcagcattcattctgctggtgaaaaaacctgccaattaggaacttcagatactggtaataaaccttcatgtgttccacagtggaaaaggggaaaggaatgataaatatcacgtttcatataagtatcaaaaaatatgttttcaaaagtgagaagaaaaggagaaagtggtgtgtggtaaaattgtgtagcttctgtgctaattgataatgaagaggagaattaatcacatttaatgaacacaatgtacaagttatacaaatgattgcaaaatgaaatcttatcagtttttaatgaatcatagaaaacttttcagtatcacgtagttaaaaagcagtcgattcttaacaaaattaacatgagcattctgacaagctgtgtgagaacacaaattcaaatcattcctcagagtaaattagaacaattctatccaactccatatgttcacaggtatttttgtatttggtctctgttctgccatcatttccttttaaaccataaggattttaagctctaaactaaaggcttctatattttgttgttgctggttcttttggttttttaaaatttgtttgctaggaatgagggacatcatttgtagattaggggacgaacaccaatgactagtgcagcttttgtttatatgggagtatcttttggcatttgtttgaagttgtcccatgataccttctataaagcggtgaagtaagtccaaaaagaagtcatgaaaaatggtaaaaggttagaaaataagacataagaaggatgagattttcatcaacagtgctttgtcttagatttttcttcttgttaaataaacttcactcccttggataggcagttttttttactatgttcgttttcaatcttgatatgcctttgctgcttgaggtgaaaataattctgggatgattgtgttacatatgtaatattgacatgttctcatgagtttatagaataatgctgtactgttcaattcaaatacttcctttcaccaagaatagaccatgtttgccatgtcagtcatagtggccatgactgtttggtaagctaactagtagtggatgtatttctctttcacaataaacctattaaagcttgaaaattaacacttataagtcagcattttttcaaaaaattatatattacaatttgtttttctgttttacacaggaagaatttaatggaaaacctgactccctcttttttaatgatggccagcgaagaattgactttgttctagtatatgaggatgaaagcagaaaagagaccaataaaaagggtacaaatgaaaaacaaagggtaagtttttatgctattttcctttctttttatttcttatattgtaacatgaaaaaactgctattttgtataagtaataaagtgaaactgatgttgaaatatcatacacaaaacagtttcatattttctctgctcatgttttctcaaagcatattaacaaaacgttttttaaatatgaatcagaaacttcctcaggctcttaacctcatttggtttcacagctgaaagcagactttctttcaaggaattggactttctattgtacagaagagatttaccttaagcatgcctggctattcaattaggtggcataggaagctaatgattaataatgacaagtgtaataacaactagctttcaatgtgtgctcactcaggtattgtacatacatttgcatacgtgttctcctttcatacagcatgaagtgggttctataatcacaccattttatggatgatagagatgacccttaggttagatgaatatacaaggtcatggaatctagtctagcaagtggtgaagccatggttcaaactgtcttgaatatggagactgctcttgacctcgcatttttctctgttacctccctttcattcattgcattgccagtcaagctgctctcttctccctttcctttgcaccaagcttttttaagtaaaaggccatctttatctcaggatattaaaacagtagggcaggtttataaacaactccctggaacgtttttacctgtacctaaactgcattaaactaaaacagaccaaaaaagattgcatatgtgtgttactttcacccactttagaaatcattcctcatcctttttttcttccccttttcacatatatgtgtgctctctccctctctctctgttctctctctctctctctcacacacacacacacacacacaaaactttaattgtccctgtctagactgtctccttgaaatatgccaactttaaatctattgatttttgcccattctttcaaatcaagcgataaaaccttttaaaaaatgaagtaatcagtactgttttattcatctgtttgtttcagagggggttaagtttggcattttatatttgcgtggtggaatagaatgagcccagactttggaaactgaccttcaagttctaattctgccactctgttggagtaattctagttgtaacaaacaagctcccagatgacagggacttaacacaaaaacagagtgtttattgttcacgtcaaggtcaaatgtagcatccctgtttggcacatagtttggggttgggcctctgtcctttgcagttatcaagaaacccaagcctgacagaagctctgccatattcgccaggtagactcccgggtcatcccgaatatcaacatagataaatggtagataagatgaagaaagtactcatgcttctttaccactttggcctcaaagtaactacatcagttgtgctcatatgctactggtcagaactcagaagagtggaaagtatcgtttctggctgggtagctatgtgacttaggcaaattttcaaatcaattttttttttcttttttatgtttgacatctctaaaatcagttggatcttacaaatgctgtatcataatttcattgttgaattttttcttattaatacataaaatattggctcaccatacaatcaatggcatcttagattcagggaaattggatcctaatacttagcctatataattatggttaagattaaataaaataacatatagatgttacataattttttagcattattagatcataaattttaattcttgtatcttcccatttgggattttcttaaaataatgccctgatatgaaaaggcatgactttcctgttattatacaattttatcactaaagtaaaacagcttagggtactttaattttcctgtggacactaagatattttatgcagtcatagtcaccatcatcaaatattcattaagtatccatatgccaatggatctggattgagcaatatataaagtaagttaaacagatctaatacattaaagtataaaagaaacagttctggttttaaacaagagctttactgccatgatgaagggccctagagctgcttacattaatcagttctgcatttgcttcagacagaaacataggtcccaaggtaactctcataaataaggaggaaaaaaatcatcattaattttggcaatccttgaactcatggattgatataccttgatgttcatttttataagctgtgctttgaagtgttttcagactgtatttgcacatattacttaatttatatatacttcaccgaaattcaaagcttaactttggaatcatgtttttcttcattggaaaaacatttgtgagttccattgtactccttgtcaggccttattgaggatttaggacaataccaaggaaaggcaattcaaaatcctgttttctttgaaagaaaaaaaacttatgtgtaaaccatattgatttcctaaagcaaccccaagcttgacttcaccagagtttatctaaaggatattgttaaacactttatagggctggagaaagatagaagtgacagggctacaaacaccaaaaacatagagtatttaaaaggatgtatcatcctttgagcaaaaagaaaataattttctagccaaacctccaaatatcatgtaacttgggccactcatatgaccaaaaacacttaagaaacataccttcctttaaaaagcataaaccatttacatttagattttacatgaggatgattgtaagttgcttcagcaacaaacgctcgtttagtctgtactgggcttggcacagaatgtttgaatgttttaaatcacaaataacaggaaaaccaaactcaaaatggcttaaatgctaaaaggaaataattattttctcatttaagtagtctagagatacagccatttctggattagtttattggctcaatgaagtcattccatcctcctgctctgccatcctcaatattttggctcttaaattgtcttcccttgattttaagatggctgctgcaactccaggtagccagaggcagagagaaggaatgccccttctcagggctgttttttaagagggaagaaagctcctctggaagggccctttgcagatttcctttcacaattcattgtctgttacaagtctcttcctaaatcaactactggaaatatgaatggaattattgcataggattggtctttcatctcttgagtcacctgatcacagaatacctaaagaacaagcaggcttttcttagtaataaagaggggagaatggctgttccgtaggcagccagcagtatctggcacagtagatgattaaatatatctaaatatgtttgatccatattgtaaagagcaaagatgttttacataaaacaaattcccatatatttctccaactcctcttgctcagttttgttagtaattgctgctttcttccagaactgctaacaatcggcagaactgatcttttgaattttgttttgtctgatgcttgccttcaaaccgatgtgttagtgaccaagtaatggtacaattcagatgagggtgaagatggggaagaggtctaggtagtacaaaaacagtgggaacaaccctgaatatgatttatttatttactttaaaaaaattatccattcctaaaagttaatggaaaatttatgtccttgaagttgaaaagtttatatatggaagtatatatttgtatttcatatctgaccttaagaattctttagtgtatggcaaaaggatctggccagtggagactgtaggatagagaatttttttaaaattagtgatcaaagttaaatttatctaattataatttaattcaaactttcaaataccgtgagacaactaactggttatagagcctgtgagcttctaaaaactgttatccattgttttggattaatcatcatgagaccagaacagttttcctagagtctggatgagatctcttgggaaatgtttaaaaacttaccaaaaagttttactatgatgaacatgatatatcactccttttattgagatctactatcctttaagtaaagctttataatacaggttaagcatcccaaatccaaaatgcaccaaaacgcaaaattttttgagtgctgacttgacgttcaaaagaaatgcttagtggatcattttggattttcagatgtgggatgctcagctggtaagtataatgtaaatattccaatttcttaaaaagtccaaaattagaaatacttctagttccaagcattttggataagagatattcaacctgtagtgtccatgcagatcttgtacatttttattaactttttccaattactgaaaatttttgttgctattgtcagaggcattttaaatgcagttatgatttactgtgtgtaaaagaagtctattgatttctgtgagtgctaagaaccttgataagctctttttagttttagtagtttctaatactattaattttcccaaatgaagaccatattgtctacaaatgatgacaattttgttctttctttgccatatttatactttctttttcttgtctgagtgcaatggctatgacctcttgaacaaaaccaatacacatagtagtcactattgtattgttcctgattttaatgggaatgtttctaaaatttcactattaaatattacacttgccatacatttttgatagatttcttttaaaaagttaaaggagttcccttttagtcctagattgctaagcatttttataataactgggttttaaagcttatcaaatgctttttcttatatctattgaggtgatcatatggcttggttcctcattaagtcttatgcatattaagtatttggttatttttgcctaataagatagtattataactgatagtatagtataactcaaagcattcatttattagctttaatatacaatgtgtactttttatagttattagcaccctacttatttatgttaatactacattaaattatttatgtatggtcataagttgcttaatgatgtttcagtcaacaatgtaccacatataccatgatgcctcttaagattgtaacacagctgaaaaattcctgttgcctagtgacatcatagctgtcttaacatggtagtgcaatgcattactcacatgtctgtggtcatgctggtataaacaaacctattaggctgggctgctagtcatataaaaatatagcacatacaatcatgtatagtaccgaacgcttgttaatggtaataaatgactatgttactggtttatgtgtttactatactataatatattttaaaagtatactttttatcattattttagagtatattcctacttataaaaaataaataaaaaaaggaagttaactgtaaaacagcctcaggcaggtacttcaggaggtattccaaaagaaggcactgttatcacaggagatgacagctctatttctgttcctgcccctgaagaccttccagtgagacaagatgtggaggtggaagacagtgatactgatgatcctgaccctgtgtaggcctagctaatgtgtgtatttgtgtcttagttttcaacaaaaaagtttaaaaagttaaaaattaaagatagaaaaatatttgcaatagaataaggatataaagaaagaagttttgtacagctgtagagtgtgtttgtgttttaagctaagtgagcagtgttataaagtctgcagtagtgcacataatgtcttaagccttcaggttcagtcaccactcacttgctgactcacccacagcaacttccatgcctgcaagctccattcatgataactgccctaaactggtataccatctgtaaaatgtttatacagtatttttactgtagcttttctatattaagatacacaaatacttaccatggtgttacagctgcctgtggtgttcagctcagtctcatgcagtgcaggattgtagcctgagagcggcaggccattccatataccctaggtgtatggtaggctacaccttctaggtttgtgtatgttcatatgtacactctatggtgttcacacaaagatgaaatcacattctcagaacgtatccctgttgttaagcaatgcatgaatgaatttataatttattaaatagtattcgatgcttacatattgagtgtaaaaaaagttgaattcatagaagtagataatagaatagtgattagcaggggctggaggtgagaggatgttggggagatgttggtcaaaggatacaaaattttagttagataagagggataagattaggagaactattgtacagctgactctatttgataatatattcttgaaaactgctaaggagtagattttaagtgtttttaccacaaaagtttgtgacgtgtaaatgcatatgttaatcagcttgattttggcttccattatatatgcatattttaaaacatgttatacataacatttttatttatcaattaaaataaatataaatgttaggagggaagtggaaaaaaagtatttaaggtcacctatggaaatatatcaagaatgaaagtaattaaagactaaatcagggtaaaagaaatataaaagccagaaaaataaaatgaagccatgtgtcagagtaataaaatgatttattatcaaccataagttcttgttcagaagttagagatcagctgcaaatttgcctctcaacttcttagttgccaaagaatataagaggattttattaataacataatttaaagtttcatcacaataaaaacaaaactggttgttccaaagcaacacagtgttctggtaggaaagatcctcctgagaaaaatttgtctcatgaatcctcataaagaggaaggcatgattgcatagactaaaaattggcttaccttcttcaaattgaagaaataaagggacagcagaaggtgaggggcactatgaggaatcagaacagcgtggaaagtttgcctgggaatgacatttgcaacaggtagttcatgaattggaaacttgagcctcatgttaagataggctcagtaagagatatggcagccagtgttgggtggttttacttcccagctaacttttggcaggtgttctgtcttttgttttagggagtgaagtcagatctatctttagctcctaaatattttagactaaagcagggaggtctttatatttttatcttttcccttgctttacagtctacttgtttatgctaagattgtaggtaaaaaggaataaattaaattagaatcagcagtttcaaattacagctatgaaatgcgttgctggtataagcacatttggttttatttttgagtattaccaccaagagcaatgaatccaattcttgcttcttatttccaaaatgggaagtatctctgggctgaagccttaaaaacagagaggacaatgaaattctgaaaagcaagacctgattattctattttatcctactgggggaattaacaacgagttcacaaagacatggagaagagaaaaccctttttctgattgctcctcctgaggtctggctgtaggttgaatgaagaggctgtcatttacctggtaccagcagggcaaatgtgtcacctttttaaaagatcatctgtaaaggggtacagcaggattggcaaaaatcagctataccaaattctctcataaaacaggcttgacagggataaatcatcacaaaagaatagctgcttgtgtgcacttgtacatgcatatatgcacagaaaaaggtgtgtcctagaaaataggatttactaaacttgtcctatgagaagtcacctgggttgcttgttaaaaatagattgtccaggccccatcccatacatgctgagtcagtacttccaggggagaggttcaagaatctacattttaaataagctctccaaagttgttcctttaagcagataagtttggaaaacactttactgaaaaactttattgtacacttaattaatagaatagttatcttggcagtgaattatgggtgtttattttttcttctttgaaaatttgttttctgtgttactcagaatgagcatttatttcttttgtgatttgatttaaaagtcgtatttggaagtgaacttcagctaaatattcactccatcctatgtttatcatttaaaatgctcgtctgttttttgtcccctagtgaacatacattactcagttgagtaaattcctcatcagatcagtccactaacattaaatgtttttatcaccaacacgtgaatttaaattaagttctgattaaataatgtattctgcttaccaaaccttcgggagaactaataaatagcacagtaattagactaattttttttccacaaattaagtacctatgatgtatttctcttgcgtttttgtaggttaaaaaaagattggcaagttgaaaatacaatgacagcaccatcaatactttgcctaacaaagctataagaatatttgaaatcaatctattcatatatttcattaatcccaactggtttctactttatcatcatagtatattcattaattttactacttagacattgcagtccctgctttttacactgaaaaaggtgggtaatagaaagaaaatggtagatatttgtgtttacaatcagtactattactgtgtaattcgcaagtaagtccttcacaacaatgactttactaagccaaatgagatgtgtaatgtgtaatgtgtaatctagggtgcgtagggatagaaagcttccttaattatgccagtctgtcctttgtgattttgattgctttattctttatttccctgacagctttattaacctctcaaaagaggtatgaataagatactggtttctggagtgtggcaggtgcttttgtcctttttcaccttgaacctccagtaccattctccaccatcagtaatagaatcacatgcatcattttgtgatgtacctaggtcctcagtgattacagtcactttggctttactagaattctagtaggttaaaaaataaaatgtggttgcactgcaaatgaatttgctcccatagagatgtacacatttacaacacaggttaatttatgactagccttttttgtttttttagtcagtgagcctcgtttaaacattttatgctgccaaataaagatcatagactatcagtttaggttcttatgtataaggtttccagtaaggcacatagataatttttactttaaaattgtgtggcctcaggtattcatttattcagcaaatatttattgagcaatggctatgtcagccaatatgcaatattaattatctttcatttttaacatggaagacagctctaccctaattttttaaatgtcaagaacactgttacttatccaagtgtaaattctacagtgaagtaaagatgatttcatgttaaagagacttaagcaatcttttcttaagtaagcagtcctttcctgatatgtgcctatttgacaaatatagcacatatgctaatttactttagctacctgacaaaccaagaaaactggtttgatcaattttttaagtattccactagttatttgtgaattgccatgccaaaagaaaataacaagaactgtcttattaaagtaacaccaaggtgatatattaatgtgtttaagcaaataaaaatgtcctatccttgatacaactgttttaagtatttatagttggtggtaaaatggagggcattataaaccaactccaaggtctaccaattatcctgagagaaatcaggtaaatatctcaggagttctttgtaaagaactaaaatagaataaattagtacaacctttctggagggcagtacagcaatacatattaaagaacttaaaattgaatacactctttaacaattttacttttaggaccttatcctgaggaaacaataatggatgcacaagatttttcataatagcaaaaaggtagaaaccacctaaatatccaaccatttgaaattggttaaataaataatggtacatctctctgagagaatattatcaagctcttaaaatgagattgaagggaagtatttctagtgttttctgcgtctatgatattcatatgtgctatacattctcatcagtgacctaccttataatagacatgaggcaaaagagaagagacaaaaagatatgttcacatccttcagagaaggaaaagatagatatccatcagatatcaaagaaggtagcctgaagatcaggatagccaagtggtgtagaagagtcaagggggagtctaggtgactctcatagtgttcctgtaaaatgacgtactggtgtcccactgcagggacgaagggtcattgggtgcatggtgtagaggcagagtgagtggggttgcctgttttgtcagatatttggtatttaaaacagagatgagcctctaagccctgcagaacagagagaatttctttttttttaaggaataagggaagtcgagcatgttaaaaggcagagagaaggtaatggtgatggctgacatatctacagcgcttatcatatgccaagcatcatgccgagtgctttatgcccatgatcatgcttaatccttaaaacaatcccaaaatgaagctgttttttccctctatcttttagatgaaactgctgatgattatagagttgattatttgcccaaacatcacagagctagtaaatggcagagtcaggatttccattttgactctgaatctagccactatgcccaggagtaacaggaaaaccaaaactgcaagagctacaggggctgtttgttggaacaaaatccgagaagagagagtcccttgaaggtgatgagttgtagcctcagtttagaaactccatcaagaaggtacatgtctgacttgcactattcagcatgttgcattcatagctgatacagctgatacaaccaagacagaaatattttgtgtttggtatgtttgacagaactgccctcgtgtggggctggctcattctgggctgtctaagcctcattccttttgtcatctggtaattcaaattctgaagcgtccaggaatcacttcatgctgtggatgcccctatgctctctatctggtgttggtgtacttcagaattaaactgcatctctctttctacaccatgtcctgtaatagccataagtaaaagtacatggaaaatttggggggctcagaaaatttggggggctgcagttgctgcactgcagccatttacactccttagttcattccggcttaacaggcagtcatcgatccactattcactcagtttattcattcatcagacatttattgtgtgcttactctgttataggcttgttttaagtgttaatgatatcaagattaaaagacaccactgaagtaagggcagtaattgaacagtaggcagggccatgggaggatttaatattcttaacattgggaaacatttaaggtgttttttggcagaggagtaagagcaatgaagagaaaaatgggaggtattgcccaagtaagctcaagaagagagatgaaaggatagacttctgacaccaagaagagaggtggtgcccaactactgataggtagaaagaaagagactggcaggaatttccagtgagtggctgcccttttctctgtaaggaaggaggtgaggtcacttgcgagcatgctgggctggaagttaggtaatgagcgtaaggagcaccttaaaagtttggaacagctccctagtggatagctaggggccaggaaggagacagcccaactgtgatgggaaccatgaatttgtaataaggccactgaacagagttacatgatttttttccctaccagcacttattgttaaaacactcatcaagccactggagaagaccctcttctgactgattctcctactcttctaatgaagacatttgtctccaagagctaaaattcttgggcctgagctttcacatgctaactgaaattcatgactgaattttagaggataccaaagacacaggcatggatcctgctatgacctgctagtgagaccatctgggttgccctttgtacagcctcagggtgagtcatctcccctgaaggaaagaatgtcacagtgtctggtcctttcagaatactccatccctctactgtaccatgttttaggttttggtctaacacgttttccctagtttgcaaccactctgttagtcaggattcttacttaccagtatcataaatgagctgtaatttaagcagatcaggagtttatcagaaaaatgttagagaactcacaaattctcctgatgggttagataaataaggttagagataggcagccagaagcagtaccttaaatcctgccacaggagaaaaagcacagttgctgtcctgagcacagggctgctgccagcaccgctggcaccactgactagcagtagctatggacagctcctgccgtaacctctaccatctctggaactggcatttgctctctcagccaccccagaatgtattctgcttggcctggcttctttgcatcactagcattcaatttggagcctggagccaggtagtctggttggcggggcctagctcgagtgccagtagctgaatttcatgggagaccacgaaaaggagtgtctgtgtttttatctgctataatggatgtgggctcttgtaggagtttaaaatgggtgtccataaagaatgacagatgtccattacagtgccagaaagcacatgaataaacgtttcagtcattctgtatcaggagaaagtcttaggtcactggatgctaagtttctctatatttcctctgtagcagactattttaaattctttcagtctccagtactttgcaggatgcctgcaaaataaaaggcactcaagaaatgtttgtaaatgaactaatgcttgttgagtatattctttcaacaaatatgtgttaggcattgtattagttctcacattgctataaagaactacccgagactgggtaatttataaagacgaggtttaaatggctcacagttctgcaggctgtacaggaggcctcaggaaacttccaatcatggcagaggaagaaggcacatcttacatatctggagtcggaggacaagagcaaaggggagatgctacaaacttttaaacaaccagatctcgtgagaactcactatcacaagaacagcaaggggggaaatccgcccccatgattaaatcacccccatcaggcccctcccctaacattggagattacagttcgacatgacatttgggcaaagacacaaatcgaaaccatgtcgggcatatactggtgaatgctgtctgtgggatcaaaatgctttacccaataataaagaggtaatcagtcagaaataaggactgggctcctatgtaagaatcaaaatgagaggattaggatttagagggaaggagtactgcttagataagaagtagaatgaatctgagtcaactttcaagttcaagttgggaatatggtgggtcaggggtggaaagtgctgaagaacttctcaggatgaattgcggagctggtggggaaggggacacccagagggaacagtcacttttggggagcggagtaggaaagctatacctcaaactctccttacccctatctgagtggggcatttctaggccatttgcttgtgtttagggaagttataccacttgctggtttcctctgctactctattgtatgttcaaattgcagccaatagttaaatgtactatatctgaacagctcttagaacagtgtctggcatgttttaagtactgtacaaccatttattaaagatataaaaacaaagcaatatcctttttctgatacttcaacacaatacatcagggattccacttggactcaaatgtagccaaataccaggtatattcttttactttttgacctttggtctttttcctgcagcttcacctacttctagtttatgggattttttttatgttctaggccctgtgcatagcacagcaactcatccccactctgtccctttagagtgggcagatcatgagtattgttccctgggtaaagtgtctgactgccagacccactagatgatctcgacctggacctagcagttcctctctgtcttgttaactgctgtgctaaatattccacccagcgttttcagctgtcttcagtgtaaggcttgccccaagttaccttttgtcactattggaaatgaaaattctacttcatgtgctttatgtagtttaaatcatatcttcacaagaccctaaaaaggaaacaagtgggttttcttagttctacagatgaagaaaaatgaggcatggagagtttaattttcttgtcatgggtcatagagttgatgaataataaatcagattttgaacccaggaagtgtggttacagagctcattctggtccattttgtgctgctgtaacagaattccacagactaatttataaagaacagaaattgattggctcacagttctgtaggctgggaagtctgagatcaagggggctggcatctggtgaggactttgttgcagtgtcacccccacggtggtgggggagagagaggtggtagggagaaacaaaaatggggcgggggggttagaaacaaaagggggccaaacttttataaggagctcattccatgctaataaactccctcctgtgataatgtcattaatttgttaagtctgcccttgtggcctgattacccttcagtaggccccacctctcaacactgttgcattggggattaagtttctaacatgatttttgggggacatatttaaaccatagcagagcttgtgttcttaacctctgtgtctactcattttcttcatttcacaaagcagtataaactgttttgtcatgaaaagcattctttttaaaaggtcaaacaagtctccatctttgcatgcttcccttacaactttgggcacagcttggcaaaagcctaggcatctagaatttaatatccataagtgtagtatattctgtatcttttgaaatggccatgtaatatagatatcaatttagttcactatttttatggatttagacatagcttcacaaacatctcagtcttgcagagagaaaaaaattatctgaattttgccaaaattgcctgtgttgttttattgaatttggtcaagatatgcagggatgacgcatacacatccagtaattgaaccatttgaatgtctggtatggaaaccaaatttttaaaatctggaatcttcaactctgaaaactcgtatcagtgaataggactcagaaagctcaatttgtatgcttttatgagccaaaaagtacgtgggattgtgtcaaagcaggatactgttatttacctcagatgactgaaaccacaccaggacagccaagggccttccagggtgccagggcatcgaagtaccctccacggcattctcttggggatccaacacttacatgtcaccagcagcaagagctgcttcatttcttctattccatttgcttgaccaaatgctgatgcatttctttttcaggtccacgctagtttgattttgttattaatattgttttaaaaaatgcctttttctgcctttggtaaactaaaggtctaacatatattccaacttcttttgacagaggaaaagacaagcatacgaatctaaccttatctgtcatggcctgcagttagaagcaacaagatcagtaagtactggtcccttttcagccctcggctgaccactgttctcgggcagcttcgtgccacttggaatacttgggtgacattggaaacatgcagccctggccacatcttagtcatagactgggagaggagtcaatcaaaatctgcattgtgtaggatgtattctttttttctgatcaaaactagcagatcttttttaatagccaacgaattttacaatgaatgcatgtatgaatgattattttctttctttaagaaacttctaaaagcttttttgttatacaaaaaatagtttatggtaaaaaattagaaaacataagaataaggaaaataatctgtatcttaattatccataaataattttgcagtccttctgagctgttttactcaaaaatatatatgtacacattttttatctttcaaaaaggagaaaattaccacttcacagttttataatttgctttttccctttaatatatagcaaatggatttatgtcaataaatataattctttgacatttttaacagccacataatatgatattgaacagatagacaataagttcattcgaggtttagaaaattaaaaatttttcattatgctagcactacaatgaatattctagtgtttttactttaagtcaataattagggtagagtgatagacaaataagtttggttttcttcattttataaattattttcatagttttatgaactatgatgatttgaattacttccttaatgattcaaaccaagaaatcgtctttaagacaaaaatttatgatggtttgcaaatctgtttttattgttatcttcacttttagtggtggtctctgtattgtttttttaaagctaccaacaacataagaaaaatctatgtgttttaaaattgtgaaaagagttggtttcttgttctgcgtttttatttttccaatataggtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcattgtaagtctaaaccaaatttagttgctgtcttggggtaatttggaacctgctgttttgtggtttggttggtttggttttatttttaaaaactgcacaaaaagaaaagaaatatgccagcagatttgtgttacagtagtaaacaatgattggattggttaattacactatataaaccgcatactctattttggaatctttttaggtttacttcatcctctctcgggtcaagtatcaagtgataaacaatgttagcaagtttgggatcaacagacttgtaaactctgggatctacaaggcagctttcccactccatgatgtaagttaaaaggcaaaaatgaactaaaaggccttctgtatactctggtgttgacaatagcaaagggctaactttcctgactgtaagtttcttcctcagtaaaatgaagggaacatactgcaagattacaagctcatttagggtaagaactaggtcttttgttcacagatggatcccagttataaagatactcagttttaaaggagcgaatgaatgaatggacaggacctctctcacagttaatgtgtaaagcagtatagattagcagttaatctgtgttagcatttctgagaccaaaatgcctgccctgccactttctagctggatgaccttgtgaaagtcatttagcctttcttcctccatttcctcatcaataagctggggataaattattacctacctcctagagttgttaagaggattaaattaatccattaaattaatccaaatgttagtccctagcatataataaatactattataagtgttagctgttttcataattactaacagatgttattatcaaccagaaaagattagttctttgtcagcaaaatacatgttagaccttctcatttatcattttctgcaacatagacttttcttcctcatttggaatacgattttcaaactgtcccctggaatatccctgggcttttaaaaaggcatctgtcagggttgttgtgacaatggcagtaccccagatggttgacatttttttaaggactacattctgagaccacagcaacccctcaaattcaagagtacttctctagccgagaacatctctcgtgaaatgaaatttttaaaatgtgaccactgtaaatgcagggacattataactaaagctgtttaaactctgtcattgaaataaattaaatactatattatattgcattattactttgttatattcactatcaatttatctgactgtgtaagaccaaagaaagtaaagactgagattggtaattgctactgtgtagtacatgtatttgtggatagagacgatattgaaatgtactgaataacataataaaactaggacactaaacagcagcttgatacacatggaaaagtagagaacagggagctgggtgaggtaaatactgatcctaagagacccaatgtagccatccagcctgagagtccatgtgttttacttttgtgccccactgaatttagctaattgcgaataacaggacatgaattttgaggccacttgcaaatagctgtcacgaatattaatttgggatgccagggttctctaacagttgacatttgcttttggccatgtcttttccactaaagcctcttctaattgcagtggtcctgtattcaggctaacaaatggtcccatgtggtatttgagagggaggtgtgtgaaggtcagggcctgtgccctgatttggctgggtggtaatctggttctagtgccagaagaagaaaaatgagtcagaaaaaaaggcaactggatttaagcaggaagttttgtttcttgaataagctaagtgtgtaacatgatacccagctttattgtttgttttctgtatgttatcacagaataactgctgaactgggggcaaagaagcctaggttttagaattgaccctgctgctaaccagccaaggccttggtttccccattgtccaaggagaggggtgggttatcacgtgttcctctggtgtggtgatttgggcacttgggtggcccaatttttcattgtgtaggactgccccacttaaagcattttaagcatctctggggccctcacagagtccctgcagtgctccccaggattgtaacacccaatcgttcatccctgcccacattcataaatgacccccaaggagggtagtaccatgcctggttaagaatcactaaaaattagatggtatttccaccctttccagaaggtgaggaccccttgttcacaattgactatcaagtatttgtatcacatttaagaagcagatttgtgaaaacacgatgattatggtgcttacatgttcccttctgcgtcacagtgcaaattccgccgtcagtcagaggatcccagctgccctaatgaacggtaccttctgtacagagaatgggctcatcctcgaagcatatacaaaaagcagcccttggatcttatcaggtgaggggttgtagggagtactccagggggaggcactcagggtgttacccccacagcatctgaatgtgacagtactcatcaagactcttgccagtgaagggagctgacccagagtgctgagcttcgttggccagggtttttattgaggcttaattatgtgggcatgattaattgaatcattacccatctccagtatcatcctccccctggaagatggccagtaatatgtggctcaaagctccagttctccaatcacatggttgatcttctggcatggccagcctccaccctgagtcatctcattagcacaaactctctagaggtccaccatgagccacttcactggcataaactatcaggcgtagtcctagggtcccactgtgaataaaaaggcactcctatctctcaggaagttccaagggtttagaggttacccaccgcccaggaactgggatgcagacccaccaaattccatattgcacagaagtaaatgttagatgtagtttctattgtatggtaagacatgtacattttcactcttttcttatgtctgcctctaggttctatttcgttgtatctcacaagatacaatgactagctcaagagtttttcttcccaaggtaccctgttggttttcctccagaagcttacgttgtttgggcagggctgaggattctggcttgtgggagatagaccaagaacacccaaacaagccaataaaacatgaaaataaataaacagaatttctaatggaagtgaagaaaataacagagcaataggatgggagggcagagtgggaagtgagttgagggagttatctttgaggaggtgacttttaagctgagatcggatagtgaagaggagccagtgctttgaggacttggcagaagtccttctaggaataggggcagcttgtacagtggccctgagatgcacacacatttggcaagtttgaggaaacatcagagaccagtgctagtgagaaacagagcaagacatgaagttagaggggtggcaggagcgccgaaaagagtttagactttaattgcagtgagaagcagttgtaatattttaaatgtttaagtcattgtatcctattcacgttttgcaaagataatgtggagaatggattataaggggtacagggagcagggagaccactaggtaggaggctgtttgagccaggcagaagactgtgggagcagatttgggatgtgtttggggagtcgggtcgacaggacttgtttatggattggatgtggagagtgacgaggagaggagagttaacttcatgtctgtctggagccacgtacctgtttttttatggtgtctcaacaccccatgcacttgccacctacttgagaaaactactagaccttaaaagtgagagttttaaacaaatgaatgtttgttttgttttacatttaccgtgggaaattttaaatatatacagaaatagagtatcatagcaagcctgcattcatctgtcacccagctccaaaaattataaactcatagctaatcttgtttcacttttactcccacttctttccctccccactccactggatcattttgaagcaaattccaaatgtcacgtcgtttcattagcttctatttctaaataaggtgtctcttaaacataaccagaatacccccttttgaaaaggaaggctgggtgaggtgactcattcctctaatcccagcactttaggaagccaaggcaggatgatcgcttgaggccaggagttcaaggccagactgagcagcatagtgagatccagtcttaaaaaaaaaaaaaaaaaaaaagccaggcacgatggctctcacacctgtagtcccagctactcaggagactgagaagggagaattgctcgagtccaggagtttgaggctgcagtgagctatgattgtgccactgcactctagggcaacagagtaagaccctgtctccaaaaaaaaaaaaaaaattatttaatatcatcagataatcaggattcagatttcccttattgtccccaaaaaaacttaatggttttttagttcaaagcaggatccaaacatggtcaagaggttgcagttaatacaatctctcaaatttcttctggtctcagtttcactgtttatttcttgttttccttgctcttgttgaaagaatgcctttcattccctattttgctgatttcattctctcctgtggtgttgttgaacatgttcctctgtatttgctataactaagtaatttgtgtagttgcattagctaagtagtaattggatcctcatctagaagcttaatctgattgaggttagattttatacaagaatacgtgatacgtggagttgagtacttatatcagaaggtatataatgttcagttgtctcttttgttatgatagcagctatcaacgatcattacttagattcattatttcataagagatttcattattttatatggtcatactcggattcccttgtcattcatttttatcaccgagattacagtcatgaagaggcactttcattaactctgtttaccctgtaaaataagattttaaaagatatttgtacatatgtaaatatttgaggttgacattcatgtgaagtttccattttattaatttccttttatgttaaaccaatagcatctgataacagagtgatgggttcttaatcattttttatgtgctcttttattttttttgctttagtaaagaaaacttcccaactattttaaatatattttgctagaggaaatgcatttactatcccctgtccctggtccacatgttctttcccttcattgcttcccactagtaaccccttgagcattcaggctattaaacctcatctatggttcccagggattactgaagggaaaatgggctctttccattttgttcccaaaaagcaaaccaaactggaaacagcaacctaggggaaccagactttgcacaggtaaaaaagaaaagtttccctccaaactcccgtttttacctccagagtaataaaagaaaatagggtattcacaagacaagggcagggtcctataaaaaaggattgttgtgagaataaaatctagctcttggaaactgaaaatgtgattagacagaaaaacaccaatagaacgcattagaaaaatgaagttgaagaaattatgcagagcatagagcaaaacttataaagggatagaaaagggggaaaagataaaaaattagatcagtccaggccggtacaatgtataaataataggattgtgagaaaccaggggagaaaaaatgtagggaagaaatctgagaagtacttccagagaagtatctgaagaactgaacatcatgagtctctaggtggaaagagcctgctgagtacccagcctagaggatgaaaatagagccactgagtcactccaacacagcagctcagaacgctggggacaaagcaaagatcctgctatcctttggaaagcaaaatgaaaagaaaatcatacaaaggatcaagactcaatagcattgtgcttctcaatgacactacacactgaaagacagcagtaacttcacatgtctaaggaaagtttgaccatatatatgtaactctatgtatgctcaaactgttaagtatgaggaattttcacagtttagatgtgcaaggtaatggaggaggtgctccaccaagaaggaagacctaagagttagtaaacaggaaatgcaggaaatgccagcacaagagagagggacagagagatcccaggtgacacagttctgtgatggggcttggagagtcatcagtcaaggttggaggaggtctgagggcatttattcaaggagttgaaactgaaagacaatctcatgtgtttgagcctactgagaaagttacacattaggggagagtctggggttgaattgctgataagtacacagaaaactaagcaatgaaccatcaagacaattattaactctagggagaacaagatattgagcagggaggaaaaagtaattatagcagtgacttgattcagctgtgaatagtgtttatagaatcataataatgtaaagcaagaatattaatctaaccaaaaactataatgtaactatgtcaggatggcaggaatagagatgtggatgtttagatgaggcaaggagttgaaagagagcttaatccacatcttccagaatagaaagtcaataggtgatgcataaaactgaaaaatcaataaacagcacttctcgcatgttatttagagatagggaagtaaatattctaagcatcaactataaaagtttaaagtgactgcttctgggcagcaggaaataggggagggggtaggggactgctcctttttataaccagccttctagagctattagactaatgactgtatacttgtaactttgatttaaaaaatcaaagctgaattttgttaaattgattttaagagttgggaggtgtttggcagagagggacaatgatcagaaaatattgcatttgaaggaatcctcattatttccagcttttcagcaagaactaagagacagatttccttttgagatttgaaaaatctttctggccttgcctacaatgtaacagggatgccttagaaagtattgaactccttgtcacagtaaataaccaagcagagactgcctgaccagctctttaaatacagcaggattttttttattattgggagcttggaccaggcaacttctaagattctttccaatttaaatatggcatttccaggatggatggctgatgaaaacttattacagaaagcataaccaaaaagaggccaaggcgtctcaaacccatggccagacttctctcccgggctgtatcctgaacctgccgtttgcctgccttccatgagccagagagcaaagctccggtcacgtgaaaatcagcccactgtgttcctcccatctcccgattccaccctcaggtctgtctcagctcttccttttttccctgtggatgtgaactacacccaggcctgtgacccatggaactggtctcagaccttccctgtgagtgcttgtccagcccagggatgttcctgtctgaagtctcccaggactccaggttttgctcagagctaagtccccacgaggctaagaccaaggagttcagcccagctccatactgagcctgaagtctcacgtaggcctcagagttaagtaaatctccttatcgtacagatcaagatgaaggcagaaatgagtcattcttggggaatatcagcaacagcagcagtcacctgaaccatctcttcattcctaaactctctttctgcctaactgtacttgaccttcctttcaggaacaattttggcactgcttcttggtcagcctgccctctttaatcttgcctacgtggcctcttcagttttaccccagagtataccattaaccagtttttaaaacttaggaaaaaatagaagagctagctataaggaatacagggtgatggattcctcaatcatatgcatccttccctctttcattctcacatgagttttgcaaaaattttggtcagagagacattccactacaaattagtggttttttttcttattattacagttgccccttgaacaacacaggggtagggcagtgacacccgcacacacatacagtcgaaaacctgcatatatattttgactccctttaaacttttaatggtctgctgttgactggaagtcttaccaataacatgaacaatcaattaacaaatattttgaatgttatatgtattacatactatattcttacaataaagttaagctaaagaaaagaatgttattaagaaatcataagaaagtatatttaccattcaccaaatggaaatggatcatcataaaggtcttcatccttgtcttcacattgagtaggctgaggaggaggaaaaagagtagggttattcttgctgtctcaggggtgatgggggaaagaggtggaggaagtggaaggggaggcaggagaggcaggcacactaggtttatcttttattgaaaaaaaatccacatttaagtggatccgtacagttcaaccctgtgttgtttaaggctcaactgtatttgtgacttacgttacattttctccaaggaacttccctagttaagtaaaagcaaataactgagcagattgttcatgttcatttgtctcatgcatataaagaacagtcttttggagaatgtgtaaaatagtgctggtctttacaaagaatgatagtaatactctgtatttattccataatcagcatttttctctcccttgctgtattttaatgtactttcaccaggcaaaccagcaatagtgatcagttcttccataatgtgtaatatactttttgtttcatcgtagaattcagggtctgctgtgaaaatgaatgttttaagggtgaattgagtcagatttaagcttaaagcctctcctttatttaaaatcagaaattaatattaggatgaagctacggagtaattatttgcatcttctaaaaataatttctgtctttcttcaggaaatactatggagagaagattggaatctactttgcttggctgggctattacactcagatgcttctcctggccgcagttgtaggagtggcttgctttctctatggatatcttaatcaagataactgtacatggaggtaacctctgtttattccttgttgccatgctgaaaagtttattagacataaaattattttcatggtcttaaactgttttggtaagacaagactgactgcagaacattcattgcttgggatgatatatcccttttgttctgagcacaataactgagtgaaatggaaaaatttttttcttagataatccaacccagtgtctgacatgaatattacccctaggaaacactccaatattttaagacaatattttgtttgaaaaagaaaggaggactggaggcgggaggattgcccttgaacttttggcccctagaggaatgtacactcagccctgcagatgtgagccaaaagcagctctgatttcttcagggttccactgggaaaattagtgaggggttttgttttttgttttattttgttttacttttagaaatgatttcttactactaaaaagtgcttgtttaaaaactcaatagttgttttggtttttacattaaaaaatagttcatacaatgtttaaaaaaatgtagtgaaaaattagtttgtactgaggttgaaattcaaacaccagctgcactctctaaagggacatatgtgggtgccagagcactctaaatttcaccatcactattctgaatggtattattagacctctgcttttggtggtctcaacttccagcagggatgcagcacggaaccaggattttctcttgatatctggctgctatccaggtgtgccagccagataaaaatttctgggcaccagcaatgagctgataaccaaatttttcaagcctgaagcatgtcagcctgctcctgagttaggttgcttacatggcagccctgatggatagacataattacgcttcgatttaacagaggattctgagcat

SEQ ID NO: 1055 - DNA, 497 bp, Homo sapiens
tgttggaaaaccttggacagacaattgtccccgatttgggatcactggaaagtcagcatgattttcgaaccccggagtttgaagaatttaatggaaaacctgactccctcttttttaatgatggccagcgaagaattgactttgttctagtatatgaggatgaaagcagaaaagagaccaataaaaagggtacaaatgaaaaacaaagggtattggatgacaagcttgtatttgtaaaagtacacgcaccatgggaggtgttatgtacgtatgctgagataatgcacatcaaattgcctctgaaacccaatgatctgaaaaaccggtcctcagcctttggtacactcaactggtttaccaaagtcctcagtgtagacgaaagcatcatcaagccagagcaagagtttttcactgccccatttgagaagaaccggatgaatgatttttacatagttgatagagatgctttcttcaatccagccaccagaagccgcatt

SEQ ID NO: 1056 - protein, 165 aa, Homo sapiens
LENLGQTIVPDLGSLESQHDFRTPEFEEFNGKPDSLFFNDGQRRIDFVLVYEDESRKETNKKGTNEKQRVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRI

SEQ ID NO: 1057 - DNA, 71953 bp, Mus musculus
  misc_feature (1)...(71953): n = A,T,C or G
ccagacaatcgaatggcctagcacttgtgcatcccggcctttgtcataaccccatctccactgcactcactgttgcctggagccctccagtgtcttccagcagcagcagcagcagcagcagcagcagcagcaacaccccattttttttcttcccctgaccaagccagctcattcagtcagcagggtctcaagtgagggagtgaggattgaaaagaaaaaaaaacagttagagaaaatgataccctgactccagcctgtgctgaggctggaacagcttcatgtcgctccagcctgcttgtatagcatcctaggtgcatccaaaaaacatggtcagctcttagatcaaagacaaagtaatcaagtgaagtagcaaacaaggaggtcacacaaggtaataattaagaagccaggcagtggtggggcacgcctttagtcccagcacttgggaggcagaggcaggcagatttctaagttcaaggccagcctggtctacagagtgggttccaggacagccacagagacagggctacacagagaaaccctgtctcaaataaaaaataaaaaaagatagtcactaagtaaagtagtaagcaaagagatcacacaaggcagtaattcatcaaagcagtacacaaagccccgtggtctctgtttctaatattcttacctcagcctacttccttgtccaagcccagtgacagatgccaaattcctagaagcagtacccaaagctctcaacatcctccccacccacagtgttgaggatgaaatctaggacctcacagagttatagccctactgtggtgtgtgcgtgcaatttttgcaaaaaggctctacattctttcttttgtttgtttgggtttcaaggcagtggttctctgtgtagtccttgctaaaccaggctggcctcgaacttagttcctcctgtctttgcctcccaaatgctaagattaaagacatgcaccaccactacctggctaaagtcacattttattcaattcctcttgtatgaaatattcaggctgggcatgttagcatatacctgggccagggcggcaaaagcaccaggaccctgatggccctggcggccagtgaaaaggcagcacaggtaggacttctaaaggtgtctttgcagatgactatgttccacagagaggaagtcagctagggactcaaggaagaacctggacgaagggatggagacaaaggctatagagaaatactgttccccgtccccggcctattttctgactcatgctcagctagctttgttacagatcttgggcctacctgcctaggatatggtgctaccagtagtggagcagccttttcacaactgtccgtcaggacagactctcacagtaagaccacagaaagcaatgtgatcaaggcttcacctgaagttccttcttcccgggtgtgtctaggttctgtcaaccctagccatctttattttattttattatttcattttgagacagggtcttattgtttagctctggatgtcctggaacttgctatgtagaccaggctagccttgagctcagagcatcacctatctctgcttccaaagtgctgggattaaaagtatgcgctatcacactcagcccaaccttaaagaaaagtgtgtgtgtgtgtgtgtctgtgtgtgcctgtgtggtgcctgtgtgtacctgtgtgtgtgtgtgtctgtgtgcctgtgtgtacctgtgtgtgtgtgcctgtgtgtacctgtgtgtgtctgtctgtgtacctgtgtgtacctgtgtgtgtgtctgtgtgcctgtgtatatctgtgtgtacctgtgtgtgtgtgcctgtgtgcctgtgtgtacctgtctgtgtctgtctgtgtgcctgtgtgtacctgtgtgtgtgtctgtgtgcctgtgtatatctgtgtgtacctgtgtgtgtgtgcctgtgtgcctctgtgtacctgtctgtgtgtgcctgtgtgtatctgtgtgtgtctgtgtgctctaatgtgtgtgtgaaggtcagaagacaatgttcaagaatttgtttttccttccactttgcgagtttaggggtaacctcaagtcatctggcttggtatgaactttgattcacttggccccctgaccattccatcatatgtgtgtgtatatgtgtgtgtatatgtgtgtgtgtgtatgtgtatgtgtttagtcttcatgccagaaggggccattggatcccctggaactgnnnnnnnnnnnnnnnnnnnntggggctatgcctcccttgcaggaaagccttgaataaaatgagtaaagtaagtgcgcactggggtggcttgttgcattgggtaggatcaacacttttatgataggattttcatttagaggatgctagtctaagcttttcgttgtaaatctaccataaagatgaacaagtatggtgggaacttgatagggtaaagtgaactaattcctctctcttgtaggagatttgaaaaattaaacagtgcttcctagaaccatcaagaaggaaaatggtgagtatgtatcatagaattattctaactgggtggttggttgcttgtttctaacccctttgggttccctggagctggagacacaagcagatgtgggtgctgggaactgaacaggccctgctgcaaaagcaacaagtcctggtacctgccaagcctgccctctcagccgcccattacatggtttttaatttgtgtgtgtgtgtgtgtgtgtgtgtgtgtgtgtgtgtttttctttttgagacagggtttctctgtgtagccctggctgtcctggaactcactttgtagaccaggctggcctcgaactcagaaatctgcctgcctctgcctcctgagtgctgggattaaaggcatgtgtgccaccatgcccggcttctcctggtcatcttattttaacgtctatctcaccctccacttctgtccttactctggtcgtaaattcatcgttaacatccacttcatgttacacacttgcaagctgatcttcctgtggggtaactggtccaaggtgggagcctatgtcctcctctacccccaaatgtaaaggccgtgtctctctctctctctctctctctctctcacacacacacacacacacacacacacacaaagttagcatgcagtaaattttgttgatggaatgaataagcccaaattaaataacagaggttacagaactgtgtgttatcagcactgacattgacagtgatggttcgatggacttaagaggggagccgggtgtgggggtgtacacctataatcccatcacccaggaagcagataggaagatttcagacttgaaaccagcttggactacatgagacgaggatagaaatgggccttggatgtgcacaactttgtagagagctttcctaagaagcctgggttttaccgcagtgtccacagaattgggtgtgatgacacactcctgtaaccccagcaagaggaggcagagtcaggtagatcgaaagttcaaggtcagggctggagtggtgcttggtgctgtaccagaggatttggttttggtttccagtacccacatggtgggtctcaatcatctgaaactctagttccaagggatccactccctcttctgatgttctcaggtatcaggcacttgtggtgcagccaaatccatgcaggcaaaacatttatacatataaaatatattaaaaactttaaaaaaaagtttagttgggtggtggtggtacagaaccttaatcccagcactggggaggcagaggtaggtggatctctgttagttcaaggccagcctggtttacagagctagatccaggacagccaacactatgtcttaacaagttctttcaataaaacatattgtataaatatacattatatacaatatataatgtacacagtaaaatatattatatttaaaacaacaaataaataaaacagtttaaaacataatcggagtttagtacactcataaatcgaaccatcggaggcaggaaagggggcctgcctttcaatcccagcactgaggcaggcccagcactgtgagttccaagccaacctggtttacagccaaggttgtatttagtgagaccctgtcttaaaaaaaaaaaaaaaaacagaagccaaaaaaaaaaaaaaaaaaaaaaaccaacaaaaaaatcaaataaaaattcggaggcgtttagcctcttaagaaatttcaaaagtcttctacttcaaatcatatgcagttacaaagttcagtacaaagggagaaactccagctcattgctggaaaattgtgaagacagtacaaaacttccgtaacggttatatttgagcgagatctcgacgctcgccttttcttgcagctttttttcattgctcgaacttcaggaatatggnnnnnnnnnnnnnnnnnnnncatgcgcgcggccgttggcggggccggaacccttgtttcgcctctctctccgcctggcggagtgtgttgagcgaagcaccggacatcggcactggcggagccgggcggcgaagctggagcggcggtggcggcggcggcgggaggccggggccggggctgaggccgaggccggggctgcgaggcccttggggagacaggcggcgggagcccggggcccgagcccggagactggagcggccgccatggccgagagcatcgtgagtgcggcggccgggagggagcggggcgctgggatgaggcagcagatttgcgggtgtcctgggcgggccagcgccggacggtgctcggagccggtggctcctcctcgctcgccccgggtttgaggaggtacctgccctggccgagcccggaaaggctggcgggaaggaggccgagcggtcggaacggagcggccttcttcttccccgctgctgcaggttgctctgagggacctcggcctcctcccaggccccgaagcccggtacgtccttctctcctcctccatcccgacagtgcctcgtcacgatttcactccggaagagtcgaccggagaagaaaagggcatcattaggggaacccttttcccacagaggacgcggccatgggggccaacccaaaacaggcgggattggctcctctttgacacaggcgacttgacgaccacctgtttaaaaggagtgtcataaagaaggccgatttcacttttagcctgacagtagagactgtcacccccagccccatgaaataagtcagtaaaaggagaggaaaaccagccgtttgttaacctgtgggagtttctctccagagcatatgtggcaggggttgggaagtgataggagtaacagacccgttctgacagaataactagggccaacatggaggaatattggggatttccatgggatcggaatcatggtggttgccttaggcctgaaacagctcttcagtggtttcctgcattcgagaacatcacatctctctggatttccagggaagtatagctcttgagttttgtttgtgttttgagacagtcttactactttgtcccaggccatccttgaccttgacatcctcccacctcacttatctcactgcagacatttatggcaggctaagagttaaggcttttctctgagggcagcttctctttcctcacagctccatttaggggtcttctgttctctgtattttctatcctggatgcagacgatgcagagaaacctgagaaagaaaggctgacttagttttaaaacttaaatttaccatcacagatgacttgcctagaaataggtgaggtatcagtaggtcaatccgctttttaaatttctatttatttaaatgctctttactgaggttaagcagtgtgttcaggtgttccaaaggctgacttgggcatcagtgggtcttaaatcgactttctcaggttgtaaggaattaatatactcttcagaagttgattttaggagttttgcttttaagacctatgtatttattttatgtgtatgggcgctttaccttcatctatgtgtaccacaactggttgttaaggagggcagagtaggctttggatcctcaggaacaggctgggagagactgtgtgggtgctgggaattgaaccagttcccctggaagagcaagcagtgctctttgtgcataagccagctcactagcctcatttggaaagaattatgtgtatatgtgggtgtgaacacatgagggcagttgttgctagaagctaaaggtgttggatcccctagggcttaagttataggcaggcaattgtggatcctggggactgaactgagatgctctgcgggagcagagagtgagtgtgtgtacctgctgagccacctctccaggcgtgtttgttttgaattcaaagggggtcttcaaagaaatttctgtaggaataatgttaaaaactcaaccactcttccaagaaaatttcttttcttttctttccttttctttttaaaaagatttatttatttattatatgtaagtacactgtagctgtcttcagacacaccagaagagggcgtcagatctcattacggatgattgtaagccaccatgtgcttgctggaatttgaactcaggacctttggaagaacagtcggtgctcttaactgctgagacatctctccagcccccaagaaaatgtctattcttttaattttgatctttttgggttttttttttttgtttgcttgtttgtttttgtttttttacgttgtgacccagactcagctatgttgtccaggctgtcttctatcttcagtgctcaaattcctcagcttcccagatacgtggagctactgctgcttgtttccacacatttgacttttttatttttaaatttatttatgtattttgtttttgtctgcatgtacacctgcatgtcagaagagggcatcagatgccagtatagactggttgtgaaccagcatgtagttgctgggaattgaactcaggacctctagaagagcagccagtgcttaactgctgagccatctctccagccccacttctaacattaagagtctgtgttttccacatggccaaatctgtctgttccatgtattcccttttgcagcctgtcagaggttaatccaaaacttttctcagtacatggttctttcttcttaaacccagactcccatcaggtagagtgactttacactttagaattcttctttggtaagcaaggcattgtggcataggcctgtaatcccaggatttaggaacctgggtcaggttcctaagggtttgaaacttgtctggtctgcatcatgtgtacaaccaaaccaaaatcagccaacaaacggatttctcttgctgctgctttctcgttgtgccagggtgagtgacgggatgaaggagcatttgtagggcttccgtagagaagcaaggtcttcactatcacgcgtcacagtgttggagacagattgcagagtgaaatacatgtgaggtgtttttcctaggcatcaaatttcgtgtggcgagagttctggaaatcagtgctcacttatcagagaggaaaggagacagatgtggatcagaagcaaatgggtacacagctttatgtcctttatccagaacagaggttttaatatcgaacatactggacaaagccacgtgaaagtcactagaaattgagaggcacagtcaaattcagttgactataagccattatggaattcctcacccggtgtgtcagtagaagtctttgttcacgtatgttctgtacagtgcacattagtgactactggagaaagcactaaagtagaggtgtttgctgagctattctgtgtcttccctgtcagccctcaagtggcaacagctgcctggtttacaggcctttcctaaagcagaggctgccagcaggctggcacaatgaatgacacgttctcagaaggtctggatcagtatacatgtcaagttctcgaaagtgggcccatgtctgacatccttggaggccagccgacatttttatctttgcttgctatgaaaatccaagaaaacctgttcgagtttaccatgatattaaggacctttattttgttttattataaaattaattcatcttttttgttttatatatgttgtatgaatttatgtgcccctttgcatgtagggttctgaggagcagaagtgggtagtgcatcccttggaactagaattacagacagtttagagcttccatgtacacagtgggaattaaacctagtgtctccagcccttttaagacgatttcatgtgatgtcttcttgtgatcttgaaaggcagtacatgcatgtggtgcacagacatgcatgcggacaaacacctgcacttgtaaaataaaaacctattgcctgggtgtggtggcacacgcacacctttaatgccagcannnnnnnnnnnnnnnnnnnnccagcatcagttgatactgactgtctccaatccctcctgtctaggcggatgctatctacaacatgataggctaccccaacttcatcatggaccccaaggagctggacaaagtcttcaatgacgtaagtggcttccacatgcccctcagactcctcgatgcccatgtgaggaaaggccagggtggtggctctcagcctgtgccaacttgatggggggtggggtttagggatatgggcatgaggaaggtttcccctgttcctttgtgttcctgggtcagtgggagcccctgtctccccagagccaccatcacccattgtttggtggttattactggaacataagctctgtgcctcactaggaatggccagctccagggaggggccccaacaccatgggacagaaaaaaggacagggagaagtaaccagacagggcaacgtgcatctctgatcctagcactccaaaagctggggcgggaggaacagggttcaaggccagctctggctacttggcaagttcacagtcagcctggactataaggtagaccctatctcagacagacagacagacagacagatccaaagattaagggaggtactggagctcggtggttcagagtgcggactgctcttacagaggaccagagttgggttttcagcacctgcattgggcagttctcacaaccatctgtaatgggatctgatgccctcttctggtgtgtctgaagagagccatagtgcactcaacataaaatagatctttttaaaaactgaccatattagctaggacaggcataggatatgtctgtcagcactggacatagtcttgctgaagtcccaagtgctattatgttagggtggcacatagcatcgtgaccctctcaggcactcttgggtaacagttctagggtgtctttgaaagggagagtcaagccaggacaggggtgggcgcacgcctttaatcccagcacttgggaggcagaggcaggcggatttctgagttcaaggccagcctggtctacagagtgagttccaggacagccagggctacacagagaaaaccctgtctcgagaaaaaccaaccaacaaaaagaatccaaaaaccttatcttaagattgtcttatgttgtccaagctggcttcttctgatgttctcacatcctcctctagagtgcttgggatcacatgtttctaccatatttagccttgaagttgtgcgttccacgtgaaattataacgtgcttgaatcagagtagtactttagaccgtctttcatgtgttgaggcacctcacatcttgtttctccttcaaggaaaaatggaattggggattgaaaggggaaagattgggagtggggaggttaggtggaagaggggttgctgtgtaagcactggggcctgagtttgcatcccagcacctggagaaacgctggacacagacagaggtggacttctgtgactccagtactgcagaaggtgcagagcagtagaggaagacgccctgttgactgacggcgtgtaggtgtgtacagtgtgtgcacctgtgcatacagtacacacagaacatgacagaaagctgcagaagctgatttctacctttagtttgtgtaagtcttataaaaccaatcctttactgggtacagcaactgtcttttctggtttcacagataatccgtgtccagtcccctgatggcgtgaagaggatcacagctacgaagagagagacggctgccaccttcctgaaaaaggtgcctgtgacactgaccccccgggccctgttctctccagggcttctgtctctgccttttcctctttcctttctgacttccaccaccaggctgtcactcataccgtgttttcgaggtgtgattggactggatagctgctggatcgttgttgagggacagggaggtagagaaggaaacgagacagactggcgaagtcagaaagatatccagagcctcactgtgtaagctggccttgtgctctaaataattctcctgcttcagcttcctgcgtgctgctggggtttcaaggatgaatccccatgctgaactctggatcaggtgtctaatcacagttaatatctactggaccacaggtagatgttaaagcactttgcaagagtaatttttgagaaggaaaatttggagttaagtgtggtgctaacgcccatgtcttgtcttgggaagctgagatgagaaaggtttaaggcctgtgtaggcaatgtaaactgcagaccagctgggtccatgaaataagaccctttctcatccccctccctgacagagcaagcaccatgtttcaaacaaacaacaattagagaaaaacttcagtttatcaaaggggaatttttaaaatgatccattctatttctttgtttttgttttgagatagggtctctgtgtagccctggctatcctggaactcactgtgtaaaccaagatggcctcaaactcacagagatctgcctgcctccgcctctctgcctctctgcctctctgcctctctgcctctctgcctcagcccctctgcccctctgcctcccaagtgctgggattaaaggtgtgtgccactacactcagctcattctttattaattttgagatagtgtctcactacttagtgctgactgacctggaacttcttttgtagaccaccaggctgtcctcacatgctggttttgaattcagaaaggtctgtctgcctcagccttctgatttgatttatctacctatcttccttccttcctttctttctttctttctttctttctttctttctttctttctttcttcctttcctctctttctttctttctttctttctttctttctttctttctttctttctttctttctttctttctttcttttcgagacagggtttctctgtatagccctggctatcctggaactcactttgtagacaaggctggcctcaaactcacagaaatctgcctgcctctgctgggattaaaggcatatccaccacgcctggcttttttgatttgatttatttttatcttatgtatatgagtattttgcttgcatgtatgtttgtatactacatttgtgcaatgtccatgatgaccaaaagagggtgttggattcttctgaactggagtttcaggtggtgttggtaactgattccaggtcttctgcaatgttttaaatgttttaaacagctgacccatctctccagccatgcccctctcccgattttttttttttaggtatatggatgttttgcttgcatgtgttgccaggtctgtagacatttgcctgcatgcttgtttattaaatagaacaatgggagattctggcaattttgttatttttaggtatgcggatgaggatatgtgtaccacatatgtatgtctagtacccgtggaggccagaatagttgtcagatcccccttggaactgggttacaggtggttgtgagctgctacataagtttggaatggaacctgggtcttttagaagagcagcctttgctcttagcccctgagccatctcttcaggccaccccttccttccctgattcttttttttgttgttgttttgttttttgagacagggtttctctatgtagccctggctgtcctggaattcactctgtagaccaggctggcctcgaactcagaaatccgcctgcctctgccttccgagtgctgggattgaaggcatggccacctctgcctggcccctgtttatgactctgtatgtaacagggagtattggagagagctgaatcagacttaaggagaataactttgttttgtaacctcagtttagctgcattttataactaagcgcatagtgttattcttgaggtgttttctttggtgaggtatttcagatttcaaaagcaatctttttactgatattcctgctacatttcttcaaatcttagacacaatggaggttccaaagaaatctcaatatgtatacctaggaaactgtttgtcattagagttttattttgtgctttggtgctttttgaaagttatttggaaagcattttaactgtgtatcattctcactcatttataagaagcgaaaaccttaatgaaattagcgggataggatctgagcagctttctgcttacagggtctagccttgctgagttagtgtctgtgcagggcctgtcgcaaagggtcctcaactgccagtgtccagagatgtggacacccagcacccaggctgctctttccatggtaactagagagctccagctttcccctatcactcattaattggcttttttggtggggtagcaaggtatgccattgggagtgacaagttcacacaagcctaggcagattgtcaatttggatgagcactgggcctattataagatcttgttgtttacaagtgtatccatgttcaagatggcattatatagccatctttaatttatgttttatttttatttttcactgaacagtgtgttatggatgtggttctctgatatcacatgcagatttacatctgtggaattaggtgttctttttctcttttcttctgttagggatttcattccattccatttttcattccccgttaagtttcttgtatacttacattgctgtgaaacatgtcttcagaacattttcattgttcaggtctgagatctgttctccctcaaacaacttccctgcagccctggttactctgttttctcttcccactaaagtgttgagttccactactttagatgtctattgtaagtgggactatactatgtgtgtgtgtggttgaaatcccaatttaaaacagcctctttctacccttataaacttgcttggaaagcaggtcttagccctgtaaatgttgtttgggcaggatggcctgtcctaagtagccttttttttttttaaaccaaaaaaaaaccatatgtatgtatatgtgtatatatatatatgtatatatatatatatacacatacacacacatacacacatacatacatacacacacacacacacacacacacacacacacacatatatggctttatataagtagataagtaagtaagtaaattaatgttgtcatgtgtggtgagattgtttatgttgaaaacagaccagcacttgggaagtgcaggtaggaggattaggagttcaagaccagctttagctgcattctgagtttgaagccagccagagctatttgagacctgtgtcactgtcacctctacctcagccagaaaagaagacgatgaagacttgtggaatcttagtgattggttcatttgagaccattcatttcaaggtctcactgttgggtttttagagcctagaacctctagagccccacatataggatgcttaatatctgttgagttaaatgattaataggtcccatcgcacaagggatttgattatctacctctctccccacttacttgttattccttcctttctcctttcttttctttttcccttttattgttttgtgtcagatcatcagggtctcatgcatacagtctagaactttttgtgtagctgagactagccttgaactctatacccccgcttccatcttcccagtgccaataccacaggagtttgccactgtgcgcagctgacagaaatttcattttaaaacatttaaaactattttacacttatttatgtattggggtgatggtggtgacattcatgccgtgatacacacgtggaagttagaggacaacttgcaagagtcaattctcttgtcctattatgggcccagtatcaaattttggtcattaagctgggttggnnnnnnnnnnnnnnnnnnnntcattaggctgggttggcagcaggcactggctgctgagacttgctcgctgcagccgacttcccagttggtagcatcattctgcactccatttccctctgtggtaggtttatgattggaattgggttctcactagtgtttctaaagcagcaattaacttaccacaatggccttgactctggctagtttcaactttttattatttatatagaaccttggcttcttttggaccacttattgaattggcattggtatgatcaatacagtttttctcaagtgaaatgacaaagggatgcatccttgtgctgagcatttcctaacgttaccaagtgttcttcctgtggtcttggcagcctgtggcatgtgatgcttggatgtttcattatatttctgttgtttggggcttgtaggttgcaaaggagtttggcttccaaaacaacggcttctcagtttacatcaatagaaacaagactggagagataacagcatcgtccagcaaatccctccatttgctaaaaatcaagtaagtgtccagccggtggaaggtaggcagtaggaggaactatgtgcagtgccctacctgaggctgcctggattccctctattctctggataccactctaactaaggccttgctcacttctcacatacaggggactgtgttgcttggccggtatacagcagtcatgctaggccagcagttactgttgagcaggtttgactatggaattctggaatggttatggtaaagagaaggttatggtgttgagtccagatctgaagtagggacaataccttgtctagaggggaggacttagagcacagctgtttgggaaatagatgccatcgtcagccctgtttactaagaagataggtgaggtgaggtgtgatggtccattttcacatgtatgtgtcagtggggcttcggcaaaggcctatggttatggagttcctgtgactcagtcatgcagcagtttgtgagtgcaggggagagtggttgtaataaatgatggagcctgcagagttgacgtttgctgtgtggttcttttattgaccagcttgttcactcttgggcacctgcattcagcagtctttttattttagatgtatttattttatgtgtgtgagtgttttacctgcatgtatggctcagtctgcaggcatttgtctgcacgcctgattactagacagaagagtaggcattctggcagtattcacttttaagtttatagattagtatgtgtggggaacaaactatgtagtgatgatatactttgttcaaagacttggcacctgtttgtctattctgtaactagtttgtgcctttcgttatgggttatgcttacttgtgaccatttctagtagagtggctgaagtcatactttctttgagctttgggaggctttgatgtgtatgatttattttgggtaagatattgctaggtctgcagatcaggctggcctttaagtttttatggagctggaacctcgggttttgaacgtagtagttacctctgtacctctgggctgcatcctcaatccggaagaatggtttttgcattttgaaaatcagtcatttctttaaacaaacaaacagaaatgtatagctagcacatgggaggcagaggccggcagttatttgtgagtttgaggccactctggtctccatagtgagatccaggacagccagagctacataatgagaccctgtgtcaaaacataacaacaacaatttatttcatttcatttgtgagtgtgttcatgtgcacacatgtgtgcatgctcttgagtgaagaggtcaggacaactttgggaatttaattctctcctttaggccccagggatgaaattcaggttgtagggcttgtcactaggccagtgagctgtcatctcaccagctcgccgagtcaagtcatttctcaggagttttgagtttatgttcccattctttccctccctgggccttgtcatccctgtaactgccttttccacatggatggagggagcctgtgtgctaagatacagtggacagtgaaagagtggctgtggcttgttggctacatttttttaaatttgtgtgagtgtgtgtgtgtgtgcccacgtgcgtgtcataggtggttgtgggctgtctgatgtaagatgctgccaagctaaagtctagtttgtttggttttgagtcagggttttcctgccttgagctgactgttctgcccccttcctctcagtgctggggtcatgggtgtgtgtaaaaactgttctcatgagtagataaagacgagaaatggagtataactgggtgtactcagaacttactgttggaggcaggatgattgcaaatttgaggccatcctgggctatagagcaaggccttgtcttaaaagaagaaaaagaaagcaggcaccaagagagcagttttcaggtgaaccacgtgggccgctcttttgctgctgcaggtgagccatgtggcccgctctgttgcaataacagtaagagaacagaaggtatttgaaacacctctctcagggctatcctaggcatttctgttgttactgtgaaggcagggtcttaccatgtgttatccttcttgccctggaattctgtatcatccaggctggcctgaaatttgcaccctgcctccttcctgctgggattagaaacctgtgctactctgactgggtctagattgtatgttgtaatgttttacctagacattagttgtttatttccttactgtcttagagggtcaagatccaaggccaaaaggtataaagtatttctcattggcctgtgaaaagctgctttcttactgtgctcgtatggctgctgtgtctagagaatacaccataataccgttgaaattgaaagtaactacaactttattttacttgtgtttttaagaatggtatttctttttttgttgaaattctgtgtgaatcttactcttctgtcttgtagtttcattattgttgctcagtaatgaaatgtgtttctgttactcttttttagggtgcgtgtgtgctcatgcattcatgctgtgcttctcctgtctctcctgggtgctttaagaagtttgtggctgagtagcagagtgcttgtctagcattgctgattctctggtttattctccacacccctttattccaagaacacattggcctagggctctgaagtttttttctgttgaatttacctgggtgttttgcatggttagttaatttgtgcttgatgtctgctcgattggtagattttatttcaacaaatatattttcacttccttgtgttttcctgtatagcctttgctggccttgaacataacactagtcctcctgccttagcctttcgagatgtgaggcactaggcccggctcatattttcactttaaaatatttttatttgagccaggtcatggtgacattcctttatttccagcccttgtgagacaggggtaagtggatctctgagttcaaggtcagccttgtctacaaggcatgttccaggacagccagggatacagagagaaagctgttttgaacctacacaatatatatttttatgtatttagctttgtggtagaacatgtgcctagttagtatgtgtaagaacctgggttccatccctagcaacatcaccactaaaaaaaaaacatacacatatatgattccttttcannnnnnnnnnnnnnnnnnnnaaaaaaaaaattagagccgggcgtagtggtgcatgcctttaatcccagcacttgggaggcagaggcaggtggatttttgagttcgaggccagcctggtttacaaagtgagttccaggacagctagggttacacagagaaaccctgtctcgaaaaaaaaaaaaaaaaaaaaaaagtgagaccctatcttaaataaaataaataaataaataaaggcttgtatggtggatggctcagcaagtaaaagtgatgccatcaagcctgacaagctgagctcactctggggcatacatgaggagagaactgacccccacagactgtcctctgactgccacccctgtaaaacaagtcaatatgaacatactacaaataataaataaataaatgtgctacagaaagtttgtaataatcactgggcttggggattcagctcagtggtgggtgcacatgtgcctagcatgtgtgagactctgaaaaaagtacagatttatgtgggttgtggtgttctggtatgagtatcctgtgttgtggagtattcttccactagtgggacaaaataaatacctgaggaaacagagggaggaaagattattttggtttagtttcagtccacagtgacttggctccatcgcctctggagtggtaaagcggacattgcaggagcatgcagtggggcagaacagttcaccccagcagacaagaggcaggtagagactaagatggacaggggacaaaacacgagactgagtatggtttcctaccattaccctgtatccccaggtctctcctcctcatttttttttttttttttttttttaaagatttatttatttattatatgtaagtacactgtagctgtcttcaaacactccagaagagggagtcagatcttgttacggatggttgtgagccaccatgtggctgctgggatttgaactctggaccttcggaagagcagtcgggtgctcttacccactgagccatctcaccagcccctctcctcctcatttttaaactttttattttgagacggtcttctttctgtgttgcccaggctagctttggacttgccttttgtctcctgagtagctgttttacaggcctgaaccactaggcctaaccaaagcgtgatttgattccctttcctaggggctgttgatgtctagcactgcaaaatgccaggcggctcctagctttttcctgaaaggtttctgatccattctctggagtttgtgtttatgagttgtaattccagcatttgagtcatagacttgcctctctctctcagcccttactctgtcaattcttcctcgtggaaatttatttcccttgtaattttggtttttattggggtaagtgtggcttcgaagaggatctatttgatgcaagctttagtggcatttgcttatgtgagcaccagggggtgctgtggagctgcattctcttctggtttgggtctccagatcccagaagcagcccaggtttcactccatatgcgtgtgcctggtcttggaggtgactttgccctgcagagcatctggtggaagtagactcagtttcttcttggttcccattctgagttcctggattctcttggttgttctgacatccttgagtcatgtggggtttttttgttctttaaggacgttctcacattatccaagctggccttgcacttgacgtctagctaaggctgaccttgaatttgtaactgcttgcttttttccttcccaagtgctgggataacaggtgtgcaccatcaagtctggctagtcctttggtttatgtaggagattcaggctcagcagtcaaatgtgagcagggagttcaaagacacatctgttgcccagtaaacactgtcgtctatgagcctcaagttcctgatcctggccttggccgagggacagtcgtgtcctctgctattattagtgacatcactgcgagctttggaaggcctgggtgttttttacctttggagctcagcagtgtttttacagtgtatttgctaaaatcgatccagtgtctgagccaagtattttatagttagaggatgtttagacatatttaatccagtgctagaagcagaagttctggttacagtctgacagctttattgcctctgaattatgggggataaggaggtgagggcagctcttgagagctgcagcccccgctcctgggattctgcatgtctgtcagtacttgtacttgcagacattgttcttcttcggtttgctgttcagcactggaccagttgttctctcagtttctttcttgtgtgtcctgttgacagcagctgaaagtttgcgaaatgatctgtcacctcccgtcttcaaaggctggagctgatttagtgccacgagacacctctggtcaggcatgacccacgatggttctgtgaatagcttcagagagaaaacggttctttagccacaagtcatgtcaagttggagcagagcaagtagaattgtggcagctcttttggaaagcaggccttcagcagtcttggagcaggaagctgtgtctgggagtctgccctgtcagagggaaagaaagtgttggcatgtgcttgaggtgtgtgcttcacagtggcagaaaccagcagacttgcccaaccctgtagtgtggtgaccctctgtccctggggggggggggggtagcacacatctgtaatcctaacacccagtaagtagaagtagaagaattttgagtttgaggccagcccaggctgcatagtgagatgtggagtttttttgtttttttaaataagtcagtgttttagttaggattttattgctgtgataaaacgccactaccaaaagcagcttggggaggaggaaagggctgatttgccttacacatcctgggtcgcagtcttcgagggagagcagcacaggaagtgaagtggaagccatggaggaatgctcatgcttcttggcttgcttagcctgctttctcaaacaccctaggaccacctgaccagtgggctgggcccgttcatatcagtgctaattaagagactgcccacagctggcctacaggccagtgtaccaggcaggctttcagttgtgcttccctcttgtagactttagtttgccaagttggcaagacaaaacaaccaaaacaaaccaaaaaccaccaacaggacagtcagggttgtgcctgggaacttgctgattgtggcagttctttgagacccgtagatgagcagactgagatgtgaaatatggtgtaaatcagtggttgcatcgtccgcgtctggatgcttgcaactcatgtcaccttatccagtctcggacttgtgtatgagacacatggatggagggagagctggccatggcctgagagtgtgggttcgatagattgctgtggatggcgagctcagcaaggccagagggcagagacagaaggaatgggagggctgtcctcggcccagctgagcacaggctgtgttaacacatgcagtcagatggccaattattggtaaggaagttaacttttagaggatgtgcgctgttgtgtgtaacgccaggaaagaaagaattctgttgtcttcaaatcaggaccttccctatgtaggccattaaatggtagcatttgtcctttgaagctgtccgggtccacaccagactttgtggtttgtatttgggggagtatggcattgtgacattttgtcctttgaacaggcatggcgatttgttgttcctgtttccctcaagccttgctggaccctcgtctgaaatggaaacatcgacctcggtagggttaaaggcctttggtgctcctaacgtggttgaagatgagatcgatcaatacctcagcaagcaggatgggaagatttaccggagccgagacccacagctgtaagtgctccataggctcctgccagtgaggctttaatagatcattaaagtgaatatttaagagctgggtgtggtggctttagtaatcttagcccttagaggattgttgcaagttcaaggtcagcctggtttacatagtgagctcaggttagctcatgcaatatatatatatatatatatatatatttttttttttttttaaaaacatgttccatgttagtaagcatttgataaaggtgaaaaatctgagtctggccacctgttatcacattattttactgcagttatacaactctttagtagatggaactttaaaatggattccacatagaatgtttaggagtatgtgagtactaagaagctcaaaaggtgtctagagacatgtagggtctgctttgatgcctcttgagatgagtgtctgctccctccaacagaggtaggcgtagaagacactgatggtggttgatgtgttagcagtgtaagggctggctctgacctctcaggagcagtagaatgacttctagaagagtatcctgggtaccctgcagtgaatctgatcccagatctgctccttggttagtcacttgtaccaggttgtgtcacatgatagtgcatgtgcattcctttatcttaggattttttgcagttctttttaaagaaactagttaggggttggagagatagctcagcagttgagagtgcttgttcttgcagaagatccaggtttgattctcagtatctgcatggtggtttacagctgtctgacctctgccccaggcacgtagtatgaaggcatgcataaaggcaaaacacccatacacataaaataaaattgaaaagtaaaacagagataccagttagaaacatcatgatctacactcagatgtgaaattatgtacatggagactgtttgtctctgcagtagtgtgtcactgtgtaaatgcaataaggtgctgacactgggatactggttctaaatgctacatcagcaacttttatgtcagatggaatagccagcagtgcactcagctgcaggactggagcctccaagactccagttggtgtttcttccaaggactcactataatctgggctttcttggtcctttagagcctgctcacatgtatgttaattctgctcttcagaaataagcctctccaagtgatggagggagcacatgtttcttttctgttttgttttgtttgagacagagtttcctctgtgtagcctgactaccttataacttgctctgaagaccaggctggcctcaaactcagagatccacttgcctctgcctccccagtgctgggatcaaaggcctgtgctatcactgcacagctttcttttctttcttttctaaatattactttatatgattattcttgctctcttcagatacaccaaaaggggcatcagatctcaatacagttgtgagtcaccatgtagttgctgggagttgaactcacgactctgaagattagttcttaacctctgaaccccccagccttttcttaacattttcatttagtgcaacttttttttaaattaatttatttatttattattatatgtcagtacactgtagctgtcttcagacaccccagaagagggcatctgatctcattacagatggttgtgggccaccatgtggttgctgggatttgaactcaggaccttcagaagagtagtccgtgctcttaaccgctgagccatctctccagtccttactgcaactttttaaacatgttatttttcatggtggagattgaatacaacctcatgtgttgtttattttttagctggtgtcctatgaagcagttaacattgatgaagccatggatttgatttgttggttagggtttttaacttccctttttttactttccttccctccctccccattcctcctttcccctcttcccctttcttgtcctcttttgagacaggctctccctttgtagccctgtcagccagtctgaccttgagtcttccagcctctgcctcctgaatgctgggattacaggtttaggtaatccatcctgtagttttttttctgatacataccagaataaataactattatagggggaacatttgtttgtgtaccatcaacagtaattcttcatttgtagggaagcactttgctgaagtgtgatgtacattttaaatatcaaaaatattgggaagtagcaagagaaggtaacctttgtatctctgtgcttttcttccaccctgtgcattctccagatgccgccatggtcccttgggcaagtgtgtgcattgtgtcccactggaggtaggtttgaagaggaggttttgcctgagcagtgtggttggctgctgctgagagagctgtctaagcattttcttatcctaaactggggtgttttggctttttaaagattttctctatttattgtcttgggccttttattcccagttgtgcaaatagcacaaagaatctgaggcttatttatgggagtgaccttcctttaggggagattgtgagtggctgagacattgtgttgctgtgatgaaggggtatgtacagttcccttcctagataattcttctctgacacatggctgggcctctctgttcctgcatgtgatggttttgatttactgtgtgtgaatcttaggtctccttttgatctttctctctctctctctctctctctctctctctctctgtatgtgtgtgtgtgtgagagagagtgagagagagagaatgaggaccgcctctgaggtacaagggctctgtcactaagctatatcctcaggcattttgtgactttgcagtcttcttagagctttagtatttaacaggagttcattttatcttgaagaaatgtgactaatacaaaaaaatccttcattctaaccttgaactagtaaagacccagcttagcctccctcattgtctctgtgccttctggtctgatcccctgcacagtaaggttcagaaaaacctcatgtgtcctggcagaactgtggcgcttcattttctgtgtatgttttggcagccatttgatgaggactatctgaaccacttggagcctcctgtgaagcacatgtccttccatgcctacatccggaagctgactggaggggctgacaagcaagtatcctctgtgtcccagcacgcaatctcttcattcattcctgacgattatagtttatagacacagggcatgggaatggaaaagtgaagccttgcagtacagaaaacagagcagtctcaagtgttgcccattccagaggcagggagaacctgtcacatgtcctgctgtcaccacagtgctcggggaggtaaacagctgttgcaaagacagctgctccacgaggatctcagtgcacccacttcccgggctctccctctggagaccaaccaggctggcctcgaactcagaaattcaactacttctgcctcccaagtgctgggattcaaggtgtggccacctcgcttggtgtcagctttacttttacaactgaaatggggctgaagccacaacactctcgtgggctgcatcctggtactacaggggctctagttaacagacttggtcaggcaaggcagtgtaagcagccacctctctccctgaatgcagtggcagcagtggccagaaaggtccgctaaggcagcacctgttgtttgattttcctaagacagccctggctgatgagaggacagggctctgagttcaagtcagcagggttttttgtttttgttttttgttttgttaaaaatgattgcctgattgtagcttttctcagataacctgccagcattcaaaataacttttaaatctatctatctatctatccatatctatttttttttttttttttttttaagacagggtttctctgtgtagccctgactgtctggaactcactctgtagaccaggctggcctcgaactcagaaatccgcctgcctctgcctcccaagtgctgggattaaaggcatgtgccaccatgcctggcagctatttatttatttatttgagccagaatttttctgtgcagtccaggctgtcttagaactctcttagtagaccagactgggctcaaactcagagatctacctgcccctgcctcccgagtgctatgataaaggagtgggccaccacccctgggcaaggcaaggtgatcttgactcagctcaagccatccacagcatgtgagtattttgaaatcatcaacatcaaaaacgtaaaattttcatttacaaaaaaaaagccacatggtacaacttaaatatgtatacttttttggtcagttatttcttaataaaactggggggaggacaagaaagaaaatggaggttgttagaatgattctgttggataaaggtccttgctgctaagcctgatgagctaaactcagtccctggccagaacccacatggtggaaggaaagaaacaactattgtgagctgacctctgacctctgcatgtgaatgcacactaaataaataaaacaaccattatcaagcaagaaagtagaatggacccttctgtgattgagaaaacggagagcacatacacagaattcctgtaggccaggggtcggcctggtgcttcctcatgcatgtggtgcctttgactgtagtagatgagtgacgatgtgacagctctgtcctagtgagagtttccctaagaagaagcatgttacacaagcatgttacagtaataacattactgtattactgtagcatgggctatatttgccatcagtcacaggtttccaacagtgttcttgaaaacatcatgggtgtgggaaagagctgtgtgtccctctataggacacggtagaaagtggggaactttgaagttagactagagtggctttagtgtattgccttgtgctctcgccccctagaagcactgtccagtgggtgtaacctggctcacgtgccctctagtctcctgcctaacttcccactagtgttaggtttaactcagccttgttttccctcaggggtaagtttgttgccctggagaacatcagctgcaagattaagtcagggtgtgagggacacctcccatggccaaatggtatctgcaccaaatgccagcccagtgccatcacgctgaacagacaggtaagcagcctatgtccctgagatttgttttcatgactaacaagtagacacttcctttgtggcaattctctagtgtttctttttttctttctttctctctctcactctctttctttctttcttatttatatttttagttacttttttggtttgttttggtttttgagatagggtttatctgtgtagctttggctatcctgaacatttttttggaggctggtctggaactcaaagatctgactgcttctggctcccaagtgctgggattaaaggactgtgcacatcacacctggctttagttacatatatgcatgctgtgtgtctgtgggatgtgtgcctgaatagggcaggagagggggagtcagactccctgcagttagatttacagggaattggaacctcctgatgtgggtgctgggaatagaacttggaccttctggaagagcagcaagtgtcccctccagctgccaagccttttagatctaaccgtctgcctttctgtggccgtcataagacagagaagtttctagtgcttgcaggtgtagggcttgagtttaggttccatttggttggcttgtgcagaggatggattttctttaaaaacaattttaaatatttatttttattttacatgtgtgagtatttcacctgcatatgtgtatgtgttatgaatatgtgtggccagaaaaagatgttggaagccccagaactgaaattataggcggttacaggccagtgaatgctgtgagctgaacctctggtgctctctctggcagagaaaccattgagccatctcttcagactcccccttctaaatgtgttttaattattttgttgttgtttattctgaaacacagggtttttttttaggagatttttaaatgttcagtgcttgtgatacctttaagaacatattacatagggctggaaagatggctcagtggttaagagactattctcagtggttaagagactattcttccaaaggtcctgagttcaaatcccagtaaccacatggtggctcacaaccatttgtaatgagatgggtgctgggatttgaactcaggatctttggaagaacagtcagtgcttttactggctgagccattttgccagcccttagaatattttcaaaaaataatttattaatttttattttatgtgcactgatgttttgtctgcgttcacttctttatgaggcgtacagatcttggagttacagacacttgtgaacagccatgtggttgcggggaattgaggtcaggacctctgaaagagcagtcagtgttttttgtttttgtttttgttttttaactttatttttggtaaattttttgttttaaggtttatttacttatatatgtgagtacactgtagctgttttcagatacgtcagaagaaggcattggatcccattataggtggttgtgagccaccatgtggttgctggaaattcaactctgaacctctggaagagcaatcagtgctcttaactgctgagccatctctccagcccagcagtgttcttaactgctgagccacatctccagcccagcagtgttcttaactgctgagccatctatcctgctccaagtctttggaatcttaatctcctttaattacttcattcttattggaaagctacttttcagtttggaaaccttcattctaagtaaaaacagtgaggttaattccagtttattgattgatgaaattctcctttccctgtcccccctgatctctaaagagcagagcagtttgcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctgaagacagctacaatgtacttacatataataaataaataaatctttaaaaaaaaaaaaaaaaaaaaaaacaaagctaaataagttaaaaaaaaataccaactagataatgtttcactagattggttcttgaaaaagttgtttctgatgggatgctttcatttaagcttttattaacctttgttaactctacagaaataccgacacgtggacaacatcatgtttgagaatcatactgttgctgaccgcttccttgacttctggagaaagaccggaaaccagcattttgggtacttatacggacggtacacagagcacaaggacattcccctcggcatcagggctgaagtggctgcaatttacgagcctcctcaggtgcgtgagtgcagagtgcagggcctgggtgtaagaaggtcggggttgtttgtaaggtgctgtggagctcttccccttcccgatgcctcgttctccctttgtttttcccacggcttttctgtctcttactgtatgctcttggacatgcacacatgacacacatgtatgtgataatgatttccaaaattattggagcataagatcacagcccctagggctggcccgtaacacttttagtagaacacttgtctggcactcacaaagcttagggctcagtcagtcccttccacataatctgtatgtggtagcatatgcctgtaatcgcagcattggagagtgaaggcaggaggatcagaagtttaaaatagttgggcagtggcagtggcagtggcagtggcagtgcacatgtttaaccccagcactcaggaggcagaagcagggatctctttgagtttgaggctaacctgatctacagagcgagtttggcccctccccaccaaaaaatgtaaaaaaaaaaaaaaaaaaaaaaaacaaaactgaactataagatcatccttagctacctagcaagtcggaggccagcctagcatacgtaagaccttgaatgaaacaaaacaaaacaaaaaatttgacttccaaaaggaaacagatatatagggacagaaaccataacccccaccccacccccactttttaaaatgtacttgtgcctctaggtttgtctgtgtgtatctgcatgccacagtgcatgagtggaggtcagaggaaacatgctggcgtcagctctctctccaccagatgggttccggggatcaggctcaggtcatcagacttgtagtcacttcttttcacttcagtattctgggtttttttggttttggtttttgttttttccagacagggtttctctgtgtagccctggctgtcctggaactcactttgtagaccaggctggcctggaactcagaaatccacctgcctctgcctcccaagtgctgggattaaaggcatgtgtcaccatgcccggctttcacatcagtattctggaggtcactgtgcacctctcactctgctcaattcttagatcatctgacccagggccccatgtgaccccggggcacatgtcagggtctgcagccgtgactttacgagtatagtgtgtggcttctatatccatacatgcgtcatccctgcctttgttacaggggttctcagtgcctgtcaccccactttgatgctttggcatttgtgtggagatgtgtgagattgtagaagtcttctgctgctttgtttacaaagcaatggttgatggtaactaagcccctgcagagaggcccactcacccagaccttgactgtggtgtgctttccattgaagtgctgctttgtaaacacagagcttcagctcagttttgtagatctctggcatggagtgtgacagttacattaaaagtatagttgaagcccaatgtggatgcttactccttagatctaagcacctgggaacccatgacagattgaagtttaaggtcagctgtgcttcatagtgaatctgagtccagtccaaattaaaaactaagacactgtccaaaaaaaggcaggttgtggcagccagcaccagtgatcctagaactgaggagatagaggcaggggatcatagcagttttgaggccagcttagtctacacagtgactttgaggcagagatcgccttcctttgggcaatgttgaagctcgtgggtcaaggtgaagggtgtagaggcatcattcttcccaggtctctcttctaactgttttctatctgtggttccacccagattggtacacagaacagtctggagcttctggaagacccgaaagctgaggtggttgacgagattgccgccaaacttggcctgaggaaggtatgaggctctgtcagccaggtgctctttagggaaacctgggctccatgctggggaaatccaaacagatggagtggctaagtctgctctgggaccaaaccttgagctgacaagatcaagtgtgggctcagcccctctggaacctctgttgtgtttattggtgctagtagctttgatggtttcctgacttggagtgaggtgagaacatctcaagtgtcaatatgaagctaagagttaggcacatacgtgtccactctgtcatcgcccctccccgcctacactttgctggctgaggcaggatgatcagtagttcaaggctagcctgatacatagagcaagacttatttataaggtatgaaaacacagcttttcaccttgatagccatagttcctaaagatagctgcactctataggaaagtttgttgtacattgcacccagagcagaagagagcttgctcttcatggggcttgctttacttggtgctagtgtcctttctacatcagcattgggctccctgtgtataatgtaggtctctgaccctgcagttgtctgtgtctctgggacagttagcagataggagagtcctttcagtctattactgtgatttgtttcacacccttgacaagtgtcctaggaatggtagcttgtagtttttgtttttaagacatgtccttttgtagctcacactggtctaaacttaaatcctcctgtctcagcctcccactgtgaggattgcagacgtatgctaccatccctgccttgttagggtttacaggctcattgagtcatgaatttgaacacattgtggaagttcagtactggtagtcatgtaagttttgtcctttatttagacagagaggaatgatctgtgtggatcactccaccttacctctcttaggtgggcaggaagacctaaaaacatgactgggaaagtcatagcatggctttaccttgaggcagaaatacctaccctacaggttctggggccatactctactacaaattctgggagtttggtttaggaggaaaagtggcccagtgtttagacccgtgtgttgtggatttatgttttgtaacatcatgaccatgtaaagtctgaagttatgtaagttactttctcagaaccctcattccttgcttgctcttccctcagcctggtttggactgtgcctgttgattggatcctctgtgctaccatcctttttggtttgtgctcatctgagaattgttacagcagttgtgacccatagtataccagacttaggtgtagatggtggtttcatgagttgagtctcagttttgtggagagagtggtgaccatcttgtcagttttcccaaggatggaactggtggtggctttgcttgtcctcaagctccagtctgatgtcctctcactgtctcctggtgctggaggccaaggtgagcagagatgatagagcatgcaggcctgtcactgtaggacatacaggggctgcacagcacctgaattgtaggattggcctttagggagccccggtggtacagctttacagcttggaccctcagcggtggcaagctgaaacctctgttgtaacactcctttcatcttaggtgcctctctccagggacactgtttcttccttgtggaagacctactccaggaaaccatactgcttgcttcttgtctgtcttctttttggagcataaactccttgcctcatccttttggtctcatttacaagctgttctgatttctagtggagtgcgggcttgagtggtcctaggcagagtctgtttgaggggcgcatgtttgtcatcgcagcaccagagggaggtgctggtctctccctggcagcagaattgaggaactgtgctctcagcttttctggctcgggagtggaagggttgtctgcagggcactgcttttaccctccctggacagaagccatctgttgtgtggagatactcaaagatgctttccttttccattaaggttggatggatattcacggaccttgtctcagaagacacccgaaagggtacagtccgatacagtcggaataaggtgagacggaggagacaggagtgtggcttggcctgaaacctcactcaggtagtgctgacttagacctctcagtctctgcacagcttgcagttaactctgtagacagtcttgttagtcaaggctcaccctgctgaatcgtccagccggtcagatcccacacatctccacttgaggcctgtgggagtgggagccaaggtcttctcctctcttactttggttttttacacgagtccctgatagctaggaattgctgatattcgtctcagtgtgattttttgaggcattgtggattgcttgcttatttatttatttatttatttatttaagacaaacttttcagccttggctgtcctaaaactcactgtataggccaggttgacctcagactcacagagatccacttctgtttgcttcccaagttattagcattagaagctcttcttcttctttttttaaaataattttatgtatttgttgtgcatgtgtgcacacatgtgtcacagcacacaggtggaggtcagagaacagcttgtagttgtttctcttcttccatcggagggaacctagggattgaacccaggtcagcctcagtggcaggcatcttcactgtgagtcatcctgctggctcaactcttagttggaatcttagacaaaatagaagcttgttttgacacatgctgtaaaatttgatatcccgcctttcttggcttaggacacctatttcctgagttcagaagaatgcatcactgcaggagactttcaaaacaagcaccccaacatttgccggctctctcccgatggtcattttggatccaagtttgttactgcagtggccacaggtataaatggggcagagtgccacaaatactactgcccattaatgtttgttcttctttgcagcagcttcccatctttaccttggttacaataagcttctttgtatgtgtgtttctttttcaagatagggtttctcttatagccctggaacttgctctgtagatcaggctggccttgaactcggagatcaacttgcctctgtatcctgagcgagtgggattaaacgtgtgcaccaccaatgcccaacttaatttctggttcttataatagtgtccctaccagttcacacacagtctgcatccaggcttctagttcagacttccttctggctctttgagaatccgcactaattcatactgccttaatgcagggacctaggtcagctccctgctgtcagtgggtttctgtttcgagagactcagcatttttttaagccttgctaaatgctagtaagcttgccttttcctaagaggttatggtctctttagatctacaaggaggtacttctcccacttcactccccccccccccgttttttttttttgagtgaacatcctttgaggagtgaaagacactggtcgtgtctttgttctaccatgcttttgattagaggtatgttgattgttgcacgtacagattggtgtcatatttttctaaatttttgctctagttgagtgttaaagggagtgagtggaggtgttggttagggttaaggaccccagagagtccttccttgtgggcaggtagggcagaaggcacctatacaatggcagatgtaaggccacttgtgtggtcagtatacgcataaggtttgacggcagatctgcactaacctgtatcctgatggttagggtggtggcctcctggggtgcttcatgctttatcttgttgcttccttcacagttttgtggccctggagacctcagattatagtcatgtatgtatgctttcatgatggtttataaagtaacattgattctaatctcggatcatgatggtaggaaagtttgcctacatgaatgtgcaagggctatggaacacttgttattgtttgtgacacctcttatctggcaggatgcccaacatcttcaacatcacacaaaagctggcagtgccccttattgaaacagccagaaacaccttcacagacttccagagctgtcaccttcactgagaatggctgttttgggctcctgtgggttcccatagtaatccaaccttttaaattactgtttctatggggaaattgtcccatgggccaaaagaactggcacagttttagaattgtaagtagtttacatcttggagactgccaccttcaattattgagtcacattacttgttgaacatttggaaatcagatcatccatgaaatttttgcatccagaattggctcttaaaggatctggactatgaggtaatgactgaccttggttacaataggatgtcagtcagcctgcttttgcttgagcattaaatcctcccttttgtacttagtctcatcatcgccctctccagatggggcaagtggctgaagaatggctttgtatagtgctggagatcttaatccaagctcttagctaccacagtgagggcacgggttttctaactccaagtgtgctatttctccttcgtgtagggtcttttggccaagagcaagtgggaatcctctaaatgttctgggaaatggacctgccacagtcccatctcctttattggagaggaagttgtgagtctgcttgtttacagacagcatcctaagagttggtgcctcttgtgctgagctcaggtaccttctggacaccacggcctttgcctctaggctctccctacctcctgtgatttttttttttttcacagctttctggctcagatatgtatagtggtttgctcaagagaatgccatatgtcttcctcagtggttacctgcttggctcttgggttgtaaatgactttctggagcccccaggtttgcaagagcttggttctttatgtcactgctactttccagcacgtgctccattttgcatgtggcatttctagcaggtgctttgcataggaaatgaaagttaacttgcccagactcctcaatgtcttatttagcctttatgaagtttcctgaaagataagtaaaccatgtgggtttgtgcatgtttcttctccacttggcaaaggaatgtgtgtagctcaagctactttcagagactacctgtgtggaccaatattactcccccatcccttctttgtgatgtttgggattgaactcagggcttcaaacttgctggatatactgagccatggggggtgggggtggggatatggtggagaggtaaggatctcgtgtcatccaggccagccttaaactccccatcctcttttttccactttacaagtactggaattagaaacatatatcaccaagcctggtttctgatgccttttttaaaaaacaaacaaacaaacaaacaaacaaaaaaccaatgttgtatttataggtactacttaccactctcttctcacaaggttttcttttcctaatgacctgtcacacttaaatgactgatctgaacccattcctggtttgtagtgcccagaggaagcagtaagcagttgtgcacccatgcttgcctgcatgtctccagctttggtctctgctctgtactctgagccacagagctcaggtatggtgccatgttctgtgtgttaccagataagctgcacagctaaacctgaatgtgctcatggccggaactgtggtctgctgaagacgacagataacgggcaaagctctgaacaggacagtggcaactgttttctctgagggcttggtcaccagctgcagctggccttctgtgtatgaagatgaatggcttaggggccaacttttacctttgtcttctacactttttttattgtgtttctggggtctgggtcagatatgtatttgaaaaccagattgactgaatatctgtcctgatttgtaactttagcaaactgaaataatggtaggttttttaaaagtctttagagctctaaaagaacaatgagcattggcgttttccttgtgtagtcctgattctgggattacacctacttacttaagttatacccgttacgtcctcacccccttaatttcagggtccagtgtaactggctgggtgactctgaaatagccatttatattatctttgtctttaatgttttcttttttaaaaatcatattttattataaattacaatattacaaatatgtaattttgttacagtctacctttgtgtttgtgggcacacatatgacattgtttgtgggcacacatatgacgtatcctatagaatgcatgcagaggtccaagacaatttgcaggagtcaattctttttttcatgtggattctagggatccaattcaggcaggcaataggtgtcttactaacctgtctctccagctcccttaatgttaggtctttatggatggtgcttggaaagagggatactcttcagggtttgtatgtatctttagtgtggagagctgtgagtactcttggggtgcccattactattggtctgggcagtgtcctggcactcacagtatgagatactggagcactgacttgatcggaccacatagatttctgtaatctggagatgctgcatggttgatctgcttgttagcatcagttttctcttttcagttatttggagagagagagtagagaggcacatgggagcactgtggtgcacacatggaagtcagttcctcttttttgtgtgggttgtaggtctcaaattcaggccagtctccagacttgtgtggctgagccttcttttcttcttcttttttttttttttttttttttttttgagaccattgtcatgaagcctaagttgactttgaacttgctctgtagtagaggatgaccttgaatttctgatcctcctgccttcatctcccaagggcatttaccactatgcctggtttatgctggagagtgaatctagggctccattatgctagacaagaactctgcaacccagccccatatagagtctgttgttaccccacacctgtacttgccaacctcctgcctgcaaaggaatgtgcggttactcctgacctccttcactgaggggctagagctgccaggatgtggaacagtgtctgtcctcccacttttgtgtccaagctgagtctgagtctgtgtgctttaacacacacacgcacacacacacagttttgcagatagggctagggccaccctccaggttacccagcatattcttgactctttgcttactagtgttggatgatgggtgatgtggaatgcttctaattatgtttctttcttttttttttttttttttttaatgtttctggtagcttctcttaaaaggtttttttttttttttgcaggtggtcctgacaaccaggttcactttgaagggtaccaggtatccaatcagtgcatggcactagtccgagatgagtgtcttctaccttgtaaggatgcccctgagcttggctatgctaaggagtccagcagtgagcagtatgttcctgatgtgttttataaggtaaagcagaacaagaatattacatatatgtagggtgatgtgagtctctttgcctcttgtggttttgcaatagtttggagtgtgacctcatccattgtattttaaagctcagctgtggatcaaggcatctgtcacattctgaagcttgttactcatgggtgtgtgtgtgtgtgtgtgtgtgtgtgtgcgcgcgtgtgcgtgtgtgagtgtgcgcgtgtgtgcgtatggcattgtggggtatagacagaaaaggaaccagacatgttgggtttgaacatgttacatcagatctcactgtgcagcctcctttgtaaagatgaggtatttgcgccattgttaagaattctgcttgctacacggacccaattttttgttgtgaggcttccaagaaaaagaacaaataatggtaggaaggaaatatcatcaaatcagacaggcttacaagcatccagcagaaacttgagtgagaagcctgcttgatgtggtcacctggagttccgatcagaattccccaggcagagcaatatttccttacgaggcttccaagtaaaagaacaaatagcaacagacaaagataacatcaacccaggtgtttacaacatctgtagaagccgatggagctttctctccacaactgctggactttgatctctttcccactgtaggccttttatatcatgggtgaatacagtaatctggaagtgacatcctgcccccaaggtcttactctgggcctgttctgttggcttcttctccctgtcacagagttggaagcaacacatcactaaataggagaactttagaaaacactttgagaaaacgtgcttggatctgaaatggggtggggcaaccccacttccaaagccagttctcagtgagctcaaatttcacaggacagtctattgataaaatgtgcattatagcttgacaggataagggtgtcattgctgctctgttacctacctgctgccctatcacctgttggtttgttttgttttgttgagtagtttggctggcctttctcttaggaatggttttactcttgattacttttggttccttgtgtacagtcttaatgttgcccagggactctcttggaccactcatgatgcctttttgtgtttgcttgttatatagctctatatatctatttgattaaaaatttttttttagaggggcagcagagtcttacaagacagtatgtagactgggctggcctcaaacttacagagatattacctcttctgagtgtagggattaaaggtgtatagcaacacacctagcattatttatatgttttgtgtgggaatgttttgctttcaagtaagtctgtactgcacgtgtacagtgcccttggaggctaactggagttacagatatgtatgaaccacctgtgtgcacttggccctgaactcaggtcttctgcgaagagtaggaagtattcttagtcattgagatatacttaatttgtttttatttttatttattctataagaataaagtttatagctgggtgtggtggtgcacgcctttaattctagcactctggaggcagaggcaggtggatttctgagttcgaggccagcctggtctacagagtgagttccaggacagccagggctacacagagaaaccctgtctcggggggtaaaaaaaaagtttatttgcttttattttctgagtatggtgttgctgcctgtatgtatgactgcacactcatgcttggttttcatggaggcaatcagagggtgttgggtcccttgggactagatgaacatggttaagaaggagtgaacctggatcctcaggaaaaccagccattacatttaactgaggagcagtctctccagtccttatttatattctctttctctttctttttttttctctctctctccccctctcccctctctcttctccctctcctctctctcttctccctctcctctcctctttcccctctccctctctctctccctctccctctcctctctccctctccctctcctctctctcctctctctctcctctctcctctctctgatgcccctaagcgcaactctgcctagggaccttcaagagtcaaggaaacaaggcctaaagaggctttgtaaggtgggctgtcaccttagagagtctattgttgagacatactccttctaacataactgcaaccattttttcttcagtctccattttgtccataaggtgaaattaagttcagattctcagattctacttcctagaagtaattatccatagctgacattaaagaatgctactaataagccaaaaagttatggttgaatcacttaaaccctgttaactcctatttacacccttgttacctctcaggaccaatcagcttaaaggttagctgaccatgctttgtctagttagccagaaatgctgtacctcttcactgcttccttttgaactttagaacctcgttttacatgtaaaaagcctgccttgaggactggactgactggtgccacaattgggtttttccttcttgtggtcctgcacttacagtattatggtgtgtgttcgataaactattcttgcttacctgagattggtgtacatatggtttgagttgaaattcccaagccaccatactctgtaggctgccaggtgaaaactgggggactgactccagaggcatagaagaaacagtgatggactggctaaggcttactaaaaacaagtcagatctgagactgctgttcctactgctatcctgcctctgcttgcctgccagcagagacagaagctctggagtctctgatgtaatagatgaaaagagcgggctggcacagtgtcactcagtgggtagtgtcttgtctactttcaccccaagcatcaggtaaacctggtgtgttgtttttcttttctttttttctttctctgtcatttttgggagattgggttttttatttgtttgtttgtttgtggtctcccctcaacccccacctccatcccgtgacagggtttctctgtgtagccctggctgtcctggtactcactctgtagaccgggctgggagctggctttgaactcacagagatcctcctgcctctgcctccccagtgtgggattaaaggtgagcaccactaccaccaagataaacctggtatgttttactcctgtaattcccaaactcaggaggtagaggaaggaagatcaaaagttcaagagctacacagaaaggtcaagactagcctgagaacacacacacacacacacacacacacacgagacagagagaggaggaggaagagaaccattgctgctgctgtcacaaggagagaaggctcagccattaaaagcatttgctgttcttgcagagaataggattagattcccagaacccacgtgatggcttataaccacctctaactcaccagtctcattgggcaaaggagcatgaagctatgcctgcctgatacctgagttaaacccaatgttcctgatgatggaggacgaactgactcccacaaagtgccctcacacttacatacaaccaagtgtgtctgactttgtcgctccagcctggatggatgacatagtcccgctggacactcgctttctgctccggcctcttctgagaacagaagggatggggcttttatcttagtgtcattgcccattcagcctagggcttccttgggtccacacaggctttattgtcttagttcataagacagtaggagtcggcatcctgtcctcctttaattcctagcaatgaaaatggtaatccaaacctatggaagttagctctttgtccatgtaacttaggatgcactctgttttaaggatctccatggtgtgattctgggcccgattctgttttgtgcaggatagttctgtgccacctgctttactactgttgcttgaactagtccactgctgctcccttgctctttcctaggagcaggactgtctttggccagggtgacccatgctcaactttgaggctgctttctcctccttggacttgtgctctgttgtcttccagaggcttttaggatgtctctagaggacctctgtgaggtcactcctaactactacttcatactttcctacatgtttaaaagtgtagtgtgttagttcaggtttcatgggtgtgaagtagcaccatgacccaggcagttcttatccaggacattcaactggtctgggtgacagctttagagtttcagtacattatcgtcatggcacaaagcatggcagtgctcagggagaggtgggttggaggatcccagagttctattctacatcttgatctgaaggcagcaaaaggagtctttgttccacactgggcaaagcttcaacataagagaccttagaacccacccccacattgacatacttcttccaacaaggccacacctcctcatagtgcactcctcatgagccaagcattcaaacatgtgatctacgcagggccattcctatttaaaccacacagtacttacgaagaagccatccttgttcatttatttatatgtatatgtgcatgtatgtggaagtcagaggacagtcagtgtgtgggagtcagttctacttacatcatgagacacccaggaattgaactcctgtatcaggactggttgccaaggtccttatcctcagaaccaccttgctagcctaaacagcaacattttctacctttgtctttaaaatgtattgaaaataggttaactttgcatcagaggtggtgttatctgtgatgcagctctttctgtcgggtgtggttttatttctgtcatcttgtgtgctggctgatattccggaacaatgtcagtcactggccaccttcatccttctctctggttgagggctgtggttggagccagaccttagtggattgctggtctctaattcataggcctcctgtcttagacgtctgtgtgttgactttatggacatgaggcaacaatttcagtcttttgttttgtttgagacagagtctttctgtgtagccctggttgtcctgaaacactgtacacaccaggctggcctcaactcacaaaagatccccctgcctctgcctcctgagtattggggtcaaaggtgcacaccacacccaggctttgccttgtcttccttccttccttccttcctttcttttttctttttttctggacttatttattttatgtatatgagtacaatgcagccctctttagacacactagagaagggcatcagatcccattacagatagtagtttgccaccatctttccagcctgtaccttttcccccttccctgttacccctccaagagtttctcaccccgtcccctctccccattcacttcctgtttaatcttaaagagcatgctgtcagggtttcatcaccatgggttttcaagtatcttttatcaaataggaaacctttttttaaacaaaacaaaacaaacaaggtctcttgtataatttttacacttaaggagacagcagtgatttccttaaccctgttactctcctgtctttgtctggtctgagaacttgcagaagagcttctctcttggttatagctccatggggttgaggtgcctgctcatcttatgtttcagagacatatcagttggagcagagagaactacagagcaaatgttggagcagtcctggtagtcctcctgtggactttgtggctgattttaaaatgcgctgtataaatgacaccaatagccaggcatggtggcgcacgcctttaatcccagcacttgggaggcagagacaggtggatttctaagtttgaggccagcctggtctacaaagtgagttccaggacagccagggctatacagagaaaccctgtctcgaaaaacaacaacaacaacaaaaatttaaaaaaaaaaagacaccaatatttacctaagtctgttgtttatcccagtgtcatctgtggttacaaacactgaaaatggtgataacagaaggacactggatagtcacagacccatgtagagtgctgttcgaccttatctgtgtagtcagattttagccacacagatagaggtacaggtagaactccatgtaaaagttaaagcagctacatagagcattattctcgtatcttgtgttttataaacatcttggtgtttatatctgtatgtgtatttttcttggactcacagggtgggagcatggagcccaagtgtgcagtggaagaggtgctgttgtttgtatcctgggcagcagggcaagagcattgggcagagactcctgatcctggccaagtagctgggagacctagtggtgcattgccccacgtgtgctgtgaggaaaacagcagagacaaatgggctagctgtgtggacagagacataccagctagctgtgtagacagagacatatgggctagctgtgtggacagaaagtgactccctgaggagtccagctgttgctgcttgttcccaggacagtcagatgtgagggagggtctaggagttgttttctttccctcagctgcctgcactccacacaaggatcggtggaaactggctgaactcactcattgtgatcacattgtttctgtagagaaattggaattagacaattaaagataacaacttaaaaaaaatagatttactttaatttgtgtgtgaccaaatcagaatatatttcattagttgagtgctgattgctacttcagttatttctgttgttgttacaactggctacatcttgcaacttcatattagaattgtcctgcatgagatttttcagttttgacagatgtcagcttgctccctaaaattttgttcacaaaattgtcagtctttaaaagtgggaaggggtctacacaaaattctaggaccagctagagccatgtagtaagatgcagtctctacattcaagtggggaacttgaatggattttagaatttgtgtgtttttgtaatgtatgtgtgtggaagggtatgtgtacagccatataccccccgtggttgggggcttgaggtcaacattatgtctgtttccttgtcattcttgattcttgtcattctttgagacagggtctctcactgatgtagagctcgccagtgtagtcagagtagccagccctgatccccggcagtgctcttgcctctgtctcatcagtgctaggattgcaggcttgtgccacctggctttttaataggtacttggatctgaattcatcatggcaaactattttctcagcgtcctgctattcatttctctccttcctttctctctctctctctctctctctctctctctctctctctctctagttttccatgccaaggtttcttgtgtgtttctttttataattagaaacaatgtcagtacattagtttcttctggtgcactggtggcccacatgggtagggtggacaaagtctttaacacttgaggatctttccatcagttgtgagaatgacacctctcctttcctaccccataggacccggggcagaaagccctctaggtttgtaccctatagagtctatagcataaagctttcaggatttctggccatagtttacagcttggtggatttgagggaactacttatgctaacatatcagtgaagtgtctttagcaggagcctggcattttgttgttgtgatgtggtggttttgtttcatacttaaaaatgtcaagctaggtatggtggtaaaagccttttaatgtcagcactctgcaggttgaggtacacctttgtgaggtccttctgtagccaactagggctacagaataagacactgtgtcaaaacaacaaaaaggttgttttggccgggcgtggtggcgcatgcctttaatcccagcacttgggaggcagaggcaggcggatttctgagttagaggccagcctggtctacagagtgagttccaggacagccagggctacacagagaaaccctgtttcgaaaaaccaaaaaaaaaaaaaaaaaaaaaaaaaaggttgttttgtcttttcggtagcaatctctttcaagggaactaagccagcaagtctgagagctcagccaagggatcatcttaaaatgctgtaggtttgaactgggctttcccataattccccatagttcccactttgcaccctagcttcaataatgtgagaggattcaagtgtgtgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggaaaggagagagagagggagagagggagagggaggagaggagaggagagggggagggagagagaggagagagagagagcgagtgagagcgcacgcagaagtgagaggagaggagagagagagagagcatatgctagctcagatgtctagaaagcttgagagaaggctgaagaatctaaataaatgtgtatcaccaccagtaacaggaggccataggtcgtgaagttaccaggctggctggtcagaggagccagccgaagctgaggttgtactctttgttgttgttgttgtttaaagatttatttatttgtttgttcatttatttaatgtgcatcagtgttctgcctgcaggtatgtctgtatgaggttatcagagcacctggaagtggagttatagacagtgaactgtcatgtagtagctgggaattgaacccaggacccctagaagagtagccaatactcttaatcaatgagccttgtctccagccccaatattgtgtctttgaagcagttgtgatccaaagtaaaaccagcagagagtggctgtatgcaaaatggccctcaaaatctcattagagggttttgtttatacactactagaagtcatgtgagaagcgagtgcacactggtgggactagagagctgtgaggagcactactcacataaggagcaccactcacaagggtgtcagacaccagagacaggtcagcaagggaggtcagaggtggagatgtgtggacttacgatctatgcaggatgtgccagggctgatagagcagcaggccgcaggatcccctggacataacctttaaggagcatgctcattagatagcaccagactttcctgagataacatatgggacatttttcctaaaataaaaccacacatctgcttactagaaaacccgaaatattaaatgtacaggaagtcttcatacagctcccattacatgttccttccgttcctttgccccatgcacttgtagcaactgtaaccacagccaggctgccctccttcttacagagactgtttgctgggcacttgggcctgaaaccctcagcaagtagtcataactcgactcttactttcagagttggatgatggtccttgtaagggcaggcaggcaatcagagctgagactataaacatgatgaggtaagctaaggccaagcagagtcacttctagggggacgtatttgcatccagagaggcagtcttttcagtatggttgttggtggacatgtcaggccacagaaaaagatatggaaggtagtttgggattattcctattagatagaatcatttagaagaggaagcttagcaggcaagtatcagattcaggaggtcttaatgatgggggccagagcagaggggtgggacacaggactggtgccagttacaagcttcactggataggttgtgacaatacagttgagagagaggtctctgttgtagaacgtctatcctttggtccactgtggagttagggagcttagtagatgctgcagataacaccaaactttccataataattcagaggcatttaagagacccagtgaggagcaggaacaagccagcctttgggcaagcatgggttttctggaatagtgtactgggtctgtgtggaaggacggggagaccaggcggcaccatttgcatctcctggttttgaagacaaggtgtttctgtataaccagaagcttaggatcctcttgcctcggcctcctgtgtggtagatgtgcgctgccgtgcccagctgacagagagttttgaagctgctctgtactggcatagtagctagttgtcagctgtcggtaaggctgagaaaagctcaggcaagaagaacaacgaataatgccaagttcaaatgtgtctgcataggaagtacagattatagttcccagacacaggtgagagaagttgggactgtcaggaaaaccaaaggagcatattgggcaaatctgcgggactgccctgacagcgctggttgtgaagggacccaaaggtggtgctctctggaaggagtgatgctgtgagtgtgctgatgagtgacttgggctgcatcattccttcacagggagaagagagaacactgctgacaaccatgagctccattctaaggttgggtgctgtatactccacagtggaacccacatgagcaatcctcttataactagttcctcatgcacactactacttaaatcttgagatgaaattttcagttaaatgagtcctgtattctccaaaactttcctcactgttatatacactggctctactatctgctacttactgggctagtcagtcacagcagcctatcatttctcatgcactggggcaaggatagtgcctgtgacacgtgtagttgggagtgggaggggcagcgagaccaggacatgcagaatctatctaacctggcaggtgcctgagaagcaccatgtgctgcttctgtctgtctctggcaggcgtcctgcaggtgtgctgtgagtggagctcccgggcccactgctcttgtgctctgagtgcctctcagatcctgctgctagttacctgtcctaccagttgttaatggagcagcagcagcaggctaagggttcatccatctatctaacgcagggggataccagctggtcagtgagtcactcaccaagccaaacctgtgttggccaggataacaaggacatcggtatctatgtttctatggcaccatgacaccagtgcttgcagatgtggactgcagtaggcagtgaggtgtgggggaccatgacttctcattctcccttgtctcgctcaggtgtggataggtaaactgctggcactatggcagctgtcaaatttagaatgaagatgtctaccttccagtgtgttctgcctgacatttgctaaggcccataaaaagtaattgcctttaaaattgtgtttgggactagggattggctggcgagtgaaggcgtgggggcggggtgtgcagatacaagttaccctgttttcccctagggaaaaatgggagctacaacacctttatttttgtggtgagcagaaaaggtacagttgggtagttaagtttgaacgagaatagcacaaagaaagggtgggggtttttaacaagaaaattccctggaggggaagattaaagtgaacaggtgctggaaaaatgtttctgcatattagagcttaattagatttgaagatgaattccagatgggctaattatgtgtgagttgttgcaggttatttcttgtaggggcaagcatgtatttttggaaatggtgatttagtttgattgggtttgattcctgcctccttccctgtctccatcaagaaactgtctctttagaggcccaagacccccctcagtaggcccacatctttgggactattgtcagacatagcagaagcacagaacatggagaccatcctgaccttgtgatcacatgtgtagggaaagacaggtgaccctttcccagatcaggggacttcatggcaggaagcaggcagagcctggtgggtattggcggagcatgagatctccttgtttgacatggagaaggaactactctcacacttgtcaaataggtgctgcatgggttgatacagggtgtgtgtgtgtgtgtgtgtgtgtgtgtgtgtgtgcgtgcgtgcgtgtgtgcgcgtgtgtgtacgtgtgcgcgcacttaggccagaagaggacaagtctttgttaaaacctctgacctctgtaggaaacaggactagtttggggccagcttaacttgggaacagcttgcaatgattgtctcaaaagatagcctggctctatgctgtccctgaaaggtgtggatatgctgggagggaccctatggcataccttgggattatatgtttagcaaacagtttgcggctaagggcttccataaacaaatttttatgtaaggaactataattagaaattatcgacacatgtatgtacagcacaatgaatgatattaaatgatgatttagatagaaaatataactccttgtgggattttttttttttttttttttttccattttttattaggtatttagctcatttacatttccaaagctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgggattgtgttaccttactcaggatgatgctctccaggtccatccatttggctaggaatttcataaattccttgtgggatcttttaataaagagcattagttcttaggaatttatttctagagctctgtttgaactcagcatgtttgacataaatcacatctaattgtcattttatgattaatgaacatatgttggccatttttacccataattaaactttatgtcttgtgtatctgacaaagcaaagcaagtttagaatttgacatattggtggtttttgtgtgtgtgtatacacttttttgtacacgtctttgttttgtatatgtactaagtttttataaagtacagttgtcagaggtgtaagagtttttaagaaagaggctgaatgactgtggaagaacctgcaggctgttgcagccatctgtggccaggtcatggtggggtgggggtgagggtgcttcctgtgttctcccttgagatgtcctcccaagaacaaacaggacaggttgttctctaagatcaaggccataatacagagttctaaaaaaacaatgcagggaaataatttcaaaaatatgtagccaggcagtggtggcgcacgcctttaatcccagtacttgggaggcagagacaggcgaacttctgagttcgaggccagcctggtctacagagttgagttccaggacagccaaggctatacaaagaaacccagtctcaagaaaaaaaaatgtacattttgtttggagacaggtctctatatattcttggacctcactagtgtagtccaagctggccttgaactcacagagatcttcttacttggtacaccaagtgctgcatttaaaggcatatgccatcacacctgcccaaatcatagtattttaagaaaaccgggcttagagatgtgcacctgtaattccagccctggcaagacagagataggttgccacaagttcaatgccaacatggtcctcatagaaagttcctgggatgctgttttgaaaataaatgaatgaatgaatgaatgaatgaatgaatgaatgaatgaatgaataaagaaagaaagaaagtaagaaagtaagaaagtaagtagaagctggtgtgaaagcatactgtggcttcaccttctctcataggctgacttgtgtttgcttgtttcaggacatagacaagtttggcaatgagatcacccagctggcccgtcccctgcctgtggagtatctcatcatagatgtaagtactcctttgtattcaaactcacaggcaggctggtaccatagtccccatgaaggtcagaactcctagatgatagccacttgaggaagggagccagggaggtttgagtcacgtgctgctgcaaggattgtttcttgcaagtcccaagtttccagaaactttacagtttaagtaacctatggattaacttttctcgggctaaagtataagcaaaagatacctacctccagttccaccctatggcctcggggaggcagtgagtcctggggctctgatattcctatatatctaggcctggctggtagctgcccactgcccaggaggtacaaatgttgctctgcctggcacagcagtagtactcttgggggccacttcctcaagagtcctgggacatagctgtaactatgtgtctgtgaatagggagggccagcgttgcttctgaacaaagttctaggaagtaagaagagctggctctgctgtatcttctcagaatgtcacaggagtttcacggtcacagagacacattcataccgttggccacagggcagtgagtacaggatgaagcctatgacttcttagcagctggagtatcactgcctgccgtggttctgtccagagggttggcggtggctacgtcagtgctgtgccagaatatctacttaggctgcatttggacttaggatgggtatgtgattcaggcaataaaatagcattgcatttggagccgtgtgttcccctgagcctagcgcactgaagctccatttcagtcgacagttcctgagagcatctttattagctaggccataaggcatctgttactctcttacctggggtgtgattgaaaagaaagcgaattgatggatgagccggcgtgatttagaatgggcttcgtgagcttcccaagcttcaccttagcagctcctccagcagcactgggcagccagagaacattctaacctagagaaccacattctctgtctgagaaaatgaggtctaggagagccttagatcagctgttagctctttctctggtaccagagattgtgtagatcaggactatggctgtctgcctctccctcccccaagcccacttttttttttttttaaagatttatttatttattatatgtaagtagtacactgtagctgccctcagatactccagaagagggcatcagattttgttagggatggttgtgagccaccatgtggttgctgggatttgaactcaggaccttctgaagagcagtctgtgctcttaaccactgagccatctcgccagccttccaagcccactttttaggcagggtcatgctgcatagccctcactggcctgtacctcttcagggcttcagttagagatgttagccataatgtccagcatatctgctgggggtttttttgttgtttttttttgtttttttttttattaggtattttcctcgtttacattttcaatgctatcccaaaggtcccccatacccacccccccaatcccctacccacccactccccnnnnnnnnnnnnnnnnnnnnacccacccactccccctttttggccctggcgttcccctgtactggggcatataaagtttgcaagtccaatgggcctctctttgcagtgatggccgactagaccatcttttgatacatatgcagctaaagacaagagctcctgggtactggttagttcatattgttgttccacctatagggttgcagatccctttagctccttgggtaatttctctagctcctccattgggggccgtgagactctgctgggtttttgttggtgattttgtttgcttatttgttctttggggggacattgttgttttgtttttgagacaggatctcagctatctagccctggctggcctcaaattcatagagatctgcctgttcctgcctccttaattttgggattaatggcataagtcacttcaccctgaatatctgctgctcttacattgagttgagagtaggatagttttctcactgcagtttttgctgagtcatccccaaacccggggaagtctgagcaaggctgggcactgggtcaactcagcaatcccctggagctctgttggtgctgctcccaagcctctttcaaggttaaaagagggaatgccagccccttagaggctgaatgcagagcctgcatgcatgacacctgtcattgctatctgagttttcattattctgaggtaggtgttcctttagtcgccctgctctcctgctttggcctcgtgagtgactgcactgcaggtgtgaaccacagtaactataatataatataatataatataatataatataatataatataatatgttctttagttaccctgctactcatgtttgtgacttcccagaagaagagacctgagtaccctaggctgtcgctcacagcgtggttatactccctgtctagtgtcacacatggctggggctgtgctgtcagtccatactcagtgcctgctgggagacactccaggcatctttcttacatgccacaagtccacatacttggcctcgtggccacagatacttttctgtgaagggccgtgtatctctgatgcagctgatggttcagcttgtccttatagagtgctgacattggcagagctaaatccagaaatagcctgctgcctttgctggtgtagaaaacagatcacagcgaccagagcaacattttcattcttttagaaatcgccccacaggagctctatatctatatctggaaggggtctgacctgatgctgctaatgtcacgtgcagagagaagtatgccagacagaaatgttagtaacttgcacttgggtgctcttgtggggaagaggcctttgccataggaatagtctgtgtctgtattgattcctccatgttcaccagtggccctgaggcttctattgattacaggttaggtttaaatgccctctgcttttagagtcaaaggaaagatttgctcaccttccctagaggcttgactttgtttcacttaccttggaggaaaacaactgccctgcttgtaaaactgggggtctcgtggagtggtctcttggagattctggagggcacacatacttctcaggtccgtactggctgactccacacttgcctccaagcacagcatggagaattcggtgcctttagtctgcctcttgccttttggtgttctattcctttctgcagtaccctggtttgaccagatgagctggtcatatacatctgtagggttgcggttaggtgtcgtgcagccgctgaatagcctggagctgctcacatgtgagcccagtaagatacacacatttttactgggtggtagtcacgcatacctttattccctgtacttgggaagcagataggcagatctgtgcgttcaaggccagcctgatctatagagttgaattcccagtctctttcaacacagcttataggctctgattggtgcctagcctcttgcacaggcaggagtgtacattctgttcaggcacagtgtaacagtctggtttgttgttgttgttctttagatcacaaccaccttccccaaggatccagtttacactttttctatttctcaaaatccgtttcctatcgaaaaccgggatgtactgggtgaaacacaggtaagctctttgtcttagagacaaaatttaaagaaatttctaatttttatctagcattggtctaatttttccaaagagtgccatttccaccctcccttgattctttatctgacaagtcccattaggccctgttcacttagatgcccctttttactaggcaatagataactctgcttaagtcctctgtagcccatgggccaggcttgtcagaaatccatcctcacttgtcttcttgatctttccaatattattgatcacttttgttgtctgccaagcttcctctggtttgtatgttaatgtctcatacagtagcgatgcagatggtcttggttcctgttggtcttccctactctgctgtgtcttgggcttgtagggtccatcaagcttctctgggtcccacgtggcctggtatatggtgctgacgggctggctctgtttttatatctcctaccccaacctttgtgctagccgcacatctaaccagacctgagtttccatgactgcccagtacaaacagtgtatatacttaattgttttggggattgcttggtaccagtatttaaggatatggttggctaaggaatagctctaatacttttggtgtggttcctcacagcctcacatctagagctgttagatgcttgagggtgcaggatggtgccagttacttggcagaacttggcatacccacggtggtcctctcagatgtgtctggttgtttaaaagctgcccttaccaggtgtgatggtgtatgcctttaattcaagcactcaggagacagaggcagacatctctgatttcaaggccagcctggtacagacagctagggtaggtaaggggtgattcctgtctacctgagcaatgccttgaatgtgaacccgcttacatacctgggtcagttgtgcttaggtctcccctgggcaggaaagtcactttagccccaggctctctgcacctctcctgcagttccttggtgattactgagacaggatcgtgcatctgtgttgtttactatgtgtttggttagtaagaggcagcactctttcttgatttaatgctaagggtttgtgattaaactttttttttccttccttttaactcattccttaggacttccatagtttggccacctacttgtcccagaatacctcatccgtgttcttggataccatttccgacttccatctcctgctgtttctggtcaccaatgaagtcatgccgctgcaggtatcagctctgctgcccttttctctctttcctcagatcctaaggacaggtgtgaagctcggtgtcaagagatagctaccctatgcacagcatgtgagaatgtgccctagggaccccagagctgagactgtccctgttgcatagcctcagagccaatgtctctgcagttttctgaccttatgaccttccactctcaccctatggcccagcacggttaatggcctgagcccagaaggtttgccagcttccaggtcctgcacacaccattgtgcacttggcattttagagacaccataagggagagtggatgtgaatggtttgcagatggtaggtgctctctgaacagagcagggcagcaggtcccaccaggaagcctgtgtgcatgccttgggcactcacagtttgagcgtcggtcctgtttgcatggtctttctttgcttgagatccacagaaatgcaaagaagatgggaacaagtcacctgaacttcatcacactgacaccacctccttccttaagggtgactagatagagctgtccttcccaagatatttcttttatttgtttgtttattatatgtaagtacactatacctgccttcagacacaccagaagagggcatcagatctcattatggatggttgtgagccaccatgtggttgctgggatttgaactcaggacctctggaagagcagtcagtgctcttacccactgagccatctctccagcccccaggatatttctatctagcagcttgtaattgtccttttatcttgctgggagcacaagggtgtagtattggatgccgtgtctaccatgcagtgtgatgctctctacatgaggaactgatttttctggttgtgttcagccctctggattcaaggtcagccctgtcatctgagtacacagcatcttgtattttgcagtgacagcttctgagattctttttcaattttctttgaaagatgtattttgaaaggcatatttctgagttcaaggccagcctggtctacagagtgagttccaggacagccagggctacacagagaaaccctgtctcgaaaaatcaaaagaaaaaaaaaatagtaagagtgttttaccctcaatcagagcaaaatgcaaccctccttgtggcttcttgcaggacagtatcagcctgctgctagaagccgtgaggaccagaaatgaggagctagcacagacatggaaaaagtctgaacagtgggccaccattgagcagttatgcagtaagtgttctcgattcccttccaccaagggtcatagtcaaaatatagggcatgagctctgtcatttaaatactggccctctggcccaggtgcctccttggagtgcttgggcaaagggacagacatgggtggctgctttagctggatttactaacagtttgcaaaagaagatgtaggaatatactatcattcttcaaggacatggcagggaaagcatgagacaccactgcatgctcatcagagtgctaaaatgaaaaaaaccaaaaccaaacgaacctgacagtatcaagcactgtggagagcatggggcaggttggacttgaactctacttgggagtgggtgtggtatttgaactgggacgtagccgtctcaatgttgaatctttaccagggtaaaggaagatacaaagaaagctcccagagtttgtgtgagagtgaatctatgcagatgctcactacggggtgtgaggttcccgcagaaatacctagcaacagggagcagacttcaagtgcaagtaggaaggtgtttgctgactggagccagaacacttgatgtgctgacagtttgggcttacgcagtaggggctttgagccaccctgccctgccatctggctctaaggagatgtctttttctgtgcaggcatgacgtgttctcactttaccctacaggcaccgttggtgtgcagctcccaggcctccacgagtttggtgcagtcgggggctctgcacgcgctgctacctctgccatgtgggcctgtcagcactgcaccttcatgaaccaacctggcacaggccactgcgagatgtgcagcctcccccggacctagggctctgggcctctgctgcatgggactgggccagcccagccctctgaagtctggagcgccacatgttccctataaggcctgaagcccacagccctgaaacagtggggccagctgccctggtattccagataccctgaagcgtctccgtgcagatcttgaagagaaagaacctcggctgctgtgctggggttgaacagagcctcccacctgggaaggcagagcagacctgcccaagagctccccacacgcctcacgtgttggagggactgaacacgtccagccaatcacctgaaattggggtgtacagagagggtgctgctgtcacccagctatctctccttcctctatgatctttgttttctgccttcccaccttctcccccagtgttcggatgaatgttcctggctgtctctgttcccttgctgtggggctgtgtccctcctttgggagcatgtgtggctagggtgtggcagcctttgtctgacatgcagtatagtaggtccctgacctttacttgcctgaaatcagcagttatcaataattcccacccaggaaacttttatttattgttttttaaagataaaactgcacagatgggagtgagagatttacctctgctccttcctccttcagtgcagcccctcttgggtggtttattgggcaggaggccaccatcatttctcctcagaagcaaacctcagtgcctgagactttcctgccacgctgcagacagtggcagttggtagcatgggtggttcatcagagcagtggtggctcttgcctggcagtcagccccttcaagtctggacagccctggagttctggtcccctctcctagcactgtacctttacccagcgagtccccacactgtggtcttcttgcacagtgtgtggcagttgagaaagcctagaaaaggtgcccatttgaccactgtgaggcaaatagaaacagtccctaagggtcctatgtggctgtgttgtgacagcccttacccaggtaagagatggatgtcgtgatgcctcgttgccttaatgagagctgagtcagctgtccttcaccctgggaaagtccatgccagctgtggactgctgggagccatgtttgtcaccttagtagaatgcaccaatgttcccttctgcatctctggccctgtggacagaacacttattgctaggttatctatcgtgtggcagggctggccagcaccgttgggtctcacctggcatgagatctgaagctaaagccctgggactgtggagccattgggcttggtttggtattgacagggtcatcctgaggggttagcagtggtagagagcaaggcaagtgatctctccagctacctgccagcagtagagagagagagagagagtgctgagggctggtagtgtctctggctagggcttcacctttcggttttttgttttttgttttttctggtccctgagtctggcatttctgtctgtgacttagctatgtttctgatgccaatcacactagcaccattacatgctgggcaggtgctgggcagcacagacgctggagacctgtttgccactgcttgtcccccattcatctttgtctacaaagttaattacgttctcatgttctggcatccacataattcttgttttctctgacttatagctaaagaaatttttgtggtttctctgcttatggttttgagttactctttgttcagtaatgcactttattttattgtccaaagagagtcaagctaaagctaccaccttggggtgagccctacagaaggttcagacccgggcagctcagctacctccttctacatggaggtggccctggtcccacctctaatccctactgtcatcaggcactacagcccaaaaagaggtgcttgtgagcacacccacccaagtgaacccagtggctgccatggtcctcttcaggctcagagatgggtctagccctggccttgctctgatcagcctgctcctggggcatgggtgctcccgcttctgctctgcttgggctcacaggtatgcactggctgggtgtggatgagtatttttctgaccccagccctgcagtggaacctaataaaagcacctgaagcgattgtcctgctcccagtgcattgttcctgtgcccagaaccacagtccaccggtgtggcatggatgtgttgccttgtaaggacagtcctgagtgttagaacctggtgtgcagaagataaactgacgatgcttccaaccctggaggtgactccgatgctgcaaagaattcatctcccacttgtttccactcaaggtgtcttcagagcagcctggggcttgggctcagatctgtttcagagaccactcagaaatgataaaataggtccaggcttcacccttgggttaaagttggtttttgtttttttgttttcacttaatttacagctgggcatagtggtctgtgcctttattcccagtactctggaagcacagacaggctacaactataaagcctaagaaataaatatttggggctggggggtgtccagttccagacagagctttttgttttttgttttgttttgttttcataagcgttgctgttgtagaactagctttgtagaccagcctggccttgaactcagatccacctgcctctgcctcctgagtgctgggattaaaggtgtataccaccacacagcttttatttatttaatcgtatgcttttgtacacataaataccttagtaaaagatgtaggagcccctggagctgttgggggttgtgagcttccctatgtggatgctgggaatcaaacttgggtcttctgcaagtacagcgtgtgctcttacggctgagccgtctctccagccccaggatgttgttctgacatctacactagggttacactatgctctctaagttcacaggacgttttgtgcctggttgtgaccccacacacctttgtagatttgtccgctgtaattttcagatgaacgttcttttaagagtcaaggttgcctgcgctggctccgaactcaagtattcctgccttcagccctccgagtagctgccacttcagaagcataggcagtggtgtctagtttctgatgagtgctctggaagagtagtatttcatcttgtacttggagcctcattccagggtaggattctccgcctgctccctcagggagccccaagaagagctgtcattgaagaaaatgtggtttcccttagacccagctcattagggttttcagcatcctctgctgtagaatcacatcctgccgcgttcatgagtggagcaaaggctcttctggatggctggcctgaagcacctttttccctatcaagggactgaatggtgtgctgtgccaccctactcctgaaaccccgtgctatacgggtggtgctctcaagtgctgtcacaaaacggtgccagggcaagtgctgcatacaagccttgcaccagagcaacctctgctcaacaggtaggtgatccgaggcaagggccctgacgcgggccccagtgaacttgcaggactgcattatttggctaccctctggctttgtgcctcccgttgtggctctttgctaagccacggtgtttggggggcgttcccgccctctagcggaccgtagagcaactgtccccgcccctgcagcaggctccggccacgcctccgcagcggccgctttacggcggaggccgcgccgcgccgtgggcggccgtaaagcctggaggcggcaccgcccctccgggctgagctctggcccggcgcccgcaggatggcgggcgcttcctcgcgcgtgcactacctgtcggacttctgctgcccgctcggaggccgagcggcggggaagccgtttgtgctgcggcatgaggctgaggtctttctgtccaccggacgcgagttcgtctatgtgtatgaccaggagggcgggctgctgacggtgagcggagggcgggagggcgggcgggcggcgccgttccgaggtgagccggggccgcgtgtgccctcgcctgacctcgctctcctggcgcccaggcggtgtaccagtttcccgaccaggtatggcacctgcagctcctggccatccgcagggcactctacgtcctgtgtgcccggactggcatctactgcctgtcgttggactcgctggacaggtgagggggcgtggccccacgcggccggccagtgacaagtcgggtccccagggaggccggctttcatgtcctcctagttgtgagaggtttgtcccagtagtagtccctttgacggccactgacaacacactggggtaggaagcagaggactgcggtctaggccgcccattcccgctctctagtacctgtgcatatgcaggcgtggcagttgtgtctgcttttgtgaagttcttagctgttgaggctcaggtagtgaagtctgcaaccaggagcaccgctatcactgccctccggtgcctggcaagacctcttggaagtgggtctcagaagacggtgtctctggcaagcagtgagtggcaaaagctcgtgtcccttggcttgtgctggaagaactcaccgtgcacagcccaggcagccttgggaatagttcccaagctgcctcgatctgcagagctatgtttctggctgatcctgtgtcaagcgtgtgtgtgtgtgtgtgtgtgtgtgtgtgtgtgagagagagagagagagagagagagagagacctacctgctgaatggcctgtgatgtctcctgcctagcctactcagagcaagtcaggttactgctgagcacggtgtgagtctaccccacccaatactgactatgcttccattgttcctgaaggtctgggagccaggcctgtgaggacaaagaggaagcggctcccccctaccctgtgatccatgtggacccggatgcgtgtgtcctccctgacgctgccctctgtgccttcaccgtgctggatgatatgctggtcaccctggcacagggccccacccagtggaagatgcagctgtttgagcgtccctgtgcaggggaggagcctctgcccagaggccagattggtgaggtggagttgtccacttgcaccccaccaggtggggtgccagagaagcctgcagccccccgcttcctgcccgtgctgtgctgcgtgttcccaccagactccagggcacctcatggtcacccccagggctgtgggtgcttcacgctggaggaggctctctttggtctactctttggagtcgatgccaccctcctgcagtcccctgtgatcctctgcggtctccctgatggccagctttgttgtgtggtcctgaaggccttggttacttctgggttagcccctggtgacccaaaggtcctggtcaagatcctccaccacctagaggagcctgtgatcttcattggggctttgagggcagagccacacgaggaggaagcagcaggagagctgctgcctggccagcatgaacactctgactgcctagtagcccttggtcaccagggccggacactggccatcaaggccagctggagtgagtcagggaatctggtgccggagctgcgtgagtattgcctcccagggcctgtgctctgtgctgcctgtgacagggatggccacgtgtaccacagcactccctcagacctctgtgtggtagacttgactcggagagacagtccttggaaccctgagaagccagacggggccataggaggtctaccctctgtgctgtgcccagccagcttgaacatctgcagcgccctggctctgtgtgtgacagcaagggcacctacaggtatgagctgccattcgtcatcatagaggcgcaggacaggctcctccctgacggtctcttccctcagctgtccttcttccttgcctttttgtttggtgagacttttgctaattcagcaggtatgggccttcctcatcaggctcatcacagaccagaagttcactcactcctgtcttggggtcaaggacctttgtatgtgtgtcctccctggaacacggctgtggcccctcagttgggcgggcgccacaagcatacggcttgtggggttggtttaagagcatctcccacagcagctttcaaatcgggtcaggccaaacccccacatgtcctctgagagctcaaggagcctgctttagctgctgtgtggcctgtttatgagccattcagagggtgtctcgaagctctctaaggaagccttagctaggtttgcctgactctggcatgagaggaagacatctctcccctcccccagtgtcttcccattaagatcagctaagagtatattaaagcctgctacagaaaacatttaacaagagaaaaaaaaaaaaaaaaaaaacgcttagaaggaaagacccaaaccacttcaggtgaggggccgtagcctaagaccaggatacctatgaactgacttccagctactaacctgcccacttcggggtccatgttaagagctgtgttgggggatggggaagcgagcagacccttggcaggggcagggcaggaggacatggtagagatgttagagattgaagcaagcagaactcagcctctagggcacttttctttagaaggctcagcagccttgctctgttaaaggctgtgacacatttgaataattgggcaccatacagtgtcctcctctggcccctctttgttctatctgtgtggaccagttgccaccatggcatcacatctgtggtacatcatcttgtgtaggcacttcaaaatgtgtatagagatcagtggtccccatctgtgcagatccccagtacgggcttcccagacatccccttattgccttcctcgggcactgcctgggtcctctgccaaccctttttctggagcccagagtgaacagcactgagtgctccagatttatgacctgaccggccctgcgtgtgtccgtcatcaggtagcaccgagctcctcgccctgtcttctaaaggacgcctgatcacctgcagtctggacttgaactctgaggcgcctgtgcctgccaaaatggccatggcaaatgcaggccagaaaattaaggagctgctcttggacatcggtgatgtctctgaaaggtgagctgcagtgtctggcacaagtacagcttgtgccctgtccttaaaggttagcattctgtgtggagctgacccaggctagggaggttttggttaacaaccatctatgcggctgcctctgcctctgtctccatcagggacaaaaaaagaaatctacacacaaatcctcaaaagacaagagacccctctcccctctgacaggactccggaatcttctaacaccaatcccttgcctgcttctgtggactctcagaggccagtgggaccctgctctcagcagagcttccagcaccagacccagggagcacatctttccctagcctgtccccccagccaccttcagtgctagtccctcgtgttcttcctgactttgggttttatggccttgtgacttgaggatattcccacaaagcctaacacctactgtcactgtggagcggagcgttgcaaaaggaaaagaggcccgattgggacatgtgaggtgacctatggggctagcccatccctaggcgtcaagggccggttcagcacctccatccttccctgccttgtagagccaagagtgaggatcaggtcaaaggatttcacagtcagggcaggcagagaaagatgtcctccttcggcctgggagctgcttgcatcctcagagagagagctgatacttgaaccatgatctggttccttcctccccagggagtctgcagccatggctcctaccctcggctgtgagctccttctcctgggtgccatgactgtcctttgcagggtgtcctttctgaagaaagctgttgaccaacgcaacaaggccatcacaagtctcaacgaggccatgaacgtgagctgtgccctgctgtcccatccagagggcgatcggcccatcgcgtgcaccatcaccacctcctggagccgcctggagctgcgagacatgctgatggccacctgcacactagagaacagcagcagcttcagcctggaccagggctggaccttgtgtattcaggtgctgactagttcctctgccttagacctggatgggactggttcagctttcacctacaccattccagtggacagactgggtccaggcagccggcgggaagtgacgttgcccctgggccctagtgagagtggtgtgctcgacctgcctgtgaccatgtcctgctggctcttctacagcctcagggaggtggtgggtgcggccctggccccctcagaccctctagaggccccctacttggagcagttccctctcagccttcctaagcaagagggcgtctgcctgcccctgtgcaagcgcacagtggacatgctgcagtgcctgcgcttcgccggcgcagccacacaccctgcacaggccccctgtatgcctggccctgcctgtgagcctgtggaaactttcctgaagacctgccaagcccctggcagcgagcctactggcgctgcctccctacgggccaagtacctgcctccatccacagcctccatcagggtgtctgcaggccttctcagagctgccctggaagacagtcactcaggttggtggcacggctggcctcgctttggcttcagggccctacagcctgtagaagtagggggtccctttctcttcctgtggcttctgtgagtcccactgcacccagaccactgttggatcttgtgttgggttgccctgtctccatcctttgtgtgtttcttaaaaactgaggtggcacagcctaggcagaggtagatgtcaccagagagcagcttggtgagttctcacacacagtgcaccttggagtctccagaccaaaagctgttctgtctgggcctggcttttgctctcactgtgtgaagtcatttgtattgttttgggctgcatctgtggcagaagtgtcctggttgtcagtacctctgtcctggagagagctgcagcaatcttgcgcagcatttcttgtgtgtgccccgtagtgcagctgggactgcactgtcgtgtggctcataggactacctgagtccctggttcacgagttcctgacagtccctattcctccctgcctcttgcgtaacttgcctagcttcctacttgtacaagggctgtgagcatttgagacacttaggtggcactggaaaagaatcctttggcggaagccgcacaggtgcctcagctccagcaggcgcctctctcttgcaggtttccacctgtgcagcgccaccctgcggtggctccttgccgagaacgctgctgtggatgttgtgcgggcccagacactgtcttccatccagggaatagccccagatggaactgatgtcaacctcaccgtccatgaggcaagcaggggccacttgtctgttcttggggagacggacgtcagggctcatggtcctcagtgaagagttactttaactggcctgtcagtctcgttgagattgtgtccctgggagaagcagccctgtcaactctgtctgtcgtgggttcccgttcttgtgcactgctagggttgcagtggacagtgaatgcagaaacctcccaagctggtaacaggtcactgttggaccaccaaaggacgatgtgcccctgtcaagtgagacagcccatcccccgcatgcacacacgcacacaccagagctttacatttgcctgtcagagactcttggaacagagctgtgggcctctaccccagagcgcaggctgtgtcctccaaactccttagccccactgtccactatacttccccttcaagccaggctgtagccagcttctaacccagacaccttcctaggccaagtataggaactggcagtagttacggttgatggacagcctctgtgctcgcagccacacggagaaacccttggttgcccaggcctttctacagaccccacgttctgggtcttatgtcgctgtgtggagagaaagccatggctacccagcctgtagttagcacaggaaggacctcccagaaggggctgagatgcccacagacgggcttgtcagctccttgtgtgaggaccttacttcctgtcatggagccaagtatagcttgatgtggctcagaatgaggtgggtcctacaggattggcctgtcatcctgatactgttgtcccctgccggtgggtttctctccattgtttgtacggtctgcttacctttacagtgtaaaggacagcccagaccgtgctgcggctactcaaggcctctgtgttgcaggtagctgtgacggatttgagccctgcaggccccattcaggctgtggagatccaagtggagagctcctctctggccaacatgtgtagggcgcaccatgccatcatcagacgaatacaggtacctcagccacaggggtaggggaggctctgaaggcagtaagcccctatctgggtttccgctgtggacccacacagctgtgggcaacaggatataatgccccgtgagccctcccagcaaacaagatgcccctccagatgtcctgtcagcccctgtgaaacgttcagaaatgtctgagtccatatgtctgataagtttgtagtccttgtgtccctcccatctgggtctgagccctgggaatggattttagaccagtgtccctgagttactaggagggaacagctaaggaggccactatcatggggaagttacatgagcgctgtgtctctggcctactcagatgaagagcttannnnnnnnnnnnnnnnnnnnnnnnnnnnnnnnnnnnnnnnnnnnnnnnnngttcctcaggtggctgtccagtatcagctatcacctgcttgtgactggtgtgacccagccccaagcaaggtttgcagctggttcttggctataacaccccccctacacacacacacacacacacacacacacacacacacacacacacaccccgctgacctcagcttggaacttgacccctaagaatcgggagccgaccactgacaactcagtgaatgggagaccaggttggaggtgctagtggttttaaagctggaaggccagcccttgtgttctctcctggcacgtgactcccagttgtgagatcactccatgaagtgagtgacaggcttcgtgcgtcccgtgtaaatgccctgtaaggttcagtctccaaggtgtgggatagcaggggagtcgccaaagcagtggtgcctccggggactcgtcgccttttgctcaaatttaccattataaggacatagtctcgggcggtggtggtgcaagcctttaatcccagcacttgagaggtagaggcacacagatctctgtgagtttgaggacagccagagttacacagagaaacctgcctcaaacaaatacacacaaaggctctttggtcaaccctagtggtgtatcccccaaatactagattgtgttaggttgtgtcaggagaatcaggaattcaaggccagcctgctacatagcaagcttgggaattcctgctgctctgagga

SEQ ID NO: 1058 - DNA, 3112 bp, Mus musculus
agataatccgtgtccagtcccctgatggcgtgaagaggatcacagctacgaagagagagacggctgccaccttcctgaaaaaggttgcaaaggagtttggcttccaaaacaacggcttctcagtttacatcaatagaaacaagactggagagataacagcatcgtccagcaaatccctccatttgctaaaaatcaaccttgctggaccctcgtctgaaatggaaacatcgacctcggtagggttaaaggcctttggtgctcctaacgtggttgaagatgagatcgatcaatacctcagcaagcaggatgggaagatttaccggagccgagacccacagctgggtaagtttgttgccctggagaacatcagctgcaagattaagtcagggtgtgagggacacctcccatggccaaatggtatctgcaccaaatgccagcccagtgccatcacgctgaacagacagaaataccgacacgtggacaacatcatgtttgagaatcatactgttgctgaccgcttccttgacttctggagaaagaccggaaaccagcattttgggtacttatacggacggtacacagagcacaaggacattcccctcggcatcagggctgaagtggctgcaatttacgagcctcctcagattggtacacagaacagtctggagcttctggaagacccgaaagctgaggtggttgacgagattgccgccaaacttggcctgaggaaggttggatggatattcacggaccttgtctcagaagacacccgaaagggtacagtccgatacagtcggaataaggacacctatttcctgagttcagaagaatgcatcactgcaggagactttcaaaacaagcaccccaacatttgccggctctctcccgatggtcattttggatccaagtttgttactgcagtggccacaggtggtcctgacaaccaggttcactttgaagggtaccaggtatccaatcagtgcatggcactagtccgagatgagtgtcttctaccttgtaaggatgcccctgagcttggctatgctaaggagtccagcagtgagcagtatgttcctgatgtgttttataaggacatagacaagtttggcaatgagatcacccagctggcccgtcccctgcctgtggagtatctcatcatagatatcacaaccaccttccccaaggatccagtttacactttttctatttctcaaaatccgtttcctatcgaaaaccgggatgtactgggtgaaacacaggacttccatagtttggccacctacttgtcccagaatacctcatccgtgttcttggataccatttccgacttccatctcctgctgtttctggtcaccaatgaagtcatgccgctgcaggacagtatcagcctgctgctagaagccgtgaggaccagaaatgaggagctagcacagacatggaaaaagtctgaacagtgggccaccattgagcagttatgcagcaccgttggtgtgcagctcccaggcctccacgagtttggtgcagtcgggggctctgcacgcgctgctacctctgccatgtgggcctgtcagcactgcaccttcatgaaccaacctggcacaggccactgcgagatgtgcagcctcccccggacctagggctctgggcctctgctgcatgggactgggccagcccagccctctgaagtctggagcgccacatgttccctataaggcctgaagcccacagccctgaaacagtggggccagctgccctggtattccagataccctgaagcgtctccgtgcagatcttgaagagaaagaacctcggctgctgtgctggggttgaacagagcctcccacctgggaaggcagagcagacctgcccaagagctccccacacgcctcacgtgttggagggactgaacacgtccagccaatcacctgaaattggggtgtacagagagggtgctgctgtcacccagctatctctccttcctctatgatctttgttttctgccttcccaccttctcccccagtgttcggatgaatgttcctggctgtctctgttcccttgctgtggggctgtgtccctcctttgggagcatgtgtggctagggtgtggcagcctttgtctgacatgcagtatagtaggtccctgacctttacttgcctgaaatcagcagttatcaataattcccacccaggaaacttttatttattgttttttaaagataaaactgcacagatgggagtgagagatttacctctgctccttcctccttcagtgcagcccctcttgggtggtttattgggcaggaggccaccatcatttctcctcagaagcaaacctcagtgcctgagactttcctgccacgctgcagacagtggcagttggtagcatgggtggttcatcagagcagtggtggctcttgcctggcagtcagccccttcaagtctggacagccctggagttctggtcccctctcctagcactgtacctttacccagcgagtccccacactgtggtcttcttgcacagtgtgtggcagttgagaaagcctagaaaaggtgcccatttgaccactgtgaggcaaatagaaacagtccctaagggtcctatgtggctgtgttgtgacagcccttacccaggtaagagatggatgtcgtgatgcctcgttgccttaatgagagctgagtcagctgtccttcaccctgggaaagtccatgccagctgtggactgctgggagccatgtttgtcaccttagtagaatgcaccaatgttcccttctgcatctctggccctgtggacagaacacttattgctaggttatctatcgtgtggcagggctggccagcaccgttgggtctcacctggcatgagatctgaagctaaagccctgggactgtggagccattgggcttggtttggtattgacagggtcatcctgaggggttagcagtggtagagagcaaggcaagtgatctctccagctacctgccagcagtagagagagagagagagagtgctgagggctggtagtgtctctggctagggcttcacctttcggttttttgttttttgttttttctggtccctgagtctggcatttctgtctgtgacttagc

SEQ ID NO: 1059 - protein, 544 aa, Mus musculus
IIRVQSPDGVKRITATKRETAATFLKKVAKEFGFQNNGFSVYINRNKTGEITASSSKSLHLLKINLAGPSSEMETSTSVGLKAFGAPNVVEDEIDQYLSKQDGKIYRSRDPQLGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNICRLSPDGHFGSKFVTAVATGGPDNQVHFEGYQVSNQCMALVRDECLLPCKDAPELGYAKESSSEQYVPDVFYKDIDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKKSEQWATIEQLCSTVGVQLPGLHEFGAVGGSARAATSAMWACQHCTFMNQPGTGHCEMCSLPRT

SEQ ID NO: 1060 - DNA, 52104 bp, Homo sapiens
  misc_feature (1)...(52104): n = A,T,C or G
ttccggccttgaggtggagctcccaggagcagctgtgtgaagtctgcattatattaccccttttgtattatgtgcctttctctaggaatcctttttcttagcttgtcaggaaagacctactctctgaaatgtttatttgcttgcttgttgtctgtcttcctcttgggagtttaagtgcctttttcactcaccttctgttggtctcactcactgctgtgtctcttgcacccagcatggtgctgggcagagctggtgctgaggaaactcatctctaacccagcagcaccagagggagggtggccagtttctactgaacagagatggagatccctgggtgtggcctggcatcttacttgaggaacctgttgatgtagattcacctggctcacaaaaaggagtttctgactgagaacattctttttaagctctctgggcagaagccagaaaacattcatcatctatctttttttttttttttttttttgagacagagtcttgctctgtgggccaggctggagtgcagtgacgcaatctcggctcactgcaagcttcacctcccgggttcacaccattctcctgcctcagcctcctgagtagctgggactacaggcacccgccaccacgcccggctaatttttttctatttttagtagagacgggatttcaccatgttagccaggatggtcttgatctcctgacctcgtgatccaccgtcttggcctcccgaagtgttggaattacaggcgtgagccaccacacccggccacgcccagctaattttttttttttttttttgagatggagtttcattcttgttgcccaggctggagtgcaatggcgcgatcctggcacactgcaacctctgcctcccgggttcaagtgattctcctgcctcagcctcctgagtagctgggattacaggcatgcgccaccaccccaactaattttgtatttttagtagagacagggtttctccatgttggtcaggctggtctcgaactcccgacctcgggtgatccacccgcctcggcctcccaaagtgctgggattacaggcgtgagctaccgcacccggcctaatttctgtatttttagtagagatggggtttcactgtattggccaggatggtctcgatctcttaacctcgtgattctcctgcctcggcctctcaaagtgctgtgattataggcgtgagtcactgcgcccagccattcatcgtctatcttgaggagatgtttaaaagctactttcctttttttaaggttggctggatatttacagacctcgtctcagaagatacccgaaagggtaccgtccgctacagtcgaaataaggtgaggtggagacaggactgtgcgtgtggccctatggcttggttacagatggtgttggcctgcattatcagggtctctttgcaccgctggttctagctttcaggccccattatttatttatttgtattttttgagacggagtcttgctcttttgcccaggctggagtgcagtggcgcaatctctgctcaccgctagcaatgcctcccgggttcacgccattctcctgcctcagcctcaggagaagctgggactacaggcgcctgccaccatgcccagctaatttttttgtatttttaatagagatggggtttcactgtgttagccaggatggtcttgatctcgaccttgtgatctgcctgccttggcctcccagagtgctgggattacaggtgtgagccaccatgcccagccctcaggccccattatttttcaagaagttcttcttgatcaatgaaggccggatctcttggtctcatagagctaaacccatcttacctttataaagcagtgattttcagggctcagcccatggcggggtggtttgcatagtgcttctggcctttctagtcgtgagtggttttagatgaggaattggtaatggttaggaattgtagatacttgtttcaaagtggttttgagttttatagtttggttcttattttttatttttatttttttgagacagagtcttgctgtgttgcacaggttggagtgcaatggcacaatctcggctcactacagcttcctcctcctgggttcaggtgtgcaccaccatacccagataatttttttatttttagtagagaccaggttttggtgtgttggccaggctggtctcgaactcttgtcctcaagtggacctcccgcctccacctctcaaagtgctggaattagaggtgtgagtcactgctcctggcttagttcttattttttaaagaagaaatagaagtatattttggcatgatgctgtaaaatttgataggctgcttctcctctcttaggacacctatttcctaagttcagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggtgacagggtgagcctctgtctcaaaaaaagaaaagaaaagaaaaaaaaaatatatatatatatgtatatgtatatatggacaaggatgttcccctgggcgacagagtgaaactccatctcaaaaaaaaaaagcaaaacgggttttttttttttttttgacagtcttactgtcatttaggctggagtgcagtggcgcaatctcggctcactgcaacgtccgcctcctgggttcaagcgatttttgtgccccagccttcagagtagctggaattgtaagtgcacaccaccacgcctggctaatttttgtatttttagtagcgactgggttttgccttgttggccaggctaatcttgaactgacctcaggtgagtcaccctcattggcctctcaaagtgctgggattacaacatctgtaatcatagcattttgggaggttgagccaggaggatcccttgagactgggagtttgagaccagcctgggcaacatggcaagtccccatctctacaaaaataaataaataaaacatttggaaaaaaagaaagaaaagtgttcaagctgactgcgaagtttttgcactttgctgcatattcttgagtttgccgggtttttgtgtttttttttttgtttgttcgtttgttttgagacatgttcttgctctgtcacccaggctggagcacagtggtgcagtcatagctcactggtgcgactcctgggctcatgtgatccgaccccaacagcctcctatgtagttgggactacacgcgtgcgccaccacgcccagttaatttttaattttttttttttccctagagacggagtctcgctctcgcccaggttggagtgcagtggcgcgatctcggctccctgcaggttccacctcccgggttcacgcaattctcctgcctcagcctcccgagtagctgggactataggagcctgccagcatacccggctaattttttgtatttttagtagagatggggtttcaccatgctagccaggatggtctcgatctcctgacctcgtgatccgcccacctcggcctcccaagtgctgggatgacaggcgtgagccactgcgcctggcctaatttttaaatttttagtagaaatgaagtcttgctgtgttgcccagcctgcagttccttgatttaaggtgcatttagattgatttttgaaatgaatatactttttgagggtgataggcatctttcacacgttaattatgttaataattaatacatgttaactattttacaagtgaattagttgagtcagttttttttttttttttttttttgagacggagtctcgctctttcgcccaggctggactgcagtggcgctgtcttggctcactgcaagctccacctcccgggttcacgccattttcctgcctcagcctcccgagtagctgggactacaggtgcccgctaccatgcccggctaattttttttgtatttttagtagagacggggtttcaccgtgttagccaggatggtctcgatctcctgacctcgtgatccgcccgcctcggccttccaaggtgctgggattacaggcgtgagccactgcgcccggccgagtcagatttattttcctaagttgttgcttgggttgagtgcttaagggaagggttgggaatttgggctaggattgaaggagggtctgggaattctgcattacagaacctgttagggcaccctgggaagggtgctgtcgtgggggactcagggtagctggagagcagctggggcatcaggcagtgggcactgggcacccaggaggggagcagagaacaaaggcgctcatgtcatttagaattctgcctggccagcgttgtatttagagacggggagaaaagtgtcgtcatactcttctcggtgtcacatccccacacccctgccacatgtaggctgatatctgggtacagtagtgtaggctggtagtttccaagcctatcagactcaactcctgtttttagaacactttgtgatacccctttactatgcagaaataaaattcatgggtaacatagttaatgtaggctgccgacacacagaattctgaaatggaaggcagagtagtatcctaactgtaacatcaggggaaagtgataggaaagaaacagaataaagtcatacgtttaggtgtgtcagtgcttctggactgactcgtgaggacagcacagcgggatccgtactggcctgtgtgggcaagggctgagcacagggctgggtccaggcctctcagctggccttgccgtcagcaacatggcttcctgagaggctcagcagctccccacccagttccaagcagaagagtgtgcccttgcctcagcttacactattgtagtcccagagaattcagtgtgcattacaactgtgcctgtctgttttgtggctatttataaaacagaattgcttctaatctcatatcattgtaagtagtggtttttgcctacacaagtgtgtagcgggcattcagagtcttgtgggatatggaacagttccacagtatttcagtgtggttttaatgactattttattctgagtgaaatcgaggatcttttatttttatttttaattttttttgagacagtcttgttctgtcacccaggctggagtgccatggcacaatcttggctcactgcaacttctgcctccgggttcaaatgattcttgtgcctcagtctcccaagtagctgggattacaggcgcatgccaacacacccggccaatttttgtattttttgtagagacggggtttcaccatgttggccaggctggtctcgagcttctggcctcaagtgatccgcctgtctcggcctcaaaaagtcctgggattacaggtgtgagccactgtgcccagtctaattactgtgtctgtggagaaattattccatgggccagaagaactggcacatttttagaattacagtttctaacttgggggctaccaccttgaatttgagtcatacctcttgttgagagttgagagattatatagatcatccttgggcttttttcacctctggaattggtatttactgaaaggttttagaactgagagataataaataacctaatttataagcagataggcagtgacagcccctttgtgtctgtgtgaatcacccctcttggtgctcagacttgccatggtctccctttcccgagggtggtggccgactgaggagtgcttatcctcatgcgtgcttttaatcactacagctcggatgaaggttttctaactcaagtaaagtgtgctctttcccctgtgttagggtttcttggtcacggccatgcggggaccccatagcgctgttggaaattgtacttgttgcattcccgtcccacatccctccttagacaggaaggttcagactgagccatgtggcatagggtgcggggcgcccctgccgacagcactcaggtcctggctgggatgcggaggcctcgcctctccctctgcatctgtccttcctcccctttcccctttcgttgtactcaggtattctctggcatgaggcttcagagtataagagccccaatgaagtgtgcgctttgctcgagtgaccctgaggggccctgtggaaggacagtgcagtgtagaacttaccccccacactgggctgggcatctgtgtcctcatagtctagcatactctacatttacgggctgttaaaattacttgctggggatctggttaaaaaaccagaaatgcattcagattcaatagcagctgaagttttgctgtcactgcctctttgtaggccctgtgatccttcccacgtagggatttcctgactgactgatttgtgaagggaatgatagttaacttgtcctgccagccattctggcagggttacacaaacccatcaggacatgtatgtcctgctgctgcatgtggaaaggggagtttgcagttcatctcagtgaatttacccttgaagattatccatatggccaattttgctgtttataaacagccttcagttttataaataactgctttccatttttctcttattctcaactgctagatttttctttcttgaatgacctatcgtgttaatgaccagtctaaacaccagagcagggttttttttttttttttttttttttttttctgttttactccagagatggagtcttgctccattgcccgggctggagtgcagtggtatgatctcagctcatcgcagcctctgctacctggggtcaagcgattctcctgcctctgcctcctgagtagctgggattacaggtgcacgccaccatgcccagttaatttttatatttttagtagagacagggtttcaccatgttttccaggctggtcttgaactcctgacctcaggtgatctgcctgcctcggcctcccaaagtgctggaattacaggcgtgaaccactgcgccaagcccagtccaggttttcatggtgtcctaaccagatgtctgcaccgtggctccccggcgctctgtccagcctttgcctctgctccctctgagccctgcattctttcagtgtcatttatgccaccaagcacatgggcaagtgaggtgcctgtatctttgctgagatattagtggtcatttgtgcagggttggctgcctcctgagcatttgagtttggggcagggagaaaatcctatgctggtgaactgtgcctttggagcgagtttgacccagggttttgaagccagccatcacttgcctcctatgtgtgttgagagcttcatggcggccagctctatctcctccctcaccttttttgattgtgtggccgtcaggtttgctttctgatgcatgtttgacagccatgtgcactacgtttctgttttctgatcataagtgattctttttgtcaaagaaactgaaatagaggtattgagggttttttttcatccaaaactataacaaatgttgagggctgggcacagtggctcacacctgtaattccagctctttgggaagctgaggcaggaggatcacatggggccaggagttagagaccagcctgggtaacatagtaagaccttacttctaaaacaataaataaatacctaaaaaataatgagattgtagtcagcacataacttcagttctggaagcacacttctgcagcggtgggcatctcccccatgcctgcctcctccaaaggctcaggctgcccccatggcatcatctgcccagctcacttcagggatctggtctaactggaccacactgccgcctctcagccatgatctgtagttctcctgtccccacatgaagtcattctggaggcttcgatggagtggagactgggagagaaggatggggtgggcagtgtggagggtgaaaccatggaggagctgggctcccaggtctgcccacggccgtggagtggcacctgcacctccacactgtgtgatgacgcctggtggcattaactctgtgtggcggccgtgtaggtttctggaagacagaggctgctgtgtatacaataccatgactggatttgtattaaaaatagtttccgtcttgctcttctcccacccgcttccccatctctctgcctccagatgaatttatcctcccatccttaccgtgagcctagggatctatctgccgtttacacccctggtgttattatgaaccaggagcccaagtgctgatgacactaagcctggttttaggggcagatgctagacaatgtttaacaatcttttttttttttttttgattgattgatttattgtaaagatagggtctcactatgttgcccagactggtctcaaactcctgggctcaagcagtcctcccgccctgccctctcagagtgctcagattacaggcgtaatctgagccttttcttttctttttttcaaaagtttaacagtcttgatttccagattctcatagagcatgtccttagtggcacctgtttgtggagccaagtgtgtgcggagctgcagggtgtcctgactgtgctaggtcttgtgctaggtcttgtgctgtggccacccatccgttgactactgaatttttttttttttttttgagatggagtctgtcacccaggctggagtgcagcggcacaatctcggctcactgcaagctccacctcccgggttcacgccattcacgccattctcctgcctcagcctcctgagtagctgggactacaggcgcccgccaccgcacccagctaatttttttatttttagtagggacggggtttcaccgtgttatccgggatggtctcgatctcctgacctcgtgatccgcctgtctcagcctcccaaagtgctgggattacaggcatgagccaccgcacccggccgactactgaacattttttaactcttacccccgacaaactcttgagggtttgttttttctgttgatcagaggtgaagagttaacagatatggactggttttgaatgccgtttggtagactctttttaaaggtctctctcttgcaggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggtaaaagtatggtaagaaaaagaactctgtacatggagaatggtgtgaacctgtcttggacctttctaatttgggtgcattctgcctatagcagccgtttgtcagctgtggttgaaccctgcttgtcactaaaggcttctgtcacgtttctggggctggatattcgctactcatgcttccatggcgtagggcttctcaccagaagtggagctacatgcactggctttgagatcagtaacaccaaatccgaccattgcaacacagacagtctcagtttctaaagatgagaagatgggtccttggcatggtggctcatgcctgtaatcccagcattttgggaggccaaggcaggaggattgcttgagtccagaacttcaagaccagcctgggcaacatagcgagaccgtgtctctacaaaaagtagatgtggtggcatgaactgtagtcccagctactcaggaggctgaggtaggaggatcacctgagtctggggaggtcaaggctgcagttagccatgattgtgccactgcactacaggcctgggtgacagagcgagaccctgtctcaaggataggggtggagatgagaagaccgtgggagatgtttcgggaccttttttagaatcctgccaattgcagctactcaatgttttctctttttggtgtttcccgctcctttgggggctccagttacacatgtatttggctgcctgaagttgtcccgcagtttactgatactctgttcatttcatttcagtcttcttcagtgtttcattttggataatttcttttagtcttcacattcgttgatctggacttctacagtgtctcatctgcagttaatctcatccagcatattgttcatctcagacattgtagttttcattccagaagtttaagttgttaattgcttcctgtgtttctacttaactctttgaacataggggatacagttatattaacttttttcggccgggcgcggcggctcatgcctgtaatcccagcactttgggaggccgagatgggcggatcacaaggtcaggagattgagaccatcttggctaacacggtgaaaccccgtctctactaaaaaaaaaaaatacaaaaaataagccgggcgtggtagcaggcacctgtagtcccagctactcgggaggctgaggcaggagaatggcgtgaacctgggaggcggagcttgcattaagatcgtgccactgcactccagcctggggaacagagctagactctgtctcaaaaaaaaaaaaaaaaaacaacttttttctttgtttcttttttcctttttttttttttttttaaagagacagggtgtcagctgggcgcagtggctcacgcctgtaatcccagccctttcggaggctgaggcgggcggatcacaaggtcaggagatcgagaccatcctggctaacacggtgaaaccccgtctctactaaaactacaaaaagttagccgggcatggtggcaggcgcctgtagttccagctactcgggaggctgaggcaggagaatggtgtaaacctgggaggcagagcttgcaatgagccaagattgtgccactgcactccagcctgggtgacagagcaagactccgtctcaaaaaaataaaaaataaaaaaataaagagacagggtgtcactatgttggccaggttgatcttgaactcctggcctcgagcagtcctcctgcctcagcctccaaaagtgttggggttataggcgtgagccactgcacccgacccatattaacttttaatgttcttatatactaactcatatcacctgcttatttctgcatcagttttaattgattgattttttttctaattatgggttagcatatgtgggtctgcagctgcaatgtgttttccgtggaccgtctgtctgtctgtccttgttactggcgtgctgagtgtgtgtggtgtgctgctcattgtgtatcacaagccagagactccagcagggtgttttcttccagagagggctttcctttcctccatgggaaatgtggtggtggtgagctgtccatctccatccaggtggcaagtagctggtcagagccgagttgcattttgatgagacttcgtctattgttgatccttccctttttctacagtgtaaccccttaggggtgccatctgagagcctggtagagctctttgtgaggtgacagtcttccttaaatctttgtctcattggccctgaaaggctgggagatacagtctgtccagaagtttcttgttttcctcatgcctcatacagcttaaatatgtaggtatcccatgtaccttaaaacttttgcaagcatcttttttttttttttttgagacagttttgctctgttacccaggctggagtacagtggcgcgatctcggcccactgcagcctccgccccttgagttcaagcgattcttgtgcctcagcctcccgagtagttgggactacagatgtgtgccacctgcccggctaattttttgtgtttttagtagagactgtgttttaccatgttggccaggccggtcttgaactcctggactcaagtgatttgcccaccttggctacccaaagtgttgggattataggcgtgaggccacccaaagtgctgggattacaccacacccagctgcaaacatcttgaggggagagaatggctgcatgtttgaaattcctgtgtctccagagtctctgccagaccctcatctcccagcactcacttcctgcaggaggggagggaaggggctttccatctcagtgccacagtcccctttgctgggggtcttcttatctggtttggattcaggcccctgcctccccttcctccctcctaccccgttgggcaggctggtctcgaactcctgatctcaagtgacctacccacctcagcctcacagagtgctgggattacatgcatgagacactgtgcctgacctatatttttcttttgaaacagcatctcgctctgtcacccagactggagtgcagtggcgtgatctcagcttgttgcaacttctgcctcctgggctcaagtgatcctcctgcctcagcctcccgcgtagctgggactataggcgcacactaccatgcccacctaactcttttgtatttttagtagaatcaggatttcaccatgttgcccaggctggtcttgaactcctaggctcaagcaatctgcctgcctcagcctcccacagtgctgggattatagatgctgggattacagatgtgagccactgcacccagcctctgatttctttctttccccccccccccagaaatggagtcttcctctgtctcccaggctggagtgcagtggcctgatctcggctcactgcaacctctgccacctgagttctgcgattctcctgcctcagcctcccgagtagctgggattacaggtgtgcaccaccacgcctggctaacttttaaatttttagtagagattggatttcaccatgttggccaggatggtctcaaactcctgacctcgtgatctgcccactttggcctccctaagtgctgggattacaggcgtgaaccaccacacccggccttgatttcttaacgatgtggataatcagctatatgagcacagttttgggaataaaagcaaacttttgtttcccttttaatctttgatgcttctctgtcgtcggtcatctccatgaatcatggatgttactggactctgttctattccattggccagttttcctaaaccagaactaataccatactccttttttttttttttttttttttttggcgacagagtctcgttctgtcgcccaggctggagtgtagtggtgcgatctcagatcactgcaacctccgcctcccgggttcaagcaattcttctgcctcagcctcccgagtagccaggactacaggcgcacgctgccacgcctggctgattttttgtattttagtagagacagggtttcaccatgttgcccaggctggtcatgaactcctgagctcagcaggcaatctgcccacctcggcctcccaaagtgctaggattataggcgtgagccaccgtgctgggcctcgttcccatgttctttaatgtctcttagaaaggttttcagttttctctgtggaggtcttacctatcatttgttaggttattcctaggtactttaattttttttaagcctgttacaaaatagcactatcttaaaattacatttttaaactgttggtgtttgaaacaggtaaatttttgtatccagcaactgctatctgttcctcagtattattatttataagtttagtctttcgcatttcctacacgtattatcctttccatcatcagcccttctcattctctgggcttttcccagtgttgcctgggatctcccaaacagcactcatgacagtggaagtctctggcacctttgtcttgcttttaattgtaaagcaagtgcttttaggattttatcattaactgtgagtttgctgtaggattatttttaaatacccttttcagattggaaattggcttttttatttccatgcgttattgtaagtttcttgcacttaggaatggagctcccttttgtcatgaaatatgtgacatttccttaatcattctgttgttttcatagagtgcttatttgccctctgttagcgagaataggctagaaatacttcccagaattgtttatagccctgtaggatttgagacagatttctcatgtttcaggaaaatatcagttggagcaaagagaactgtaaaagcaaacattgaagtcatccttttagtcctcccatggactttgcggttggaggtgacatgccttgtaaacaaaacctgcaccaatatttgtctgaggctgctgtttatcatgttgttgtctctggcaataaaaatgggaaacaattgaaaagccccgtcccaagggcatattaagttacagctggactctgggatagcatgtggttactaaaggtatgtgtttgcaaattatttaaagataaggggtaaaacttagaaagcaaaattaaaaatgcatctatacctagagtataataccaattttttttgttattttcttgaagacacgtataggcatttgcacatggatgtggacatacatttacatgcactcacacatggggtgggagtagaagcttcctgactgtccttcaggagggaggagagtctacagctttgccctgtcccatatgcagccagtaagagaacgaggaagagccttgtggacagatgaggggagctgtgcagatgctggccttggagaagtgatttgaaggcacatttgtgtcatcgttcacgtgtagttttttaggaaagcatatgggtgtacacatagtcctgtgaggaccaggagcttcccgagggactagggccagccagcctcactcatctctggggcagccaggtggcaggacgtggggcttttctctttcacctttcttgtgaaagggaacatttgtcccctgcagaaaaacatgaagaaaacatatttaatgataactactctttgcatctggtagagttcttgtttccttttctattcttttaacttcaaaacaaagacttgtaattatggagaataaatgagtgcatttattgactatatggccaaatcagaatgtatttaattggtcttgtgttgatggcctttggttcttcctggttgttacagaaagtgccacatttaacaccctatacatcctcctgtgacatctttgtatatcttcaaaatagaattgctggggaggaaggtttttcgagttttgatagatatttccaagtcgctcactgaaaagtcacactaacatctctcttgataattaggaagaagagtttaaaataactttccagccatgaatgcacatgggtgtgtcacacacactctgcgtcacgtggcagtggctgctgtgctggcgcacatgggcgctcagttgtgagtgcgcaggggcggcgccgcagggaggaggcctggccctggccgggaggctccttgggtttttgtgtgtttcttcgaatcgggaggctggctgtggctcactgcccatcagccccaagagcctgcagctgtggagctttatgtgcagccccagagcccagctggtgggggttttgtttgggcaggctgggacctcctgcccatcacacagggacaagactcacactcgtagactgttgtacagccaggaggcgcttgactgtcttctgtcttttcctttaaaaagaatactaatagactaggtgtggtggctcacacttgtaatcccagcactttggaaggccaaggtgggagaattgcttgagctcaggaagtcgaggccagtctgtgtgacatagcaagacctcatttctacaacaacaaaaaaaaattagtcgggtgctgtgtcatgagcctgtggtcccagctactcaggaggctgagtcagaaggatctctttagcccaggagttcacggctgcagtgagctatgattgtaccactgtactccagcctgggcgacagaacaagactcctccaaaaacatgcagacatacatacacacacagaacaccgctagatgcttaggtgttcagctgcttcccactgaaggtgaaactcgggtccatgcccctcatcgggcatcatagctgaaaacctcctggtacggatgtgacgtgcaggcatcttcagctttgccctttcatgcccgtcatgccacagctcgcttacctcacggccctcctggttgtgctgctgcagcctgcaggacaaccgctgggcctcagcttgggctcctagaatcataagttctctggaaatgttccccaagtaagtcttccgactggctctgtctatgctccatgttttctggtgattcactgtggtgtctgggcccctcgggtgttctttggtacagaggagccctcctcatgttccctctctgacactagggtgtggtgggtccaccatggaagcatgtctctgctgtcagcacgtcccagagacattttgagatggtctgggactccatccagggcatagcgaggctactagctctgcccagaaggtctaagttattcctgcgcctctgctttcgggatgctctttcctgcgtctgtgtgatgtgtgaggatgtggcaggctacgacccttctgccacagagatcacacagcctccagtccttttattcccactcctctggacatgggacagtggctctagtgtctggaatctgacttggctttgtagctgtgcctttaccaccttgctggctggcgccccgggagtatactctcttcccatggactgccttcactggctgatttctgtaatcgttgtgggggagtgaggagaggtggccttggtgctctggaggactggctgcccctctggctggagccagttgtctcctcactgctcgcacctatgccaagggtctgggcgtccacagggcttattcctctggggcagggagaattggttgattgggtttgagggagcctcttgaggacaagtaacaattgggcactttgacaaggggctggctttcagttcttttgtgacatggtgattttattaacttttttttttttttttttttttttttttgcgttggagtctggctgtgttgcccaggctggaatgcagtggcccaatctcggctcactacaacctccgcctcccaggttcaagcaatcctgcctcagcctcccaagtagctgggattacaggcacctgccaccatgcctggctaatttttttgtatttttagtagcgacagggtttcgccatgttggccaggctggtctcaaactcctgacctcaggtcatccacccgccttggcctcccagagtgctgggattaaggtgtgagccaccgcttccagccttactgtgttttaaaatctctattttcttctccttcagccatgaggaaatagtctgacgggcataagcccacgggtgggctggcccagggccactggggattttgtacttccatgccatgtctctcccaggcccccagctgtgggcatgggaggctggccctgggcccttcagagctgagcggggagcgagagctgttgtgtttgggtggccaagcccttggtagcactgacctgattcactgtgcgatgctctcacggcatccattctctcatgtttagagaacacctgtgaattgccaggccctggagttcatggagaatggagaagggctccctgcatcggggagactgctgcagcaggggaggtgggccaccccagcggaacgggtagagaagcttggagtgccctggtgggtcgagtcctgagaggggagagaaggtgtcaattggcagagcagctctgggggtgtctggaggagattgttcagacagaggcagcagcctgttccccacacagagagtgataagcagggtggcctgctggggtagaggtgggaggggcccttggaagctgaatctatggttggaagtgagatgagggcttctgaaaggtgctgaagggagatggctgtgccggggctgtgagacgatcactctggctgctgggctcggagctggaaaaggagactagggtagagagtagagatggctgtgcagtagtgagggggttgagtgtgtggtgtgatcgagagaagaggcaggcagactccagggtgtccaggccaggctggaaggctggggatctgtcggcgatgtgctagtgcagaggcaccacccggggtgagcgcattgcttgggagaggcacatggtacagatggtgttggggtggtgcttgaggcctggtgagaggccgagttgtccatcctggaggggatggctgaggagaaccccaccttgggggaatgaggtggagagcactgggaggcaggagctggggaggaggggcaggagcatagcgccctggaaggcaggcaagaaaggagctccctggtgagtcaggagaggaggctttgccttcagcagctcaggggtgttgggagctttgatgagcctggctgagtagtagataagcggctgccgagagtgagctcacagaggagaatggggggtgagctcacagaggagaatggggggtgagctcacatcagcaagctgcatgactctttcggggggtttcactgccagggagagcaaaggacagtcaccagtatgggaagtgggattgagaagttttcttgtttgggtttttattaacgtaagggaaatactgacatgggcatgtactgcttcctggtgtccagcaaaggagctaattggcacacagagaggaaggggcatggtccgtgtgtcagggacagctttggggcatctggagacaggtcagtacaatgaggatgggaggcagaggtgggtggagctggcaggagcgatgggatgcaggtttggggatcagcttgctcacaggaagccacagggtcagctgaagggggaggctggagtggagaccaccttttagaccaggaacttgtgaagggggtgttgtccaggtaggagggagaggctggcagcaggagggtctcaaatctaaagatccacatgcatcagacagctcgaagtctatttatttttgagatggagtctcgctctgtcacctagggtgatgtgcaatggcacgatcttggctcactgcaatctccgcctccctggttcaagcagttctcctgccacagcttcccaggtacttgggattacaggcgcccaccaccacgcccagctaatttcttttttgtatttttagtagagaggggttttgccatgttggccaggctggtctcaaactcttgaccttaagtaatccacctgccttgcctcccaaagtgctagaactacaggcgtgagccaccacgctaaacagtaatgcatgcagtctatgctgtgtgcacctgtggccccaggtactcagtaggctgaggcaggaggatcgcttgagcccaggagttcgaggctgcagtgagctttgattgcaccactacactcctgcctgggcaacatagtgagaccctgtctctaaataaataaatatggaacattttaaatatgaaatgaaatgtatgtttattatgaaaaaattaaatattgtagattggtaagaagaaaatggacgccccctagcaccctttgtgatatggataggctttgtgtccacacccacacctcatcttgactcacaatccccaggtgtcaaggagagatgaggtggagataattgaatcatgggggtggttcccccatcctgttctcagtgatagtgagtgcattctcacaagatgtgttagatttataaggggctcttccccctttgctcggcacttctctttcctgccaccttgtgaagaaggtgccttgcttccccttcccctcctgtcatgcttgtaagtttcctgagggctccccagccatgctgaactgtgagtcaattaaacctcttataaattacccagtcttgggcagttcattatagcagtgagaaaacggaccagtcgtaccgtttatctgttgagagcttcccgtgggtcaggtgttaggcctggggcgccacggtgagcaggtccctcatggtccctcttcttggaaactgtggaggtgtcctgttggggagcagggtgcgccgaggtggccattcacagtgctgagactagagtgtgtgagaggaagccacgcggagtggaatctgctgaagctatgtacctggagagcacagcatgcacccggcggggccagtctagctggagtggcttgtggtggacagtgggaggccatggaaagacttatggaaagtgagttctggaatgttcctgctggaggtgtcaggaggggtggtctggaggcgggaagcttttgcaacaatccaggcattggatgccagtagcctgagtcaggagaaggcagcaagtttagaggagtgagtggggctgaaatccaggtaggagaggcagtggacaggtgctgacagccggatggggtgggcaggggaggtccccgctgtagaagacccatcctgggctgcagtgtggggaacggtttggagttggggagcccagtgagaagctggtggtgttggcaatccaggccacatgtcagttccctgtggccttggggacaaggatggtgtgctgggactgagaggtttggaggcctggcaggtgtgcagagaggagcacaggctcaagccaggttcctggttttggggagcagggttggcactggtgccagagtagagccatgggtctgtgtgggaggatggtgagtccaggtgccagcacgcagagtttgaagatggagcaggacagacggttgccaggactcaggtctggaagctcaggcaagagatacaggccaatagttcccttttcagactatctgtggagaaagcctaaattaacccagaagtagatgagccaagccgtggttcagagggagaagagaagagtgcgttgagctaacccggaagtagatgagccaagctgtggttcagagggagaaaagaagagggcgttgagctaacccggaagtagatgagccaagctgtggttcagagggagaagagaagagggcgttgagcaactccaaggatggctgctctaaagaggtcaaggagaagggtctgggagaggtgggagggtgatgtcctggtgccaagggacagtgctggggtcctctgtctggagagctgtgcggacaggcagtctggcgaggactacacagtgatggggtggggcgggtcagagcgccgtggggagctgaggggacataggagcagcaagggaacagcgttccttcaaggagccagctgtggaggggccagagggtatctctgaggaacccactgccccttgctgtggccaggcattgcttactcagcaggccgtggggtttgttggcatctggcactgtgaacagcacttggtggaccctgtaactcattcttagtgcatgctttaaattacttgggatgaattgctagaactaggattatgttgccgaagcttactatgtactcgaagggtctgtgtgtcctcccacgtttcctctgggaatgtggcagggtggacacttgcaggtggtgctgcagaccagccttgccctcgcgcccgtgactctggcaaggaccaggcaggcccaggaccccgctctctgtgcttctttgaccacagggagtctcctgtgtttactgactgttttctttgtgagtagcctctgtgtgcacttaagtatttgtaaagtgattcatcatttttggcattcatttgtgaggtctttgtatattaaccctttgtcgtgtgttgcaaacacacgccaggttttcgttctttgtcttttatacaaagaagctgaaatattttctgatttcaaagataccttaactctttttcttgtaatttctgcctttgtcatcgtactttggaagtacaattgcccctcagttgacacagaggattggttccaggacctccatatatagtcaagtccacatgcactcacgccccaaagtggatccttccaacctgcttatatgtaaagttagacctccgtatacatgagtttcctagccctcgaatactgtattttcaatctgtgtttggttgaaaaaagtctgcctataggtggacctgctcagttcaaacccgcgttgtgcaacggccaactgtaattctttcccccagaactatgcatctacctacatactctttccgtgcttttaggatttaattttattttgagatccataatccatttatgcatgatactggtacaggtaggaatctagcttttgtgcttctctagatgtttgcctggttgacctagtcccactgttcattgtaaaacaaggtatctgtgtctcctcatgtcttacttctggtcatcgtcctctgtgccacttacctacaatctattcctttgttgttaccaaactgctctgtttgctatagccctgtaacccacttgtatttgctggcacaagacccagcagcacgcaactttttaaaacaagccttttcactcataggagattgtgtttgcttccagcattattcaggcaggtttatcaattaatcaagaaactgccatcgacagaagagattctgaatcacttattatagcatattcccagtcttaagagaaaattttgcatcttcccttgcggtggaggtgggagaatcttactcagtgtgagacggctgttggggtccgagcctcaacttcaaggttccccaaaggcaggagggaggcctgcgtgtgccctggccctgcagcaccggcactgacttgggaggcggggagcctgcgcacgtagtgtggggggcccagtctctacacagctgtccagctgtccttgccgattgctttaggaggttcactcatctttgtaacccttcctgtcttggacagcagtagtgcctgtgaccagtgtgtttgtgaggacgaagtggctctgtgcacacagctggcccctgagaaatgccagctgccagttctgtgtgcatccagtcgttgcacacggactggactattttctaagtggtgcttttaagaaaccaagtgtcagctgggcgctgtggctcacgcctgtagtcccagcactttgggaggccaaggcgggtggatcatgaggtcaggagatcgagaccatcctggctaacacggtgaaaccccgtctctactaaaaaatagaaaaaaattagccgggcgtggtggcgggcacctgtagtcccagctactcgggaggctgaggcaggagaatggcttgaacccgggaggcggagcttgcagtgagccgagaccgcgccactgcactccagcctgggcgacagagcgagactccctctcaaaaaaaaagaaaagtaaccgagtgtctgaaagctttgttttttctgagttatcctgtggcggctcagatcctggtgtcatttgtgccccttcttgccagttcttagaaaagcagcacattcaggatttcatttaccttttctaaagcagggttgatgccattcaatcaatggaattcactgttgtcctggcataaagcccacatgcttttgtgtttgtgtgtgtgtgtgtgtgtgtgtgtgtttgtttgtttgtttggagacagtcttgtagagacggagtttcaccacgttgtccagtctggtctcaaactcccgacctcaagccgtctgcccacctcggcctcccaaagcgctgggattacaggcatgagccactgtgccctgggcatccccattgcttttgagctaacaaagacatcgatccctggatttctcttggtgtcaagaccttggcgccactgcttccagaagtggcctctggcgggtggcgaggtgttggggccacaacctccgacctcctggtgcctcgctccaggtggagataaagctgctgacactttgacggctgccaaacttagaattaagacatcctcctcccagcgcattccaactgacattttctaaggcccataaaaagtaattgccttttaaaatggtgtgtaggcctagggattggctggcgaaaacatctgagtgaaggcttgggggagaggtagaagtgacctgtttccccagggaggaaagggggatacaacacctttattttcttggggagtggaaaagatgcagttgggtagttaagtttgaaagagaatagcatgacacaaaaaagagagaggggcatttaacaagaaaaatccctagagggggagattaaagtgaacaggtgctggaaaaatgtttctgcatattagagcttaattagatttgaagatgaattccagatgggctaattatgtgtgagttgttgcaggtttatttcttgtaggggcaagcctgtatttttggaaatggtgatttagtttgactggatttgatttttgcctcctaccaaatctccattgagaaaccacctcttttggggccccaggaccccgtgcagtaggccctgtgtctttagcgcccccatcacagccagcagagcgcagaatgcggaagcccatcctgactggcagccactcgtcacgtggaaggaggacacacgaccctcacccaagtcggtggaaagtcatttcagtgtccaaggaaggcaaacagagcagagctgtgtatttgcaggaatgtagcctttgatggggcggggagcaatacgtgaaatggaaatagagtccaggttcattctcctgccctcctggaaacatcagtgggatctatttggaccatttttctctgggagggtagaggcaagttcttgttggcagctctctagctgtgagtagagaaaaggtgtgagggtatggagaactgagacacatttcaggccagaaattgaatttaaaaattttttattattttttaagactagtcaagtacaatagtgaggaaaggggagagagtagaacaaggagttggatctgtaactgactgttaacaatcatctgaggtaactcaccaccttcggaccagccagaatttaattttcaagcaagaaacagggccaagggccaaatgggggcctggggcttctcattagggtaatggacttggtttgacttgggaacagcttgtgatgattgtctcagaagacagcggggcttcctgacatccccaggaaggtgtggttgtgatgggggtggcctcctgtcaccctgcacacctcagggagatttgcttggcaatcatttcgggtctgagagctccaataaacgtaaacttttatgtaaggccctataattggaaattatggatgtataatttatatatgacttaatgaatgatttatataatgttaagtgatgatttagatagaaaatgtgatcccctcttgcagaatctttaatgaaaagctttggttcttatgaatttatttctggagctctgtttgaactcagcatgtttgacataaatcagatctaattgtcattttatgattaatgaacatatgctggccgtttttccccataattaaactttatgttctgtgcatctgacaaagcaaaacaagttgagactttgacagattggtgtggggttcccgtgtcttcatatttgtgtgtgcgctcatttgtgcatgcctttattttattaatgtccaagtactcggtttctggaaagtcgggttttcagaggtgtgagtaagattctaagagttagcattcagactgtgaggattcatgtgcttttggaggatagacagggcacaggtccaacctgaggggaacgcagacccttctgcctgtcgcagatcgcgcctgagtgccaggccaagcgccatgggtggagaggaggcatttgatgtgctctcccagtggggagtcccagtgcccgagagcacgactgctttttcaggctgtggttataatgagctccaagaaatggtggaaggtggttttactgcaaaaatatgcacgttttcctttctgctatccatacacttcaataagatttgaagtaatttaaaaagtgaaggccggacgcggtggctcacgcctgtaatcccagcactttggggggctgaggcgggtggatcacgaggtcaggagatcgagaccatcctggcaaacacagtgaaaccctgtctctactaaaaaatacaaaaaaaattagccgggcgtggtggcgggcgcctgtagtcccagctacttgggaggctgaggcaggagaatggtgtgaacctgggaggcggagcttgcagtgagtggagatcacgccactgcattccagcctgggcgacagcacaagactctgtctcaaaaaataaataaataaataaattaattaattaaataaaaggtgagacaagcatgtgaaaggaaaatcattactactgatcgtctttgctcaccgctgttcccctctgactattgcaggacgtagacaagtttggcaacgagatcacccagctggcccggcccctgcctgtggagtatctcatcatagacgtaagtgccccccatgcacagcttgggcaggtggacccattgggcgccttgtaggtgggactgctgggtggtggctgctcaagggaggaggctgcaatttaaggcaccctctgccttgagcagtgcccaccccagaacaggcacccaggaggtggttgtagaatcactgagcatgcggtgttgctgaaatgctcacagtttaaagggctttttgttttagtctcaggtttttatttccttgacgtcaacctaggggttaactgtccccatactaaagtacaaaggaccactgaccccaggctaggcagcctctggaaggcagcgaacccccattgcttgggtctccagtcaccggagcatcaagcagtcttgtccagatgtgctgtgcttggtgtgtggctgtcagctgtcctgcacgtgcaggtgcttgccctagccccagcacagctgccacagcccacagtgtgtctgggtcactccgtccagggtggtccccaggggacacacctgtaactcagtgttcttgagtgagggctcagcgtggtttactgggtggaactccaggagccacaaaggcccctggctcttccacatcttccctgtgtctcagctcctttttggaggcattttatggtcatggagacatggctgtaccattggccacagggcagcaaggatggcaggatgagcctttgcagaagccagtgcatcagccccaccggagctctgtccaaagcggacgggaggcggctcatttcctatgctgctgccacgccaggatctattcaggctgcatttgaaattggatgggcacgtgattcaggcagtaaaatatcattgcattcggaacagcaggtccccacgagccaagcccatcgatgcaccattccaactgacagctcccgagaacatatttattacctaggccgtgaaggcatctggtttttagactacctagggtgtaattaagatgaaaacagattgatggagcatgcacccaggaggagcaggcatgatttaaaaccagctttctcaggtcttctaccccaagcagcctccccacttctttcctcttcttttataaaggaagttaagtttttgccttagtgcagtttttcagaagtacttgtttgtgggagagcattctgctctgtgatgcccaggctccttgaccctgtggaagtgaggcatggggagtccttgagagcaggtgcccagagaggtgtgtcaagctccatgcccagccctgggccacaggcgctggcctcagccaaggttcttaaaccttgggatgggatggctgggcaggcaggaaaaggcaccagccagtgttactggggtttctttgtgggttctgggggcatcatctggctgatagacgatgggtagggtagggaaatggcttcagtgtaagatgggagctgatgcccttccttgggacatctgggatgggctgtgtggactttggttctgttcccctccaagggccagttacaaggccagcaagagcccccgtcagtcccactagctcactcactagcacgtgttctgggggtgccgccttcttcatttctaggccttcccaagggacgcgcctgagcaggccaggcttttgtctctgcaggaggtcagcacctcccctgtcttcagctgggacccagcactgtgtgtaccaacactatgtgtaccagccccgtgctgggcacccaggaggcgagtactccgatcatcttcatcctgaggaagagtaaagtgaggcccaggatccctaactgacgaggccatgtagccgacacgtggcaccgcggcccgagtcttcatgacccaccccgccgcttgcccatgaagggccagctcaggccagagatgctgctggtggctcagctgtccttccacagcggctggcgctggcacagcaaatcctgggccagctagctcaacaactcactgcctttgctgatgcagaaaacagaccagaaccacactcattctttagaaatagtcccaaaggaaccagaatagttcccctaaatctggaagaggtgtgacctctgctgctgctgttgtgttgcagagaaaagcagcatcaactcaactcggtgctgctttggggaggggtgtctgtcacgaagaataaaagtggtatttctattgattcttgcacatttaccactgtccctgtagcatctattgattatatcttaggtgcaaagtgccctctgttgtcattaaggcctgtctgagccagtgaaggactgaaggacttagctggcctttgggtatcagctctgagggagagagaagagctgaaccctgtgttcctcaagggccttacattcacccctgcctggaaaagcccacagctccgtggagtggctcccagcattcagaaggggcttagtgagctgctgaagggtgctttgtgtcttgaaagctggctgattgctcatttgccctccgaatccaatgacacgaatctctcttgagcaaagtcagctcctggggcggcctcctggcccttccgttcctttcctgtcacctggccaaggggccaaaccagcctttcgttcctccatagcagagggagagaacctgtgtgactctgaagggaagctgtgccacgaggggagtcccagtgccctttttgtccgacgtcgaggccggtgcacaggccggaggctgcccggatatggtgtagtttgtctccaggatggcggagtttccaagtgttcgtttagagatgacactaatagataacggttccctttgatggagagcttgtagaacattctcagaattgctaggagtcgttaatttgggctctgggagatgctctgggctggctgggagtcggccacaccattttcagcctcatttatcatgggtttgtgtttttcttcattagatcacaacaactttccccaaggatccagtttacactttttctatttcgcaaaatccatttcctattgaaaaccgggatgtattgggtgagacacaggtgagctctttgtctttagaaacataatttaaggtaactgctgattgttatctagtgtcagtattgtttttccagaaaacatcaagctttcaaatgctcccgattcattcttgtgacaggccagctagggcctactgtggggcactgctggtcacgtggacgcccttcccatggctaggtgatggacggccacaaaggctaatcccctgacgtcctgactggccacatcttcagtggacctcgtaattttcccaaatgtgttgctttgtgtcttctgccagcagcctcgtcactgttggtttggcctggcccctgcctggtcacctgctgcccttcttaggcaccttggggctgtgtggcccctctcggcctggcctcggctttcccgtgtgtagtgttgatctgctgcttagcgtggctcccgtgttggcctctgctctcactggcagatcaggccaggtccgatttgctgtcacgcctgcatactgtgtagacaggctgtgtacacacggttgttcttaaatcataacttgctaacagacatttcagaaggtggtcaaagaatgtctataatgaggttttcttcagtggctgacaaagcttcttctatgctttgatcccctcagtgcccatccgcccaggggacttggggtgctcacagaggtgcaaagccagttattggggtgcactcttgaagctctgtgtttggttctgctgaagatgtccgtgctgcatcacggctgccctgcacattcctccctcttgctgccctagatggagaatacagctcgacaggaaaagtcagacctgtctccctgccgtgaagggggccccaggcccctcccgcagcccactctccaccgggggaccagggcgcatttccatgtttgtgtctctgtctgagtcagcctttttttttttttttttttttttggaagacagagtctcactctatcacccaggctggagtgcagtggtgcgatcttggctcactacaacctccacctcctgggttcaagcgattcttctgcttcagcctcctgagtagctgggattataggtgcgcgccaccaagcctgggtaattttttttgtatttttagtagagacggggtttcgccatgttggccagactggtctcgaactcctgaccacctgcctgcctcggcctcctaaaaagtgctggaattactgtgttagcctccacacctggccagtctgagtcagctttataagcatgtctccttgcacatctgggtagtcaggtgtgctgagagcatcttcttgggagaagagagcaagagcttgctttgcagctgcctgctcctctttcttggaccctgttcgtggttgcagaggcagagggagaggtgtctcagcattcagtgtattgagttgcgtcttagtaggaaacagctctgtttcggggtctggcactggggaactgtatggaacattcatgtttattcccattcctctaggacttccatagcttggccacctatttgtctcagaatacctcatctgtgttcttggataccatctcagatttccacctcttgctgttcctggtcaccaatgaagttatgcctctgcaggtgcgtgtccaagtgtggtgtccacttgagcaagtgggctttggctgcaaagagacgcctgtgtcttgctttctttcctcccagaccagagcatgattgggaaactgggtcaaagctcggggtcacaggttgtccccctcatttgtcctatgggcagagtgtaggcagcagcttttcacaagaagcttgttgatagaaagattaattttttcacctttagcatttccattgagtgtctgcacctctgtgaggaagtacggtttcatctgttacaatcgaatgggaagcagaggtgatttagctctgcctccagcattagagttagacagtttaaaaaattcctgttctaacagtttcagagtcacagcctctgctttttactcatatctcccctcctcctaaatcaactctggttttattgccttggcccagaaggcttggccagcttccagaccccaagctcacagctgcacagttggcatttttaagagacaccgttgggggagaagagggcgagtgctttgcagaagtggctgctctgggtagtgggggccagtgggcagcagcccccaggaggttcttgccgtgtgtaggggtccgactttggctttttcttcactgttcaagccaacaggaaatgccaaagagaaaggagcaaattctttctgagctgctccgccactgactcagaacttttccctgaaggagacagaatagagaggctcctcctcccccggcctttctctgtcaggaagcctatagctgttcttgtatcctgctagtttattttgtgtctgtattttgtctcaaaaccactcactcgggtatttgacatcaggcaccctgtgcctcttccctgcctgtgccttccctagtcagcccagggaactgcacctcctgctccgaggttcagctgctgcccatctgtctggacaggtggtgaaaggtgaggctccctctacaccagagccaccttgctagtatactgcactatttttgcagtcatctgttggaagacattctctggaggtactgagagctcctgaaggctttatccgtttctcatatatgaattatttttttttaagacggagtctcgctctgttgcccagaccggagtgcattggcgcaatcttggcttactgcaacctccgccttctgggttcaagcgattctcccgcctcagcctcccgagtagctgggattacaggtgcccgcaaccacgcctgtctaattgttgtatttttagtagagacggggtttcgccacgtttgccaggctggtctcaaactcctgacctcgtgatctgtctgcctctgcctctgaaagtgttgggattacaggcgtgagccactgcgcccatccttaatgcattaatcccctgcagtttgactcggaaggctaggatagagagtgcatttttccagacacgagaggagaaagaggcagagggatgaaatgtgagggaggaggacacgtctcacagtcaagacttccgccctccatcccagcctccaggacgagaggcatgagctcctatcctccgggctgttgagcaccgtcagcacaaggcagaggcacagatgcccgcttgggcctatttgggaagaatttaaattctagttcaatttagcacttgcgtttatagatgtaagttgtggcagtttgcattttatagtgatagcctgtaagatttttaaaatgtcctcagaaatacgtcttgatgttggggagaaagaaacctgttctagcaggaagctgctcaccttaggcacagcgaagaggaaccttccttttggcttcttgtaggacagcatcagcttgctgctggaggccgtgcggaccagaaatgaggagctcgcccagacatggaagaggtctgagcagtgggccaccatcgagcagctgtgcagtgagtacccccaccccctgccccggcaccccgtggctggggccggagagcagcccactctgcacagctccccactgccggtggtgccctggattccgcacccagctgcatcctggcaggtgccatcggcaatgcaacgagtagagactcggcctccctgccaggcacgtggcaggctccggtgatggagcagacatgttgtccaggccgtacgtcttaggtacacagccctgtaaattttataaacctgtacatcagagatactaatctccaggcatcctaggagcactttgaacatcattgtcttaagagaatcagaaactttatggaagcgccggaagcgtgggaccttttggtctccttgagaatttccctttagtgcttaaagctgtaaggaggagaagcctgcagcatccatgttgttgctggtggacactacggaacggaccgcaggcattgcgtgtcttccggaccctcagtcaccaggtcctgaacgattccccactcgtgagaaccttctgtcagcattgctgcagggactcctcacgcaccgtggtgcctcgtgcagcccgagtgccctgagtccctgcagctgagagcaccagagtgcccgggagctacggccctggacaaatgctagaatccttctgttaacacagccttcaaaagacacatcaaacacctttataccatttcctgtttttttttttttttttgagacggagtttggctcttgtcacccaggctggagtgtggtggcgtgatcttgcctcactgcaacctccacctcctgggttcaaacgattctcctgcctcagcctcctgagtagctgggactacaggcatgtgccaccatgcctggataatttttgtattcttagtagagccagggtttcaccatgttagccaggctggtctcgaactcctgaccttgtgatctgcttgcctctgcctcccagagtgttgggattacaggtgtgagccaccacgcccagccgaggttttcttttcacacaattctttgtttattatttttatttttgtagagacagggtctcactctattgccgaggctggagtgcagttgcacaatcgtaactcactgcagcctcaaactccaggctcaagtgatctttctgcttcagcctgctgagtaactgggaccacaggcttgcaacaccacacccagctaattcttggggctttgttgttgctttttatttgtttgttttttaaaaataattttaacttattttagattcacagggtacatgtgcaggtttgtcacctgggtatattgcctgatgctgaggttggggtatgattgatcacatcacccaggtactacacatagtacctaatagtttttcagcccgccctgctctttgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacatgtagtatttggtttgctgttcctgcattagtttgcttagaataatggccttcaactgcatccatgttgctgcaaaggacatgatttcattcctttttatggctgcaaaattttttaatatttttgtatcaatgaggtctcactgtgttgcccagactggtctcaaactttggcctcaagcattccttgcacctcagcctcacaaagtcctgagattatacctgggagccactgcacccagccctttgatgcagttctaacaatgacaccagtcttttttttttttttcttttttgtttcccttttagagacagggtttcactctgttgcctaggctggagtgcagtggagtgatcatagctcactacagccttcaattcctgagctcaagcgatcctcctgcatcagctttcggagtacctaggagtataaacatgagccactacacccaactaatgtttttggttggtgttttttttttttctttaagagatagggttggccgggcccggtggctggctcacacctgtaatcccagcactttgggaggctgaggcaggtggatcacaatgtcaagggattgagaccatcctggccaacatggtgaaaccccatttctgttaaaactacaaaaattagctgggcatggtggcgagcgcctgtaatcccagctactcaggaggctgaggcaggagaatcacttgacccaggaagcgtaggttgtagtgagctgagatcgtgccactgtactccagcctgggcgacagagcaagactctgtctcaaaaaaaaaaaaaagatgtggtcttgccatgttgcccaggctggtctcaaactcctaggctcaagtgatcttcctgccttggttcccaaagtgctgagattacagctgtgagccactgcacctgaccttttttttttcccccctccttttttttttgagacaggttctcactctgtcacccaggctgaagtgcagtggcatttgaggtcagtctcaccttgacctccccaggctcaaacaatcctcccgcctcagcctcctgagcagctgggactacaagcatgtgccaccatccctggctgattttttaaatttgttgtagagatgaggtctcactatgttgcccaggctggtcttgaactcttgggcccaagcgatcctcccgcctcagtgctgagattgcagtggtaagccaccatgtccagccaactctttaataataggcagttctgactggtgtaagttctgactggtatctcactgtggttttaatttgcatctctgatgattagtgatgttgggcattttttcatgggttttttgtttgtttgttttgagacaaagtcttgttctgttgcccaggctggagtgcagtagtgtgatctcagctcactgcagcctccacctcccgggttcaagccattgtccagcctctgcctcctaagtagctggaattacaggtggctgccaccacacccagctaatttttttagttttagtagagacagggtttctccatgttggccaggctggtctcaaactcctgacctcaagtgatccacccacctcggcttcccaaagtgctgggattataggtgtgagccaccgcgcccggccctcatgggttgttttgttttgttttgagacggaatctcaccctgtcacccaggctgcagtgcaatctcatgatctccacttactgcaacctccacgtcctgggttcaagtgatactcctgcctcagcctcccgagtagctgggactacaggcgtgcacccacgcctggctaatttttatatttttagtagagatggggtttcaccatgttggtcaggctggtctggaactcctgacctcaggtgatccacctgcctcggtctcccaaagtgctgggattacagacgtgtatacacaagacacaaagatcagctcaggatgggtcataggcctaatggtaaaaggtaaaactatgaagcaggctgggcatgatgtctcatagctataatcctaacactctaggaggccaaagctggaggacactgtagcccagaagtgtgagaccagcccacacagcatagtgaagccccgtctgtacaaaaaaacaatattaaaaaaaaaagaattagctgggcatggtgagtggtccacgcctataatcccagcttctggggaggctgaaatgggaggatcccatgagtcaggaggtcgaggtcacagtgagccatgattataccactccagcctgaatgacagagcaataccctgtcttaaaaaaataaaaactgtaaaacagttattaagttgaatctcttcagggccttggggtacgcaaagattcttttaggcaggatgcaggaccttggggtagaacacagaaaaacactggcataaaaataggtaaattgataaataaatttatctaaacaaaacacttgtgctcatcacagggcactgttagaaacatgaaaaggcaccaatgggggacgcagtattagcagtacatacacacaacatgacttctatctgaaacttaaaaataactctgcctgttgttaatcaaacagaaagcagaagaagaagctgggcggagggtgaaacgtttcacaaaaggaaatgcaggtcgggcatggtagctcacgcctgtaatcccagcactttgggaggccgaggcggtggatcatttgaggtcaggagttcgagacagccaggccaacatggtgaaaacccatctctactaaaaataaaaaaaattagccaggtgtggtggcacgtgcctgtaatcctagctacttgggaggctgaggtaggagaatcgcttgaacccaggaggcagaggttgcagcgagccgagattgcgccattgcactccagcctcggcaacaacaaaaaaaaggagatgcaggaacagtcactatcattagtcatcagggaaatgcaaattaaaacatgagaagccgttacacattcatcagtgtggctgaaatgaaaaaaacgcgacaatgtcaagtgtgagtgaagatgtgaagcagctgggactctcgtaccttgcgagtgggaggcaaaaccgtgccaccctcgcgagaactgtgtctcagggtcttagaaagttcagcacacaattcattaccctgtgggccggcagattcattcctaggtaggttttttgttgttgttgtttgtttgtttgtttgttttgagatctcggcttactgcaacctcggttcactgcaacctccgcctcccaggttcacgccattctccttcctcagccttcctagtagctgggattacaggtgcgcaccaccacccccaggtaatttttgcatttttagtagagacggggtttcaccatgttagccaggatggtctccatctcttgaatttgtgatctgcccacctcagcctcccaaagtgctgggattacaggcatgagccaccgcgcccggcctgttgtttgtttttgagatggagtctcgctgtgtcgcccaggctggagtgaagaggcagggtctcggctcactgcaggcttcccctcccgggttcatgggattctccttcctcagcctcctgagtagccggaacggcaggtgtctaccaccacgcctggctaattatttttagtagagaccgggtttcgccatgttggccagactggtctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattagctcaaaactggaggctgggcatggtggttcatacctataatcccagcactttgggaggccaaggtgggtggatcacctgaggtcaggagttcgagaccagcctggccaacatggtgaaaccctagttctaccaaaaaatagataaaattagccaggcattgtggttcatgcctgtaatcccagctacttgggaggctgaggcaggaaaaccgcttgaacccgggaggtggaggttgcagtgagccgagatcatgccactgcactccagcctgggtgacagagcaagaccctacctcagaaaaaaaaaaaaaaaaaaaagctggaaacaacccaaatgcacatcccccggggagttacgttattcacaaggagaagcaccctctgcaacaaaaaggaaccagcaagcacaggctccctgttactccctgtggtgcaggaggcatttttctgagggcattaagcacttcaaagtgtgcctgtggtgggagtgctgtgtgggcagcaccagcactgggtgggatgttgggggcggggagctctcagctgcctgcccctgcccccatgcccacactctggcagtctctggtgggccagaaatgatgagtgctcatttctcttccaccctgcaggcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaactgcctggtcctggtgtgtccttcctgcgcactcaactgttgtctggcatctgctcagtgtggggggatttgataacttgtctccaagatatcactgttttacgtgtatgtgcatggtccatttaaaggtggggatcccacttccccagccgatccctcccaaccttggctcctcgataagtttcttaaagtgctaacatctgggggaggaggagagtgcgtcagtgtttgacggccccgccgcccttgggtgcctcttctgcctctgccgcacctgtcagccctgcgactgccccacagtcactgctttgtggacaggtacatgtggtcaaacagcaggtgaaggacaaagcccaggaaggccagactgcacaggtgcagcaaggagtgaggcctgggggtgacacactgcctgtgttcctgcttgagctgtctttccctgtgacaacagaaagcgtctagaacaagtgctctctgagcctcagataggagcctggcagtcactgttcagcaccactttgtcctttggtcagtgactcatagctgacttgagcagttactaaaaaaaactccaactaatttctgaaggagggccctggggtgaagcaggccacaggacagtgaccaaggtgtcctggcttctggactccaggagcgagagggtgagtcccccagcacccggactccaatcctgcaccttcaacacagtgcagttcactcgatttacccacagctcctgggatcgcttgagcccaggaggttgaggctgcagccagctgtgatcgcaagtccagcctgggccacggggtgagaccctgtctgaaaaaaaatttaaaaagctgaggtgaggaggctcggggaggttgtatcagagaaagcagcagcctgggccatgcagtgagccagtacctgatcatggccgtcttatgtgagagccagtgaagatccttggcatcctctttggttcgatgtaaagataaaagccgggcgcagtggctcacacctgtaatcccagcactctgggaggccgaggcaggtggatcacctgaggtcagaagttctggccaacccggtgaaaccctgtctctactaaaaatacaaaaactagatgggcctggtggtgcacacttgtaatctcagctacttgggaggcccaggctggaggatcacttgaaccccgggggcagaggttgcagtgagctgagactgtgccactgcacactccagcctgggcaacagagcaagactgtctcaaacaaaaaaaacaaaaaaactgggtgtggcagctcacacctacaatcccaccactttggggaggccaaggctggtggatcacttgaggtcaggaattcaagactagcctggtcaacatggtgaaacccaatctccactaaaaaatagaaaaaattagccagtgtagtgatgtgtgtgcgcctgtaatcccagctacttgggaggccaaggtaggagaactgcttgaacctaggaggcagaggttgcagtgagccgagtttatgccactgcactccaacctgaacagtgtaagactctgtctcaaaaaataggccaggcgtggtggctcatgcctgtaatcccagcactttggaaggccgaggcaggcggatcaagagggcaggagatggagaccatcctggctaacacaatgaaaccccgtctctactaaaaatacaaaaaaattaaccgtgcatggtggcaggtgcctgtaataccagctactcgggaggctgaggcaggagaatggcgtgaactgggaggcagagcttgcagtgagccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtaaagcgctccaagacggagccgccgccgcgcggccggggcttttcactctgacgggcccgcgcgcacgatggccggcgccgcgccgcgggtccgctacctggcgggcttctgctgccctctcgggggcctggcggcgggcaagccccgcgtgctgtgccatgaggcagaggtcttcctgtccaccgggagcgagctcgtctacgtgtacgaccaggagggcgggctgctgaccgtgagcgccggcccgcgggggcgggagggaccgggcgggggcggcggttcgcgtgaaaatgaagaccgcgggcccgcgcgtcgcgtcggcctgacccgcgccccggtccgcaggcggcgttccggttccccgaccaggtgtggcacctggagctgctggcgccgcgcaggttgctgtacgcgctgtgcgcccggaggggcctctactgcctgtcgctggaccacccgggcaggagcaggtgagggcgggcccgcggcctccctcccgcacactcctgctgcccccggactgcttcagagcgagcagccccacctcatcgcgcttggggacccgggctgccgccagctctgaagcctcggccgccatccctgcccgattatctggagcccctgcccccagcactctttctgcaagtgtcttgctcacagtccttagtaagtggggttcacatggttaagcccacggcggggcgcgggatcctgtcctttgggccctggtggcccggtgctgtctggtgagacacgcccccgaggttgggtctttattggagggaggagacagcaaaggcaccgtgaccccgagtcagtgatcagtggacaccatctgggttggaaggaagcgagctccgggcagccaggcctgtcttcagtgcagagccagcagctgctgaccgcggcccaggctgtagagggggcagcctgtgcactttgcagcctgggcctcagcctgacggttctatgctgacaggtgtcggttcacgctggttttggatgcctggtacttcttgtcaagagtatccttcgtggggaaggtgggaggccatgtggcagatggactgctgagcggccttgggggtcactgcgggaacccctgagccagactactccatgccaggttattgtgaagagaacgtgggaatcccaccctgcccaggcctgaccagtgcgtccctgttctcaaaggtctacgagccaggatgacagggacagcgaggacggtgaccagccttcccccgtgatccctgtggaccccgatgcctgcatccttcccgatgctgcgctgtgcgcgttcaccttgctggacagtgtgctggtcaccctggtgcagggccctgcccgatggaagatgcagctgtttgagcagccctgtcctggggaggacccccggccaggaggccagatcggtgaggtggagctgtcctcctacacgcccccagccggggtcccaggaaagcctgcagccccccacttccttccagtgctgtgctctgtgtcaccatcaggctccagggtcccgcacgacctcctcgggggctccgggggcttcacgctggaggacgccctcttcgggctcctctttggagctgatgccaccctcctgcagtcacctgtggtcctctgtggtctccctgatggccagctctgctgtgtgatcctgaaggccctggtcacctccaggtcagcccctggtgacccaaatgcccttgtcaagatcctccatcacctggaggagcccgtcatcttcataggggccttgaagacagagccacaggctgcagaagctgcagagaattttctgcctgacgaggatgtgcactgtgactgcctggtggcctttggtcaccacggccggatgctggccatcaaggccagctgggatgagtccgggaagctggtgcccgagctgcgggagtactgcctcccaggccctgtgctctgcgctgcctgtggcgggggtggccgcgtgtaccacagcaccccttctgacctctgtgtggtggatctgtctcggggaagcaccccgctgggccctgagcagcccgaagaaggcccgggaggcctgccccccatgctgtgcccagccagcctgaacatctgcagtgtcgtctcgctgtccgcgtctcccaggacgcatgaaggtatgagctgctgtctaaaatgaaagatgggagcccagggtggagcaccctttttggctgtctgctactatcaggccgccttcctttcctgggcttgttcttttgcaaggctgacgggtgctgatacagcctagtggttaactctcttgtctcaaggtcaagccaggggctggtggtgggcctacctgttgctctgcctctggggtctagggtgtggccctgggcctggtaggatctgagtttgctgcttgctggctgtggacttggaggaaactgcatcttgggggtccaccgcaagcgcctcctgggcaggtcttatgtggcaagcagcccagggaggtctgttccggacttgcctttcttccaaaggctgcaaacgcttgctcgtgtcatggtgtggcttgcccgtgagtctgctctggaccaaaggcagatggcattgtggaattctagttttgtgttttccacagaaaaagccagagagggttttagctgtgtgtgcccagtgttggggtgagaggaatagagccacacacctcctaccagtgcacttccccaagtgtgctcaccttgtgagcatgctaataaatctcgccacagaaaatacatacacagcaggagagaagggctttgaagggaaacgccagactgtctccactgcggaagagagggctacgggtgggatcagagatggcgtggctcggggccactgacagaagcccagggtcgggacagtgcatttgccttgggactttctcttcctcactggacactggccttggccgtcttccaacttctttcctggagtccagggaaacaccaccgagtgtcatgctgcttgcccctcccagccgctgaccaggccccatgtgtgtctgtcaccaggtggcaccaagctcctggccctgtccgccaaaggccgcctgatgacctgcagcctggacctggactctgagatgcctggcccagccaggatgaccacagagagtgcaggtcagaaaataaaggagctgctgtctggaattggcaacatctctgagaggtgagcagctcagctcggaccgggtagaggctggcgctgccatccttgggaggtagcgtccctgtgtggggtcgtcctgggtgtgagtgtcctcgggtggcaacggtccaggccaggccattacttggcctctttttttttttttttttttttctgagacggagtctcacactgtcacccaggctggagtgcagtggtgtgatctcggctcactgcaagctccgcctcccgggttcacgccattcttctgcctcagcctcccgagtagctgggactacaggcgcccgccaccacgcccggctaatttttggtattttttagtagagatggggtttcaccttgttagccaagatggtcttgatctcctgacctcgtgatccgtctgcctcagcctcccaaagtgctggaattacaggcgtcagccaccgggcccgaccctacttggcctctttttttgagagagaatttcactctgtcgcccaggctggagtgttgtggtgcgatcacggtttaatgcaaccttcgcttcctgggttcaagtgattctcccgcctcagcctcctgagtggttgggattacaggcacctgccaccatgcccgggtaatttttgtatttttagtagagatgggatttcaccatgttgcctaggctggtctcgaactcctggattcaggtgatttgcctgccttggcctctcaaagtgctgggattacaggcgtgagccaccgtgcccggccgttacttgtcctcttaagatgtcttgagagcctcatgcgtcccactgtttggtgacaggctacctggctacctctggaagataagccgggactgccccccagcagcccaccctttctccctagtggggcacgggtagtacgtcccctgctgagtcctcaccctccctgctctcagcacaggatccagtgtgcttttcctcccgcagcactggcttcgggacgttcagagagaacacactgagtgcgcgcagcctcccctgctcccctcacataaccactggggtcccgagagcgaggggcctgtcactccgggtccctgtggtttagggctgtttctgtagcgcctgcgacccccctggttttcactgtgaaggctgcaagggagaaaagaggcccactaggaacattccggggagccaagggtggggtaatgcaccacccggcccctgcgtggcccagatgtgggtggtgcgcttctcatacctggcagattagcctaggtccccggagcaccagcttcatcctctgtcctctttcctcctgtggcccaagaggagaggtcaggnnnnnnnnnnnnnnnnnnnnnnnnnnnnnnnnnnnnnnnnnnnnnnnnnnnnnnnnnnngggctcggtgtgggtggggccgggagaaacatgcccctggggcgggggctcactctctggcgtggctccacacccaccgtgtgcttgtcgtggagccaggctcggtgcctaccaggcctgagtcaagatgtggcacctggtgctgtgggtgtccccccgctcccgggggtcatgtctgtccttcgcagagtgtcttttctaaagaaggcggttgaccagcggaacaaggcactgacaagcctcaacgaggccatgaacgtgagctgtgcactgctgtcaagcggcacgggccccagtacccatctcctgcaccaccagcaccacctggagccgcctgcagacacaggatgtgctcatggccacctgcgtgctagagaacagcagcagcttcagcctggaccaggggtggaccctgtgcatccaggtgctcaccagctcctgtgctctcgacctggactcggcctgctccgccatcacctacaccatccccgtggaccagctcggccccggtgctcggcgggaggtgacgctacccctgggccctggtgagaacggcgggctcgacctgcccgtgaccgtgtcctgcacgctgttctacagtctcagggaggtggtgggcggggcccttgccccctcagactctgaggacccctttctggatgagtgcccctccgacgtcctgcccgagcaagagggtgtttgcctgcccctgagcaggcacacagtggacatgctgcagtgtctgcgcttccctggcctggccctgccacacacacgggccccctccccactcggccccacccgagaccctgtggccacttttctggaaacttgtcgggagcctggcagccagccagcaggacccgcctccctgcgggccgagtacctgcccccatctgtggcttccatcaaggtgtcggcggagctgctcagagctgccttgaaggacggccactcaggttggtggcactgcttggctttgctcagccttggggattttttttttttttttaagagacaggaacttgctctgttgcccaggctggagtgcagtggtgcaatcatggctcactgcagcctcgagctcctggcctcaattgatct

SEQ ID NO: 1061 - DNA, 3082 bp, Homo sapiens
caggtggtcctgacaaccaagtccactttgaagggtaccaggtgtccaatcagtgtatggcactggtccgtgatgagtgtttgctgccatgcaaggacgccccggagcttggctacgccaaggagtctagcagtgagcagtacgtgcctgatgtgttttataaggacgtagacaagtttggcaacgagatcacccagctggcccggcccctgcctgtggagtatctcatcatagacatcacaacaactttccccaaggatccagtttacactttttctatttcgcaaaatccatttcctattgaaaaccgggatgtattgggtgagacacaggacttccatagcttggccacctatttgtctcagaatacctcatctgtgttcttggataccatctcagatttccacctcttgctgttcctggtcaccaatgaagttatgcctctgcaggacagcatcagcttgctgctggaggccgtgcggaccagaaatgaggagctcgcccagacatggaagaggtctgagcagtgggccaccatcgagcagctgtgcagcacagttggcgggcagctcccaggtctccatgagtacggcgccgtcgggggctccacacacacggccactgcagccatgtgggcctgtcagcactgcacgttcatgaaccagccaggcacaggccactgcgagatgtgcagcctccccaggacctagggcgcctgccctctgctggctaggaccgggcccagcccagcccttcctgaagccagaagcgttgctgagtgtgttccctgtaactgccccatagtgggcagccctggaggaacaaggggctggctgtcctgggctccctgacccactgaagcttctcagcacgttcctccctggagagcgggcgccacggctggtattctgcaggctgaatgcagtctccagactggaaacgcagagcggctcctcacgcctaatcctgttgacaagtcccccgccgtgttggaaagacctctcgcctctacgtggcacctggaattggggcgcacagggaggggcggatgctgccaccacccagccttctctttattttcagtgctttttgtttggcctccctgcccccatgtttttctggctgggagctcctggttacccccttgtctgactgcttggtggcaggcaccctgcctgtgagggccactttcctcttctagtagctgttgtctggtggggacgcagtggccctggacacggctcccctctgcaggtctgcaggtcggtttgctgcctgccctcctcctctcacccgatgtccaggtgggattttaaagtctgcattggttataataacagttatcagtaattcctgcccagaagacttttatttatttttttttaagataaaaactgcacaaaaggggagtgagagagactagtttccacatccttccctcctttagtgaagcccccgaggttgtgtccagggtgatgagtgtggacgggggcaccagtcagttctcccttgaagtaaacctcagtgcctgagacttttctaccaagccacacagctgcagcaactgcagatactgcgggctgagcaggagcagtggtggcgcctgccctgaggctgccctgcgatggcctgggtgggagagctgggtcaccggtgccgatgctctggccctccccaatacgctgcttcgtcccactgcaccgcctggctgagggcgttaggggctgtgcctcttgtgagggccatttgggacctccctggggcactgcacaattgatagtgtaccaatagagggagactgggcgatctggaacagcacgtggtggggtcctgcttgtgtgctctgcgttcctctgtggcgtggccaggccggggcctggctcttacccggggagtggtgggcatctcgatgcttctttgccttaatgatggccacatctgggctgctctgcacccacgggagaggctggcccagctgcagactgcttagggacttctgtgtccatcctggggggtaagcccacgtgacccacattcttggcactatgaacagagaacatttgcctgttggcttctgaagtggtcagggccatggctgacacctccaggtccgcctggcatgggacaccaagtggaaggcccaagcagctcatctgctcttgggaccaggggccagttgggttgggtctggtcacggcagagctattgtggagggtcaggaagggtggagaggagctgggttgaagcggactgctgcggatgcaactcccagcttgcccaccgcgggctgtctgctctccctcctagcagctgtcacactgaagttttgtcctctgctgtctcctctggtcctgagatgagctgtgagcctaggtggccaaggcttcctgcattgcttccctgtgagtccaaggccttcccccaccactgggcagaggctggacagcacggacttctagagagagccgcgttgccagttcctctcccactcgctcgtccttatccaccacgctattatagtttccgttgtcctccaccagcatttcccttactctgaagttccggcattcacatcattcatgttttcttttgtcttttagctaaaggaaaagcattggcgatttgtctgattctggttttgagttactctttgttcagtaatgcactttattttattgtccaaagagagtcagagctaagcatacaggcttgggggtgagccctgctgtgagagttcaggccctgggaggctcagccacctcctcttgtgggaaggaggtctcagccccacctcgcatcttcacctgcccttggtgtggacacaccctctcatgctaccagcaccataatccagtgggggtgactgggtgcacacctgcccaggtgaacacagcggctgccagtctcctggtcccgagaggaggtggggcctggccctggctccctccaaccagctgctcctgggacacaggtgctcctgcttcggctctgtttcggctcacaggtgtgcatcactgggcttggatttgcattacattgaccccagccctgcagtggaacctaataaaagcgcctgaagcaa

SEQ ID NO: 1062 - protein, 235 aa, Homo sapiens
GGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSTVGGQLPGLHEYGAVGGSTHTATAAMWACQHCTFMNQPGTGHCEMCSLPRT

SEQ ID NO: 1063 - DNA, 22262 bp, Mus musculus
  misc_feature (1)...(22262): n = A,T,C or G
ttcaaactgccatctcccctaggggacagcaccaggttactcctggcccccgctctagctcaggtgaagccattctcaaattaaatcacaatgagggacagcagagctgtaatgatctgtgtttatttagtaaatgggttgattgccctcatttgtggagattaagggttaatttcccaactgcaaagagaactgatttctcgaagggcaaccccaggtaattaagaggaaaaaaaaaaaacacctcaaatggccaccatgtgctccaccccacccccaccccacccccacccgacctcttcccatcctaccttagcctttgggtggcctcctctgccaggtactcaaagccctgggttctcagagttttctgtgcaaggatttggtaaacaaaggcttaggaattcttagccccctttaaactgacttctggcaaatttgagatcacgggacagcttctctctctctctctctctctctctctctnnnnnnnnnnnnnnnnnnnncttctctctctctctctctctctctctctctctctttcccctccccccccccccccgccccgctggctttgaaaagcaaatgttttaaggtttgtgttctctctctttcagagtttctaatcaagtggagtcaaaccactttgtctacaccttaattgaagagcctggctctagagtttaaagtgctatttataataataggggggaggcagggaagggagaaggaggagattaagtggaaatgtgaacggggagaaagccttgggcaagcgtcccttaagggaccactctgcatgttgaacagggatttcctaatagatcacacaagttgggtgtcagtcagcgggccctgggaagagacctgctcacctctgcactatcggtccatgagaatcctgactatcagggagtccttgcttagtccagaagctcccaaatagagccagaggctattagagccatatcacaaagcactctgggaaaaactcaggggtaaccagactggaccttagccaagggtgtggaattcatcaggagtgcccccccccccaagtctcttggtcactgaagtatttcttccttagaattctctagaaggactaaaaatgctctgtgcctcctctgggctggcacccactagaggagacagttcactgacttaatatattttttaagaaagagaaactaagcctttctttctgttttgtcatcaactatttaaaaccctgggttcatattagaccctcttggggagcttttaacagatgtttaaaacgagggaagcaggttttaaaaaattcatccctctaccgccacccctctgagaatcaacttccttcaaactccgaaaccagttccctcataccactgaatttagttcatgtatcccaagtctatgttccatttggaagagacagcagtgctttagcccgtggttctcaggatcccgaggtcttttgtccctatctgtaccctgtacagccgccttttgcaaagccaccccctcccccgacacactgaatttcatatgattgatgaacggcataattttatttcaaaaaagcaaatgtcaactttgtggatgacagagaagagaaacgaaatagaatcccaactctggtcacaaagctggaaggggaccgaagcattagagtggacttgctacaagtgcaatcctgtgggccgggcacactgtgatcaaatagggctaggttggctgtaaggcacagggaggcctcagacatcgaaaagaagttaattagtatagcatggtatcagagaccctgactccagtctctctctcctttcccaaattttaggtatcaacagacattaaggaggggatatctattgtgtttatatgtatgcaatataacacactatctcggatgcccacggcccggtgtctaccactgggaaagcaagaaagaaagcttcctagaccatatgtgcaaccaaacactggggctcctatctgtctgtcacttcggaagaggagctactgaaggacggacagcagtcccacaacatgttgaaggtggtagtacgccgtaacaaatttatttctcctcccgacccaggagaaagagacggcggagcttttacagataattcagttaatatcttgattgtagtcctgttatatttcccaggtttggtttgttttgttttcttgcttgctcattgttctgcagggtcttatgtatcccaagccagccttgagcttgcaatgagctgggtgtgatcttgaagttctgagatctgggattacaggttcaagctaccacactaggtcctgggcagtgctagggaatctaacccgggagtcatgcacgctaggcagccatgtacccaccggctgcacacagctctctgcaggactgaagctggcttgtcagctgggagtaaatgctcctcctgggctcccaggaaagtcagaagatgcccatgtgttcagctttttccaggtcctggcatagggctggtagagttttccctagaagcttagtaaaagataagtggtcaagtggtttcatcgggtcatggtaggattttgagagcaggaagagagccaggaagcagcccctgtgatttgggctcttcttcctctttaattcttttttattttattttattttattttattttatttttatgtgatcaggtgttttgcttacatgaatgtctgatacctgggggaggggcagggcagaagaaggtgtttgatccccgggttccctgttgtgagccaccatgtaggtacttgaccttgaacccacattcttctgaaaacacagctagtactcttgactactgagatgcctctccagatatcctctcttcttaaaatatgtggattttttttgtcccttccttacttctcgccttcctatttccccttttgccttcctgttgttccttctaccgcttctgctgctaccatttctacctgcacagttgtctgaacagcacttgcctcctccaaatttctcctgattcttgatttttgcttttctgttcactgtgtatttacattagaccttcctgaaaacaaaggatgtaattaggtggccaatctgtatccgcagatacacctgttggacaatggtctcatgacagacaacctccaggctctgtcacattatctattcatgactcagtctttgaggtcagggttcatgtggtccaagagggtaatgtcggtctgaggaagtgagctgtgggagtagcagctgtctcacttcagaatagcagcagtgaacttgagcctcatagataagatctcagaagctaacatcacacattcagtcacttgtccaaccctctctggcttcacctccctccctcctctgtctctcttctctctctctctctctttctctctctgtctctctctgtctgtctctctccccccattacacacagacacacacactgctcatttacaattttgatatttgtagccttcagttcaaaatgaaattaggcagagtaaggactctgtgagactgaagaaattctgtgtagcaacagtgacaatgcactggtttgagatagaagtccccaagccttactaacacaaaaaaatcccctagtgagctctgaaaaactttaaatcccaaatcctatgccagaaattctgacccaacatgatgtggtggggttaagcttctgaattcccttcccttccctttttttttctctccccttcccttttctcccttcactccccccaccccactcttcagatgattctggtaaccagctaggtgcgagctctatggttccaactcccatctttagtcttctagaagtttctttgggggcatttaccactgctactatgagtccaccccctgctgttctcctgccagctctctgctggtagggcctgcattctcttatagggatgacctgaaaactaccaagtttcctgcctgccttagtgacaggagtgaggttagatgcccactagggcagtttcagcagtaggaactcctttgttcttggaaaactagagtgaattgatgggttcttataagtgggctgaaacagcagaagtaacactcacgggcatcattaacgtaggcctgagtcttaggtgccaacattctaaggcttctctgtattaacaacaacaacaacaacaacaacagagattagctgtgtatgccacagagtgcttgtaaaaaccgctgtataggttttggctttagtctaggcctggcttctctagggagcatctaccaggaatctcccagggttgttaggaaattagacatagtgtatttatagcacctggcacagtacaagcagtggtcattatatttaaaatgtgactatttggatgctcaaagcaattggaagagaagctctataagcccgttagtgccctagagcagacaccaagggtttcctgtgtgcacattttttcaactccgagctcactgacaacatgttgggtcagccaccatagcagcagtatctataccttggaaattggggaaagtgcagaccaaagtttttctcctaggcaatcattagaaacatcctctagcatactgctataatatatactataatataatatattatgtgttgcgcatccaaatagccacactttatatatcacatatacaatacatatatattacacacacacacacacacacacacacatatatatataacttcagcaaagaccccaagccacagatacactgctaaatgggccttttatttcatctcatgctttgcatcccataactaaaccagaatgctgttgtgatgattttcttgtgtttgggtcataagcaccttacagctcttacaccattaatcctctccacacactggagggaactagggaagttaggtgactggcctgaggcaggacaggaattcagtagtgagaaccagaaccaagccagtctgctctggccacctctgcactcagcccacaccttagtgccacacagagtggcactgagatgcaggtggcaattacctacagtgctgttaccagatggcccaagtctctctcagactgtattgaaaaggctttgtcctctgaatgtagacagggtccccatggagtgccttactccctgcacccagaggcttttcctagaactgtgtttgagaaaagtcctccagggtcaggattctgttctgacagtaacagatactgtagccagtcagctctgtgttctcattcttgggccgcaaggccagcaggccaagagctgtttctctctgtgtcctggctacacaactctctggcacaagaaataaccttcctcgtaatcaccttgagaagcactccaaacatccatccactgggatcttcacaccttgcttcatccctgttgcctcttaagtgagggtaacctaaggactcttgggattaggaagactgtagcttcccttgtgagtgccacagtccagggcattccaactctcaccttctcttacccccacactcccagtgctctctcctgctgagtcttcaccctgaacgaagtttcatattttgagtgtgctaggggagggatgaatgacaggaaaccgatggctttgaccaccagtgtgtaaaagcctgaggcgggctccatgttattcgagtttgggagtgggacatttgggaggcagaggtaggtggatctccgagttgagttctaggccagccagaactacaaagagaaactatgtctcaagagacagagacagagagagagacagggagggagggagagagagagagagcaagcttcaatgaagccatgactaaccctgcttgcaatgagcagacagacacaaagccaggccaagctaagtatacccaggttcctaacacttagaaactgtagataccaagtatttgttctttcaaagctgctaaattgggaactatttgttatacaaccataagtaactcataaaactcttggtcaagaaaaaaaaaagttggtccaacaaatacagtaactgagtctgcgatataaagcacctctgcccgcccaccaaatgtgagcaccactacagcactagtggccttccttgtcttcaatctggacatctctaacttccataacatttgaaagtaatttaaagataaaaatgtttgggtagagaacaagtcaacacccaaactaaaatgaacacaagttggtggccacctggcaattagatatctcaaatcttcattataatgccaaaatgtctggcaaaagagaggtcagaaagatgggtgtgtgctccaaggtgcctttctggccttccatggattcttgcagccagagtttcattaccagaacgggattgtggcaccacgtggccattttcaaatctgctctgacatcagaatgtaattcagctagataaacctgggacctagccaaaataagtagtacttggaaaaaaaaaatggagctagtgactaccaccactttctttgaggccatatatgactatgatgtgaagaaataaaggcctttgttattttaaagggcagggacaattggaagttttgcagcagacagttacaaaattttccacccttggctttccaaagaagataccagctttgggagctgggtgtggaaggtgttgtttggaaagaaaattaatcccagggagagtgtaaaccaacattgcctcacttgtcagagagcctaaaacagacttggctccttacatcgtgaacttacctcttctggtctgctgctttatggcatggctccttgaaaccatagcatctcaaaactaaagataccttcttttttttttttttcttttttatcatagcatttgacatgaggcaggcatagaaagtttcagcattgtctcacaagcagatctctctctctttggcgcaaatgtgcgcagttttgttttgaattagaatatcactaaggagctgtctgtagagcaggctagccccgaactcatggagatccaaccgcctctgcctctcaagcactgagattaaaggcatgtgtgtaccaccatacctggcacaagcagttcattctctttttcttggagtaatttgggatcgaggttatttatttaattttgtttgtttagtgtgtgtgtgaaggattgaatctagggccttatacattaggcaattgccccgtactgagcgacatctccaagcccaggccgagtgttgccgttgttgttgttgttttaaatcacctttaaacagtctccttatcctagctcgctacctttgcttctccagtacttttgctcttctctgcctgggacagagagaaaggactcacctctgtgacatctcatttaggatgggtttcctgtacctcgtgcatagactgctttagaactatttcatttcttcctataccggctcatctcaccccctcttgctacatcattattcctattgcctaacatcagagctgtctgggactctaaggatgagcagctcatccgctggctggtttccgctgtatttgaggcagtgctctatcctgtccgctttcatattttttgacactgcttggtatttctccctcaattagcagatatgagttaggtcagtgatctgatgtatgagcatgacatttttgtcttaaaaaggagggcatcttgaacctcagtggggagaaggaatctaaactccaccacccacactttcaatgacaaagcaaaacagcccccagtgtcttaaacatcttcccacaaatatcaacacagcacagctgaaggtaataggaacaataatttagaaagcagaagatgaggtcttgaagactgtatattttttaaaaaggaaaacgttgcttattcatctttattactttgaggcagatactctaaagggggctggggattggtgtgaagggtaaactgagcttagaaggaaactggtcagatggagtatgtcaactgtctgacaccaccttgttccatggagctgggctcttcagaaacattaacaggagcacaaaagatgaagaactctaaagtggaaggaaggggctcaatgaacctctgaggtaaagtaaataaaagaattaaaaggagcccaggtcatcgagaaaagggaatccaattaattaactgtcttagatttcagaatcaaccttttcctagatggagaaactgtataccagagggagttacttctgccggcattcaacattcgacctattcaaaatctcctcaaaccccagcacccaagtgagacaggcagaaggactcagccaggaaaaaaacgtttaaaatgattgcagagacagattcaacgattcaacttgtcactttcctgcatgggaattcatagtattcatgatatttcttgctggctcctgtgagagggcagaggccccttagtaacttctgaccggtcggggcaatcagacaacgcgcacgagcgcccagtgcctggagcggggttaagatttgaccaagaacaaaagaaagcttgccaatcagaaaatgctaccccacaaggaaaataacccctctttgtgtctcgaaagccctttaattagcaaatgccctgctttttaacgcgcgttaaaacatttctatgtagattccaaatggaaagatcaaatggttgcttctgcaacgaagaaggggtccctgaaggccacacacctcagaaaaaaaaaaggaaaacggggcaaccgaaggcgctctgtaaatcgtacagagttccgaggccctcggtctcaggttactttcataagcattcccccagagctgccttggagttaaaaaaaaaaaaaaaaaaaaaaaagagcctcttgggctccccaggctcccagcagtatgtccgggaggggtggcaggctcgtgtgtgcagcggatccccagctctgggccttctcctccgagggtctgcacttcctcccgccacaagtccgcccctcggccgactcgggtttctccctccaggatgccccccttttttgtaactgggggagggagagggaattgtgccttcacgtggtcggttggggtaggggaagaaaaaacgattcttagtcgcacccctttctcgactcatactgatgctaaccaaaattctcccgccctcgcctgccaggcaaggctaacgtgactccgggtcacgtctttctgccctggtgctgtactattctcagcttctccccaaagccttcggcgaatgcccccttttgttcggaaatgtgtattttagggtacccggaagaggaaccaatcttacaggcaagttccctttctggtgcgtttttttctcccttgagcaaattctgggtaaaagtttttcctaacttttctctcagtcccccgcccctcccctcaggaatccgcccagagctctttaagcaccgccttccttgtttcctcggccgccccttccgacttccacccaatcggaacaggtccacagagaaaacaaagcgcgctattggatgtccagagggctcggggcccgcccccggagtggtttgtgaatggggggaggggagggggcggggcggcccgcagccctgcaagcccgacgcttcttctagccaccagtgcggctcccaggcgttactccgcgctccttccctggcgggcggtgctggacgcggagagtcgcgggctgggactgcgcggggcaggagaggccgggtgcaggcaggccgcgggtgcaggggcctcggcgcttcggattccgtgcaactccgtttccaaaaccagcttgtccagctcttacctcccgagcaccgatcagactcaaagcgagaacgagccatttgacttgaaacttggggccgaccttcctaggactgaaggaggctccagaatcagaagaggcggctgcagtggcccgcggggcctcaaggagagaaggcggagcagcaccaccgaggcgacggccggggcgagcaggcagggacgcagggcgctggcctggcggaggcctggctcggtttaggggacgtgcgtatcggcgtgcgcccggggctcgagaaacttgggcaaactttgaagggtaaccggagaagcttgttgctcgtcgccgcagagaaagccgcaccgttacgtctcggcggggagggtaaggcgacaccccttccctcgatcccccactccaggcccaggagtttgaacctccggcggctgcgtgagtgccacgcggaggcggctgcggcgccccctcggctggcggcctcgcccccgctgtgcaggcaccctagcaccctcggctccgcgccgcccacggcccggccccggcgccgggaggactctcatgcgccgggcgcggcggcgcctccctgtatccaagcctctccccagcgcctcgtctttttcctccagctgagaacgccgctgcactcgcgaccggcgatgcggggccccggcacggcggcgtcgcactcgcccctgggcctctgcgccctggtgcttgctcttctgggcgcgctgcccacggacacccgggctcagccatatcacggcgagaaaggcatctcggtaccggaccacggcttctgccagcccatctccatcccgttgtgcacggatatcgcctacaaccagaccatcctgcccaacctgctgggccacacgaaccaagaggacgcgggcctcgaggtgcaccagttctaccctctggtaaaggtgcagtgttctcctgagctacgcttcttcttatgctctatgtacgcacccgtgtgcaccgtgctcgaccaagccattcctccgtgccgttccttgtgcgagcgcgcccgacagggctgcgaggcgctcatgaacaagttcggcttccagtggccagagcggttgcgctgcgagaacttcccagtgcacggtgccggcgagatctgcgtggggcagaacacgtccgacggctccgggggcgcgggcggcagtcccaccgcctaccctactgctccctacctgccagacccacctttcactgcgatgtccccctcagatggcagaggccgcttgtctttccccttctcgtgtccgcgccagctcaaggtgcccccctacctgggctaccgcttcctaggtgagcgtgactgcggtgccccgtgtgagccgggccgtgctaacggcctcatgtactttaaagaagaggagagacggttcgcccgcctctgggtgggtgtgtggtcagtgctgtgctgcgcctcgacgctcttcacggtgctcacctacctagtggacatgcgtcgcttcagctatccagagcgacccatcatcttcctgtcgggttgctacttcatggtggcagtggcgcacgtggcaggcttcctgctagaggaccgtgccgtgtgcgtggagcgcttctcggacgatggctaccgcacggtggcgcagggcaccaagaaggagggctgcaccatcctcttcatggtgctttacttcttcggtatggccagctccatctggtgggtcattctgtccctcacttggttcctggcagctggcatgaagtggggccacgaggccatcgaggccaactcgcagtactttcatctggccgcgtgggctgtgccagcggtcaagacaatcaccattttggccatgggccaggtggatggtgacctactcagtggagtgtgctacgtgggcctgtctagtgtggatgcattgcggggcttcgtgctggcgcccttgttcgtctacctcttcatcgggacgtccttcctgttggccggctttgtgtctctctttcgcatccgcaccatcatgaagcacgacggcaccaagacagagaagctggagaagctgatggtgcgcatcggcgtcttcagcgtgctctacacggtgccggccaccatcgtgttggcctgctacttttatgagcaggccttccgagagcactgggaacgcacctggctcctgcagacttgcaagagctacgctgtgccctgccctccgggccacttctctcccatgagccccgactttacagtcttcatgatcaagtacctgatgaccatgatcgtgggcatcactacgggcttctggatctggtcgggcaagaccctgcagtcatggcgtcgcttctaccacagactcagccacagcagcaagggggaaactgcggtatgagccccggtccttacccacccttgcctcttctacccttttacaggaggagaggcatggtagggagagaactgctgggtgggggcttgtttccgtaagctacctgccccctccactgagctttaacctggaagtgagaagttatttggaggtgagaagagatttggggcgagagatggttttgagaggaggcccagatgaaaaaaggcaaaggcagtggccgaaaagacttctggctaagacttgcaggacgatgctaactgtgaaagatatggaccggctagggcctaagggaaaggttgagaccagcagagagagagactggtgaggttttcaggcgccagagatgagccagggctgtgagtccaatcccctgctgcaaggcaagtggttgttctcactctagtgaaggggggctgggaggggagggtgataccgctctgtctgtagcctaggctttgtggccaagatgggggggacctcctgcggtgcccttgtcaagtggtggtcaaaccataatctcttttcactggggccaaactggagcccagatgggttaatttccagggtcagaccttacagtcctcctcccgggccccctcccgcctgcttttccttccctactcctttcaagtctagtaaaataagcatttggaaggccgggccctgcctgctagagtcctagcgtgaagttggttttcaagaggaggccaagaaggcgagtgggagatacagtctgctactttttaatttgttgctactttttcattttctagggaaggcagagagaaaaagaatgttttatttggtttcataccctgaaaaaaagtcatgacttgttgcttttcaaaacaggaacgcattcacacacacacacaccccatcccaccccccttgtctttgttgtaagagacaaagcgggaaacaaaagtgtctccctgaggaaaggcctaactgtgaagccagcagcttttacaggcaaagccacagaaatccgaggttttcctttggttgttaatttggttgagataaacattcctttttaaggaagagtgaagagcagctttcatacccattcaggcacacgttctgacttggataaaggaaatgctaggagttttgttatttgttttaaacagatttaattcagaacacatgatctaatagactcgtttgcttaatgaaatctcctcccattctacgcccccataacccaaattttgatttttctgcccccttccttccgtccaatttgggatttttgctgtttttgttttgttgtgttttgtttttcctccagacagggtatctctgtgtagccctgactatccaggaactggctctgtagagcaggctggctttgaactcacagacatccacctgcctctgcctctcaattgctgggattaaaggcatggtccaccaggcctggctccccttcctaatttgtatctttcaagacataacgctcacattagtaaagataaaagacaaaaattttaacttaaaggtttaaaagcattttgccctcattttcttgttctagagatgtaaacatctatctatcagacacatgagctgaccctttctctctctggttgcatgaggcgagggcaagaggaatgatagcgaaggaagaggagagtttgagtcaggtttcaagaaagtcattaagggaaggtgaacttcaaagtgattctggagttctttgaaatgtgctagaagacttacatttattaatcttaaatcgtgtacttctctttttttccctgcaatagaagtctggttctttggcataatgtaaagctgagcagagcatcatgggagttgacctttaccctacctttgacactgactgtcctccaattttgcaatgttcttcagtttctcagagcagtttttaatgccagccagggggggattgtcgggaggacagattacttcatatgtgtcctgttcagttgaatggagctgcttttacaattaaagtgatcttgtattttttaaactttcaaagtgatctcacctgtcagaatttttttaagctgccactacacaggtttggcatcttttgtgttttatctctttaagtgcatgtgaaatttgtaaaatagagacagtgcagtatgtatattttgtaaatctcccatttttgtaagaaaatatatattgtatttatacatttttactttggatttttgttttgtttacctttaaagatctacaatgaagccccactttatcacatgtacagatcacgaataaattttttaaaaaatacaaagtgaatgtttatttactcttcctgagatagtaaccaaagaataaaacttttacgtgggaaggaggtggagcgagtgtgtggggtgtgtcctgtcacatagtaccttagcgagggtcacaaaagcttttgggtttgctttgttctcattcttgtttcctgtttccaccaccacctccttatttacctctaagccagccgttctcaacctgtggattggacccctttggggggtcacatatcagatatccttcatatcagatattcacattatgcctcatgacagtaacaaaattacagttatgaggtagcaaggaaaattgtatggttggggtcaacacagcatgaggaactgcactaaagggttgcagccttaggaaggctgagaaccactgctctaacagccttttcagggaagcttttgaggaccgactagaagtttagaatccaagtctgatctgtagtttactaaccttaggaatctaagctcgggtttgaaaggactagaagatatttttgctatttctacttttcccattgattgtcttgggaaatgtgtgtgttgtaatgcaccttatctaaattattgatatttaaatgctttgaattcaggtgatagggaaaagtttccatgcttccagatgagcgcaggggtcacctttgtgcagaacactcagctggaggcttccctgaatcttctaggtaaattgaaacaggctcagcggctctccccaggggcagtgactcagcagctcagcaggactagtctccacgcctgaccccgagctggcctcggaagacactgctctcctttgctgcactcagagaggctaactttggaatcagacgcgcctgggtagcccctcagggaaatggtgaaggcgtctcagactcccagttctaagcctgagagtctttccatttgcttcttgtttagttcaggtgctgatgatactgtatgctctccccagagcaggcgctgcactgctgtctctcccattccgccacaggctggaagtttctgtagttctaaagtgtaacagacacagctctgggtttgttctgattaacaggctcacacagggcgggtgtcttttacaaacggaaagaatgaaaaccaatgacagacagccctctccaggaggagaaaggctagctagacactggtgcaaagccgctttggttgtttgttttggtgtgtgtgtgtgttttatgagtttcctagattctgaacaaagatttgggcagcaaggagagaaaaatcggtgacttgaatctcttaagatttatccagattttttgtcataaactgtcaagttttaggtaaaccatgcttttcctaacagggaattaatacaacctgttatgaatgtttgccttcagattagctagaaatagcttgatgctttccttctcctcctcctcccccgtcctcctcccccttcccctcctcccnnnnnnnnnnnnnnnnnnnncttccccctcttcctcctcctcctcttcctcctcctcctttcttttcctttttttttttcccttattgtaaacaactgagaaaggcacttaggcctttccaagggaatcctcaaggctgctcctaagaacatttccccaccttgcagttcacagctcagcgtgatggaagaggcttggtctctaacacgggaacaaacacaaacgcagcatgtgaagaaatccctacctgctcttgttagcaagaacctctcatttctttctgttccaactagcatgccctgtgaggtcagccattgcctaagaattttagaaaccccatgggttttcttaagaaattgcattttagcagaaactccatagagggagagcgtttgcaaaggggcatatatagagtttaagaaaaacattggcaggagtttgtaaatccctagataaggaacaaaaacactgaacatttttcttcactttatgcaaacaaaacacaacagtgcagtgtaacacctaatcttggtcactgggtttgtgagaactcttgggaaggaagggggaaaaaaagcgtcctgttcacattttaggattattttttcaagcgtacttaagataaaatagtgacactggagattctcttggtagaactagagtaacctaacagctgtaggtttgaggcctgtaattacactcagaaaaatctcactctcccatctttaatttcactgaaaaggcagatggctatttatagatggtatatttttgtatatgcatatgtgaacggtgaataacagtctgcagggctccaggaaatcctagaagagagtggaaccagcccagtgtgcacttacccagcagatcctagatttgtagtgcttattttttatgacacaggctagagtcgctggaaggagggaacctcagttaagaagatgcccctgccagagtagcccacgagcaaacccatgagtgatcctgcagcctgtgagcaagcctgcagcctgtgagcaagcctgcagggcacttccttgattaacgattgatgcaggtgggcccacgggtgggaggtcctggatggtaaagcaagcaggttgaccaagccatgaggagtaagcctccacatcagttcctgcctcgacctccctggatgacaaactacaagctgtaagatgaaataaacccctttctgaagatgattttggtcctggtattttatcacagcaatagaaactctgtatctctttttgttttttctttatttctgcttccatggtgaattaaactgatttcaaaaacaaaacacaaaaaaatctcattactaaactctttgataaacatatttcttattctcctctgttatcttttgtatgcatgtggggaatacgtgggtgtgtgaaatatgtatgtgagtatgggtgtatacacagctgtgtatacacaggtgtacacacgtgtgtgtacagaggccagaggctgatgctgaaacaagcctctgggcagacttggagctcatctgttctgctaggatggctaggcaatgggccccagtgagcctcctggctctgtcctctaaatcctagagttacagtaacaactcacagcttttacatgggtttgagggcatatgtgtcttacatgtgtgtgatccttgtagttgtggggtaagcaaaccgtctctccagtcttttctttgaggaatatatatatatatatatatatattcatttattcttggaattttctcaatatagtagtgaaggggaagcaaatttgatggtagtagttagtttattctatgttccatttcaaaaactactgatcagcagccaggttgaatgaacaggtgaaagttcacctaaagtaagtccagacccagttcagagtgacctcgtccctcaaggaaggctgagcagataaaaagtcatgatgctggagagaactgacaggcgtcaggacagacactcaaatgacatctcaccttttctaccggttcatcatttgacttattcttacagttaatgtcaatcctggagtggaaagcaattacccattgaaagattagttggtgaatgactcttcaccagggctattcggactgtacagagtttattgaactctatagtgtttaggacccagcaagcgtttatttgaatgactgctctaatctagctgtgtgatgtgttcactggcgagttcattacaaaaagtgattttttaaaaaaatatcagagaggtgtagagatgtaggaacagggagagtggttggtgtgctcggttggactggctgtgccatctatgctctctgtaatctgtagcctggcctactgcaaggtgctacacaggtcagctcagtcaatcacagagaggggtccaccaaggatttgttcctgtgaagctaggttatgtggcattctggaactcttgtgttcttacattgcctccttctcctctgtggggttgctctcctcatctgagaagatggcctctgaggggacgaacttcctccagccttccagtggcagcaaacacaatcatcattgtacagtatactaaactggtatatctgtctgtggagcacccacggctttcataaaatgccagaatgattggtccttccttcctgtaggtctgcccttccgccaaccaaatgagtatgcgctctgcatctacagaaggcactttagacattgggggatggaaggtcacatgactggaatcctggcacagacagcttcatctcctcactatataaccaacccgcagggttgaatataatgggggtcaaggcagctgtaatgccagcactggagaggctgaggcaagaggaccgtgcgtttgagacaggcctggctgaagagtgagagtctcagaaacaaacaaaggttttattccgtgtgctcttgatttcttcccaagcatgtggtcataacatagacaggtttagcaaatttcttggaaattttgctgctgggtattttagtaccaaatctatactcaaatgcttgaaatgatagggacagacatttttgctcttgaccagttagttacacccaggcaggaattaaatgtttctctaggttcctaaaagcctctttcaagcgcttcctaacaagataaactggaagctgtcgtgaggggtttacgcgtgcttccgccgagggtccacttacccataggatgcttcgcgcgctctgttctactgctttgctggtaagctgccttcagtgctttttacctgtgaagcctctggcactggggtcagcttggagttcaaggagtctccagagataagcatatctggagcaagaaaagacgtgtaagaaacagagacaaagagaggaggggccaagagctaagttccatatacccatgaagaaagagacaagctatccaagtgatcctgtactaccctctcctggggaatttgagctccaaatttggccatgaagggtctagagtccaattgaatcaaaaggaaaagcttgtttgggagggtcttgtagggcagggagtagcaacagtggcaacaagggaggcacgtgctgcgcataacctagcaccaaccatacttttttatttgggggagggagcggaggtcgtgcacatagctggagggggcaggcacataacctgtagtgcttgtttccaggtctagagttgctggaaggaaagcaagcagcagctagtccctgattcactttttacagcagatgtagagagaaacttcagctagaaccacaattctctaaagctccaaagaacagtttctagaggatctttccagtgctgggtgtcaggcaggtcctgtgctctgcatggtgactggtaggacttaccccagcctcagccaaaacagcatcctgcaaaggcagcaagcaccctgtccgctcaggcaagggaccctagggtctgaatggaaaacactgcattctgtattttcaaagcatctttctttccttgtggacttaaaatactaacaaatcagtgggggggaggggtaccttgaatgctttccaaagatggggaaaccacagccgtggggctaaaggccatttattcaatgtcccaagtaatcccaagccaagccacagagaagcatccactcagatctccccaaaactgattctggttctttcccccagagcaaaaggacttagccatgtggcatgatcaaagcagagagggcaaaggggggcaggagagtagtgggtggtgcgtttgcactggctttgaggagaggagcatgctgggatgtgcagactggctcttgtgtgtccttgataacggtcattatctttacagttcttaacattttctgagcaccaactatatacaaagctatatgttctgggtacaatatgacagagtgggcaagacaacgtaccccaaaaccctaactatagtatttggtacctaacaagtactcagtaaatatcaacatctttatgataaatacacaatgatctcacacattataacagccctaggaggtaggtacaattacccccagttgacgtgtggggaaactgatccctggaaggtgagcctgagagtggctctggttgctgcccctaatcaccatgccacaaatatttactgaggccttaatgtcttccattctctagtgtccctctctaatttaatccagatcccttccaacgggagggaaataacttacatcctgacaggcagaaccggggaggggattttcagtgctagttcccaaagagtatttgggttttttcttagaaagaggcaggaggttcataaatactgtttagatgctttcttcttctttttgtgttttgagaccggcctggctgtgagctcagtctggcctggaacatgtggtctgcccgcctctgcctcctgcgtgctaggattacaggctatgcaccatcacgacccagacagctcatcctccttgcccaacacgaatttctacatcaagactcaaagacatagacgtgagaattaacttgctctatggggctagaaacgcattctagcatgtaagaagtcccaggctcagtccctagcaccaaaacaatgcacgaggcctgaagatcacaagttcagatcatcctctgcttaggatacatgagatcctgtctttagatagatagatagatagatagatagatagatagatagatagatagagagataattaaaataacttagggatggtgctcctaactgtccctcaattctgacaaaatcaatcaatcaatcaatcaatcagtccctggaatatcccaccaagagccacaaccgcaacaccaggcatgtgaagcccccttccaaattcctgggcaggggagtgtaaaacattgccaaaacaacataggccattgccattttacttgtttgcttccagaggttgaaggtaggtgcctaatgctaaagacactacagacttagaaaacaggacccagaaaacctgagctagatgcgctctgaaagcctcctccatgaggatgcgctttcgggggaatggaaggagtatgcaagctgccaagggggagaaacaagcagcagtcctccccagctaggaaccacagtgacaagcatggtgcagacagtagagtcacagtactgctcaggtcctggcagtcaacaacagctctctaattgggctaaggatcactgacaaaaggggaatcgtgcctgctactaggagccgaattgacgacccagggctggggaggtctcggatcttagaggaaagcctactacggctgctttactaagccagcataaattttaactacattctaaatatttatccttatatccattataggcatatatataatgaatttaagagggagcaaagaggacacatgggagtggttagaagaaagaaagagaaaagggaaaatgatgtaattatattttaattaagtatatatatattttaaattatatgtagttaaatgtataaaatatatataataaaatgtaatgttaaatagaaaattttatatttataaatacaagtttatatttaataacataaaatataattaattaagtatggcttttatataagtaaatataaagtatatatatatatatatatatatatatatatatatatatacactttcctaggaggactcctctattgcggtagtttcttgcttcctcattccagccctgaaggagagggtgggctctaaacagtgggacaaagattcggtgggaaagttctggcttcttgctgaccagcgcaggctgcctccctccccactggtgagtcaatgattgggaacacagacaaaaccaacgcagctccatggatatcccctctctccttccctggaggccaaggccaggagtcacagaaatacttgtttacactgttactgccacatatatataatttcagtgtcatcatggtgcaattgtgctactgacagctatcatttcat

SEQ ID NO: 1064 - DNA, 2262 bp, Mus musculus
tttgaagggtaaccggagaagcttgttgctcgtcgccgcagagaaagccgcaccgttacgtctcggcggggagggtaaggcgacaccccttccctcgatcccccactccaggcccaggagtttgaacctccggcggctgcgtgagtgccacgcggaggcggctgcggcgccccctcggctggcggcctcgcccccgctgtgcaggcaccctagcaccctcggctccgcgccgcccacggcccggccccggcgccgggaggactctcatgcgccgggcgcggcggcgcctccctgtatccaagcctctccccagcgcctcgtctttttcctccagctgagaacgccgctgcactcgcgaccggcgatgcggggccccggcacggcggcgtcgcactcgcccctgggcctctgcgccctggtgcttgctcttctgggcgcgctgcccacggacacccgggctcagccatatcacggcgagaaaggcatctcggtaccggaccacggcttctgccagcccatctccatcccgttgtgcacggatatcgcctacaaccagaccatcctgcccaacctgctgggccacacgaaccaagaggacgcgggcctcgaggtgcaccagttctaccctctggtaaaggtgcagtgttctcctgagctacgcttcttcttatgctctatgtacgcacccgtgtgcaccgtgctcgaccaagccattcctccgtgccgttccttgtgcgagcgcgcccgacagggctgcgaggcgctcatgaacaagttcggcttccagtggccagagcggttgcgctgcgagaacttcccagtgcacggtgccggcgagatctgcgtggggcagaacacgtccgacggctccgggggcgcgggcggcagtcccaccgcctaccctactgctccctacctgccagacccacctttcactgcgatgtccccctcagatggcagaggccgcttgtctttccccttctcgtgtccgcgccagctcaaggtgcccccctacctgggctaccgcttcctaggtgagcgtgactgcggtgccccgtgtgagccgggccgtgctaacggcctcatgtactttaaagaagaggagagacggttcgcccgcctctgggtgggtgtgtggtcagtgctgtgctgcgcctcgacgctcttcacggtgctcacctacctagtggacatgcgtcgcttcagctatccagagcgacccatcatcttcctgtcgggttgctacttcatggtggcagtggcgcacgtggcaggcttcctgctagaggaccgtgccgtgtgcgtggagcgcttctcggacgatggctaccgcacggtggcgcagggcaccaagaaggagggctgcaccatcctcttcatggtgctttacttcttcggtatggccagctccatctggtgggtcattctgtccctcacttggttcctggcagctggcatgaagtggggccacgaggccatcgaggccaactcgcagtactttcatctggccgcgtgggctgtgccagcggtcaagacaatcaccattttggccatgggccaggtggatggtgacctactcagtggagtgtgctacgtgggcctgtctagtgtggatgcattgcggggcttcgtgctggcgcccttgttcgtctacctcttcatcgggacgtccttcctgttggccggctttgtgtctctctttcgcatccgcaccatcatgaagcacgacggcaccaagacagagaagctggagaagctgatggtgcgcatcggcgtcttcagcgtgctctacacggtgccggccaccatcgtgttggcctgctacttttatgagcaggccttccgagagcactgggaacgcacctggctcctgcagacttgcaagagctacgctgtgccctgccctccgggccacttctctcccatgagccccgactttacagtcttcatgatcaagtacctgatgaccatgatcgtgggcatcactacgggcttctggatctggtcgggcaagaccctgcagtcatggcgtcgcttctaccacagactcagccacagcagcaagggggaaactgcggtatgagccccggtccttacccacccttgcctcttctacccttttacaggaggagaggcatggtagggagagaactgctgggtgggggcttgtttccgtaagctacctgccccctccactgagctttaacctggaagtgagaagttatttggaggtgagaagagatttggggcgagagatggttt

SEQ ID NO: 1065 - protein, 693 aa, Mus musculus
LKGNRRSLLLVAAEKAAPLRLGGEGKATPLPSIPHSRPRSLNLRRLRECHAEAAAAPPRLAASPPLCRHPSTLGSAPPTARPRRREDSHAPGAAAPPCIQASPQRLVFFLQLRTPLHSRPAMRGPGTAASHSPLGLCALVLALLGALPTDTRAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGAGGSPTAYPTAPYLPDPPFTAMSPSDGRGRLSFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFSPMSPDFTVFMIKYLMTMIVGITTGFWIWSGKTLQSWRRFYHRLSHSSKGETAV

SEQ ID NO: 1066 - DNA, 22951 bp, Homo sapiens
  misc_feature (1)...(22951): n = A,T,C or G
taaaacaatgttggctaaaacatgatcaaagtttattttgttctcatatttgagaaatccagagggagtccatcccagactagcatggtgcacatctgtgttagagactcaggccccttctctcttttgctcctttcccagtgtcacctcatggtccacaacagcttgtgcagttgcagctgtcaggaggagggaagaagggtacttcccactccctttaagttgcacacaacacttttactgacaccccatggcctgggctcagtggatcccaaaagggaggctggaaaatgagatctttattccagttggtcatatgtccatctgacgactgagggcttcattactatggaagaagaggggaacagatattgggggacaactagtagcccccacaccatgttaagaactttagattcttcagtgcacttagttctcaaaacaacccaaaagaaagatgtctccccggcctttacagataattcctatctggaaacacttttgcaatcacagtcaactcaatgtcagttgcagccctgggaggtatattctcaaattctttatccaggccattgagcaagaagaaggtggttgcaagacccagccttgttaatcagcctttagcggatacctctcctagactggtgctgatcctctgtggtcagccttctgccactgtggacacattctccaggagaaagtcggaagagacgtgtgttttcacccttttctaagccttgtactgtggttagtaaggttctctctagtaacagacaaggagtcagacggcttcattcaaagggatggtagaattctgagggaaggaagcagccaggaaacagctctcaggacttggtctttttgtcttctccttctgaaacaggtgttccctctctccttccttcctttctcctttgtttctttccttccttccttcgtatttttccactataaaggccgctgctctcccgtctttccttcctctgctcctgctgccaccaactaattgctgtctctactcacttcactgcctcacagctcttgcttccttcaagcttctactgcttcctggtttctgctcgttcccttctcactgaatgcttcccagcttctgccagcatattttacactcagaaccccaaatgaaagcatccgatcagttggcctctctgtatccagcaggcacaactgttggaccgaggtctcatgccagacaacctcatggctgggtcacatcgtctactccagactcaatcctctgaggacaggattcatgtggcacaaggtacacaaatggcaaggtcagtctaaggaaatgctatgaagcgaactgtggaagtagcagctgttgcatttcagaatagccactgtgaccttgttgagactcataaataaggtcccagacccaacatcacaccatgcaacgacatttatccaaccatctctctctctcacacacacacacacacatacacacacacacattcacacccctcacacatgacacatgtcacactcccttatggttctcattatttccatccttcagttcaaaaagtaatcaactagagtgaaaactttatgcaaaactaaaggcatcaagctgggcacagtgtctcaggcctataatcccagcactttgggaggccgaggcgggtggatcatctgaggtcaggagttcaagaccagcctggccaacatggcgaaaccccatctctactaaaaatacaaaaattagctgggcgtggtggcaggcgcctgtaatcccagctgaggcaagagaatcacttgagcccaggaggcagaggttgcagtgagccgagatggcgccattgcacttcagcctgggcgataagagcaaaagtccatctcaaaaacaaaaacaaacaaacaaaaaaacaaaaggcatcctataaggtatcagtaacataatgtaccgctgtggaatacaagcctggttcagtggttcccaaacttgactaattccaaagaatcaccgagtgagtgtttaaaaattaaatccccaagtcccccactagagattctgactcaacatatctgaagtagggctcaggcttcagaaaatttttttcttttttcttttatttactccttaggtgattctgatgaccagccaggcttggactccactgttcaagttccatgtttacccttccagaggattccctggaagctttcattactaccttgagtctggttcctacagcttctcctcctagctctctgcttgataaaattatcttactgggagagcctgatatacaacaagtttcccacttgccctagggggcaggagtagggctcccaaatctctcaatctaaatgcccactagtgcagtttcagaaatggaattaaattgttccttaggtaactagagaaaattaacagattcttccaacttggtttgaaacctgaattaggtggaatgttcaaggggtcatcactaacctggacttgatatatcccagcctagaaattctggggtttctctaaattttggaatagctttttatcagacatataaaagaagatacattagtgtttatcataaaagacatcaggtagcagtgcagtatgaagtggaaaatgttatatagacctaagctttagttcaggctggctactatggaaaggaagttataacttggactgcacaggattgttgtgaaattagagatgctgtacctaaagcacttggaactttataaatggtagtcgttgtatttagaaaataactatttttgaggccgggcgcagtggctcacacctgtaatcccagcactttgggaggccgaggcaggcggatcacgaggtcaggagatggagaccatcctggctaacacggtgaaaccccatctctactaaaaatacaaaagaaaaattagccaggcacagtggtgggcacctgtagtcccagctactaaggaggctgaggcaggagaatggcgtgaacccgggaggcggagtttgcagtgagccaagatcgggccattgcactccagtctgggcaatagagcaagactacgtctcaaaacaaacaaacaaacaaacaaacaaacaatttttgatgctcaaactaatctgaagataataagttctagcacacccagtggtacaccagggcaagctcttaggggcttgtggagctgattatgtgcatcttttccaaacactaaggtcagtgacatcatattggcttgaaatcggctatggtagcattatttacaccacggaaattggcaaatgtacacatcagggctttttttcctggagagtcgattgttaaacatttaccagcataccactataaaaaattacaacctcggccgggcgcggtggctcacgcctgtaatcccagcactttgggaggccgaggcaggcggatcacgaggtcaggagatcgagaccatcctggctaacacggtgaaaccccgtctctactgaaaatacaaaaaattagccgggcgtggtggcgggcacctgtaatcccagctacttgggaggctgaggcaggagaatggcgtgaacccgggaggcggagcttgcagtgagcagagatcgcgccactgcactccagcctgggcgaaagagcaagactctgtctcaaaaaaaaaaaaaaaaaaaaattacaacctcagcaaagagccaaagccccaaaatatgcagctaacttggccttttatttgatccctaagatttgtatccatataactagaccaggattctgccctgatgattttttgcctatggatcacacagcatttcgtaaatattacctcacaaattctcccaacatcctgggggagcaagagatgttaagtgacttgcctgaggcaggacaagaaatcaatagtgaaaggcagaactaaaccagtctgtatcaaccacctctgcaatccttcctagacatcagtactgtgcagacccacattggagacatgggtagcaattaccaaaggtgctttttacatcataacccagatacccgaagtcgctttctacagactatggtccatatgctctgacctttgagtacagatttgactccccagaatggccagcgctctacatttggacattttttccagaactgttcatggtcttttattaatcaacttcctccatgttttctctcccagggacatgtgtttggaaaactggttggccagagttagggttctgttctgactctaacatctgcaagtggcaacataaccagtcaacactgtatttttatctgtgaccctttctctggactccccaaggacagagctccaagagtcgtttctctctgttgcctcatcttcataatactctggaaatgaataaatgaataatccttgtagtaagcagcctctcaaatggctccctatgatcccccaatggttttgcacactctatgtataatccctgctaccccttgagtgtgggaagatctggtgacttgcttctagtgaatagtatatggcaaaagtggtaggatgtcacttcccagattaggttacagaaagactgtgacttctatcttgatcgtcattttttcctgctctctctctctccctccttctttccctccctctctcagagggagagactctctgagcctttgctgtgagggaagcaaggtgccatattacgagtggccttatgagaggtccacattgcaaggaactgatgtctctggccaacagctagtgacagcctgaggcctgccaacagccacatgagtgagcttggaagtggctcctccaattgagccttgaggccatcacagccctgatcaacaccctgattataaaatagtcaacgtataaaactctcaactagcccagtgtggtgacgctcacctgtagtcccagcttttctggaagctgaggtagaaggatcacttaagaccaggagttcgaggctgcagtgagctatgatcactctacctcactccagcctgagtggcagggtgagattctgtctcaaaaaacaaaaacagaaacacaaaaacccctctcaatcgacaagggaagtgttggtcagactcagtgactgaatttaccatataaatcatctctacaagatgcggcctgcacatctaacatgattattgcatggtcctcctcttctgcaacttagatatctctaactttcataacccttgaaagggttttagggataagaatatccccatttttggaatgatccaacaccccaacaaaaatgaacacaagtcaatgacaacctgacaactggaaattccaagttctccatgttattacgtcaaaattgtctagtaaaagagaggccagaaaggaaagcatgtgctaaaatttgccctttctagtcttgcatgagtaattcttgcagcaggagcttcattacaaccgcaggactggggcacacgaagacggccattttcaaatctggcctgacatcagaatgtaattcaactagataaacctgggacttggccaaaataagtagcatttgcaaaactggagccaatgaatagcatcacttttctgtgggaccatatgactacatgtgaagaaataaaggcctttgttattttaaagggcagggacaattggaaattttgcagcagatagtcacaaaattttccacccttggctctcccaagaagataccagttagtggctttgggagttgggtgtggaaggggttgcttaggaagcaaaattaaaatgatcctggacagaatataaacagatgtcactacatttgtcatagaacctaaaacatgattagacccttacattgtgaacttactttttctgatcttctatgacttggctccttaaaatcatagcattctataccaggcaaggcttggaaagccagagctccccctctcacagcaaattcttattttggagaataattttggattgattttttaaaaatctttaaaaacaaaacaatctgttttaaaaattggctttgcttctctgctttttggacttgtctgcctgggacagagcaagaggactcacatctgtaacactttccatctgggatgggttttctgcatcttaggcatagactgcttttcattcgtcccttgaatttaagggttttttttttctaaattattatccctattgcctaacatcggagctgtctggggttataatatggagagtagaagctcatcagctaaattggttttagttgcagttgagacagtattttatcctgtcagttttcattttatttgatgacagtgcttggtatttcttcctcaataagcaaagatgacttagatcagtggcctgatgaataagcatgaaattttgatttagaaaaggaggatatcctgaagctcatggagagaaaaaaggaatctaaccccccaccacacatactttaaatgacaaagcaaagcagcagcattgtctttaagcaacatatttcaaccgaagatcaacactccccgatgttaggtaatagaaataataatttagaaagaaaaggggggcccttttaaaaacacaaagaaggaatgaaacatttttaaagcaggtatcgtattaccttcagcacatgtcccaaagaaaaggaaaaaaagggtgggggggtccgggagggagggcgaaactgatgcttgggaggaagaaggcgactcccgctgagggccggatggaggatgtgatcagtctaacactctgccttggcccaaaggcttccttccgccctttcgacctattaacaggagtggggaaggacaaagaaccgtgaatcggaaagaacgattcccagcaatcttcagtgatcgaaaataaataaagaaaaacagagaaagccaaagtctcccatggaagggaacccaattaattgtcttcgatttcagaatgagtttttttcctgctgtagaagaagcgcacgggaggcagcagagacagcaacttctgccaaggttcaacctgatcagaaatcgctcagagctccagcacccgggactgaggcagaagggctccgccaggaataacgttttttaaagcacaggattgctgtgtgtgtgtgtgtgtgtgtgtgtgagagagagagagagagagagacagaggaaagaggaggaggaggagagattgattgattgatttttttcttttccttctcaacatgtcactttcctgcatgggaattcctgatattcctggcagcccggagagaggggagaggccccctggtgacttatgacccccgcaggagtaaccagagagcgcgcgcgagcgcccagcgcctggctcaagacgaagatttaaccgagaacaaaagaacgtttgccaatcagaaaacgctacccgagaacgaggataaccccgctttgtgttttgaaaactctttaattagcctggtttctaagacgcattaaaacattcctacgcagattctaaatggaggatcaaatggttgcttctgcaacgaagatgggatcccgaaagggcacacgccgcagaaccaaggcacacggggccactgagacgcccggcgcgtcgtacagagtgttcctgggcgctcggtctcaggttacttctagaaccagtctccccaacgccgtcttcgtttccttaaaacctcgctagagtcaccccagttccccagactccaggccgtgcgcgcgggcggggtggcctgagcccgggttccccgctctccctgcttcgggcccttcctccgaggggtccttcctcccgccgtcactcggccccctccgcccgactcgggtttctcctcggaggcggcccctcctcctttttataactcgggggaggggagaggggactgtggcctcgcgtggactctttgggtccggggggaaagaggcgatccgcaaggcgcacccccttctcgtcccgtcccaaaccccacattgaggacccggcgacccgaaagccccgccagagccagcctttgcagtcctaacgcgactcctggtcacgtctctccccgaaggggcgctgcgcggtccttgctcccctcaaacgccgctggcgaaggcgcccctgctcaggaatgcgcatctgagtgcaccaggaagaggaacaaatctttgaagcaaattccctttctgcgcgttttcgtccctgagcgaattcagggtaaaagtttttccgaacttttccctcccagtcccccgcccctcccctcaggaatccgcccagagcgccgcggacaccgcctccgccactcccgcgcccgccccttccgacttccgcccaatccgaagcggccaccgaaaaaacaaaggccgccattgggccgccggggctggggcgcccccggagtggtttgtgaatggggggggaggggaggggaggggaggggacgggaggggacgggagggggcgggccggccgcgaaccccgcgagcccgacgcttcttctggcgaccagcgcgactccgacggcgttagtcggcgctcactcccggcggccggcggcggcggcggggcggcgggcacgcgactcgctgctggggctgcaggggctggaggggccggggcaggccgcgggcacgaacgcctccgctttcggacgcatgtgactgggtttccaaaaagaactcgccgtgctcccgactccggcgccgagatcggactcagcaagagccggccgtttggctgaaacttggggccgagcttttggggctgaagaaggagcggggtgtggaggaggaggcgaaggaggcggcgacgagggacctcgaggccaggagcggggcagcacgcggagtgcggccggggcgagcgagcgcggcgcaggggttctcctagcggaccgaccagcgcggggggctcgcgtgcggtgcgcggggtgagagtctggggaacttgaaggtgcgagcgctgctctctccgcggaggagcacggttacgtcgccggagagcatcgcgctcctcggccgccaaccaggggagagtcgtggccgcggcctgcgattcaaggccgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcttcagctacccaagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttttttgcagatttggggcgaggggtgatttggaaaagaagacctgtgtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatacaaaatgaacatttatttagtttactattcctgtaatattaaaccaaagaagagaaagaaggaaagtatgggaaaatagtatggagggacaacattgggtgtgtccctcaaagagaatggtgtatattattgaggtcttttttgctcccgcctttaagatagagtataatgaatgccttgactgtcatttaattttttttttcctgttgttgctgcttcctgccttcctccacaccaccccactacatacccctaagcctttttacatcctgctttggatgactattgaaggtattgaataagcatctcttttagagaagtgctgtctgatctatgtttttactgcccttaggagatgaaatccatattcaaaagggactagaagatagtgtttatatttgctgctttttttggtagtgtttcccttgtgaagaatacagtgagtttttgggtgtttggttttttgtttttttttttaaactgatcagtgttttggtattctaatgtaacttatgtagattggtaatccttaaatgctttgggttcaggtgctagggaaagtcagtggatacttcgagattagaagccttgcttgtggagtgttctcagctgaaggcttccctctaccttctaggtaaaccaagcaaaggtcaagcagctcccaaggtggcaatgactcagcagctccggcagcaatagactccatgcctgaccctgggatggcctctgaagccactgaagctattctttcctcttgagaagaggctaactttggaatcagattagacagggaagccttcactagccagaaactttgatatgaaagagtccctcgggaatggaaaaggcactttaatacatccaattctgagccttactagaattttttttctttccattcacctctcttctttaattccggtgcctatttcctggctgtttctagtacagtggcttcattccctggcagccgtggggactcaggagcagactgggtgctgctgtttctcttgccccgcttggcctcaaagtttctgtagttctaaagtacaacagaaacagttctgtttttgttttaattaacaggctcacacacatggctcgtgtgtttttcaaacgcatgaaatgaaaaccagtgacagttctcgcaggagcaggaagccgcatgtatacagttcgtgcaaagcagcttttctttaagatcctcccgggttttgagcatcacaatgggtatgtgaggtcatcttaacctgtgaagattttggcatcaaggaagggaaaacagtgattgtaagtctctgaaggtttacccagtttttgttcataaaatgacaccttttaggttaaagcatgcctctcttaacaccacactaataccgcctgttaagaatgtttgcttttagagtaggtggaaggctcccaacggggttttttccttgcaaattaactgctgaaggcacttagacccttctacagggaaagcccagtggctgctcctctgagtgtgtccccttcgtttcatcagcactgccttgtctttcagggctctcaaagattgaagagtgttggtctttagtaagggaacaaagacggcagatgaatacattgctacctgcttttttttttttttttttttttggtaagcaaagataaaagtgttcagtttaattcccttcacattgtgctgtgttcttatgcagtcaattcatacctaggaattttagaagcgcagggatttttcttaaggaggcacatctctgcagaaaatatgtgagggagagtgtttgtgaaagagcatgtgtagcatttaagaaaaacattggcaggagtttggtgttaatccccagataaggagtagaaacacttgtgaaaattttctgcagtttataaaacaaaactactctgtacaacaaccccatgcaacacctaatctttttaagtaggtatgtgagaaatcttggcaagaaaaaaataaaataaaagtctggacaacatcttaccattaaaatacagagagagaattttaaaatgtgcctaaaataaaataatgatattagaaatcatctgggtagaactctagtagtataacagctgtaggtttgagccctgtaattatactgggaaaatctcttctaactctcccatctttaatttcactgaaaaggcaggtggctatttatagatggtatatttttatatatgcatacgtgaagggtgaataacagcctacggggctccaggaaatcctagaagggtccaaacccacaccaatgtggactgaaataagcaattcataaatctgttctatttttctctgatttacccccctcagtggcattaaaccgaattcataaaacttggttcttcacttctcctcactgtgtgacatttcttacatctgaatctgtgttctttacatttcatgctaaagtaaactagttaaaaagggtacgattaaaatgccagctctttagtaaacacacattgtgtctcttactctctttggttctttaaaaaaaaaaaaaaagatctagtcacttggaattttctcaatttgtggatttgtagtagaaggaaaaaaggaagtttgaccaagacaatagttgtttattataagggacccagttcaacaagtactgatcaagcagccactacactgaaggtactaggaaaaggactggagggacgcagatcaaagtaagacaaagtccacctgaagtaactgtcaacatagttggagtaaggagggtgtcccccaaggaagaataagcaaagaactttaatgctggatagaacctggcacatgtcagtgtagaagcacaaatgctgtttggaataatattacctgacatttggtggcatttactgtttttaaaagctcttttcacattcactatttagcttgactctcacaattattacaaccctgaaatggcaataatttctcttttaaagatgaagaaggccgggcatggtggctcacgcctgtaatcccagcacttcgggaggccaaggtgggcagatcacctgaggtcaggagttcaagaccagcctggcagacatggtgaaaccccaggcatggtggtgcatgcctgtaatcccagctactgaaattgaggctgagacacagaatcacttgaacctggaaagcggagattgcgatgagccgagatcacgcaactgtactccagtctggtcaggagaacaagactccatctcaaaaaaaaaaagttgaagctattgtgaggaattcagatgtaccttagctgagggtttactttactttgtaaggaccatttagggagcagaagcccacctctttttggtcgttaagcttcttttaatgctttccacctgtaaagctctttatgctggtgggccctggcatcagattcagcttagagtgtaagaagtggtctccaagagatgtgcatctaacgagcaagaaaggaaatttgggaggcagggaaaaagtggagaggagtgaggagatagataaagttctatctaggccatgaataaagacaagttgtttgaatcatctaacctaatactacttacccttagaaaatctgatccccaaacttcagcttggccttgcagaatctagaggctaattgaattaaaaggaaaagcatgccagggagagtatggtgggacagagactaggaaatatggtaccagcaatgaaagcatatgcggcataacctagcaccgatgacatttttcaatttccaaaggaaaaaaacaaatggcatacagcatttggttccagtttccaggcctggagtctctggagggagggttgggggtggcagctggtcatagcagctttttgcagcagacatagggaacacatccttagctaaaatcatgaattatcttcacctccaatagatggtttcttgaggacctaccacatgccaggtgctgtgctagccctgtgtgtttagcacagtggctgctgggactcactctctccagtctcagccagtgcatcaacccacaaacagcacacctcgcttatttcccacactagcttctggagggggatgaggacagtgggccaaaaaacactgtgcttttcatttcagaagtgtctttgtccccaggttcctacagtactaatgaataaatagcagcatcttgatcacgttgtaaagatggggaaaccagcaccgtgagtctaaaagtagcttgtgccgtgtcacaagtaaattataacaggccaagccacaatgaaggatccacccaggtcacccagtgactctgaatttagtcatctttcccccacagccgtaggttttgaagatgtggtatggtctaaaggaacctgagaggggcaagggaggggtggggtatggggaccagctttgtcaagggaagcagggtggtacaaacatgtcaccaaggacaataaagattagctgtttgtactttgttgataataatgatcattgtctttataattgctaacatttattgagcattacctgtatgctaagtcttgagtacaatatggtatagtggtcaagatagctcacacgaagcctaaaccatagtacttggcatctaataagtgatcaataaacatcaacattattattcttatataattatctcatttactcttcacaatatccctaggagataagtataattattccccatttgacttgtaagggaactcaggctctaaaaggcaagctggagagccgcaaaattggctccagtctgtgcccctaatcaccatgccacaaatatttaccaaggttttaatgcctgccattctctattattattctcaatttaatccagaaccattcaaaaaggaggaaaataacttacatcaggacagaatggaatcgaggaggggattttcagtgttagtccccagaatgtatttatttttttcttggtgagatgcagaaggcttgtaaatgctgtttacattctgaagtgccagatgctccccagtcttgtcctgcctaagtttctacattggggtcctagggcttggcagcaagagggagcttgggaaggtgcttcccagacaccacgtctagcccctcaggagttggtgtccgagtccctaagaggcctcctccactgccacaggccccttccctgcccattccagccctgaagaacagggcaggctcaaggagggtgggacaggggcttagtgagaaaacttatccttcttgcagaacaggacaggctgtctttctgctaacagtgagtcagtgagtgggaaaatgaggaagacaaaccccagcaccacggaaacccccttcctgaaggcctgtgtgaagaatcacaaaaacattcacgtgattcttatcgtatatgtcctatcaatatcatcataatgaaatggcgacattgatagctgtcacttaatgtgtcaactatgttctgtgttaagcacttatattaactcatttaatccatacattgtgagatggaaattattattttcatcttacaggctttcaatacgaacttgtgaagtcatacggactgttagagtcggacatgagctcaagagagagttgtgcaagtatcctaccctaaatcccttttaattatccccagtttaacagggcaactgaggcacagaatttaactgggccttaaggaggtacactggggaatattttaggtctgcttcccattgaagtgctcttgggaaaccattcttgggcaagagtgaaaacagttgcagagaatgtagttaaatccctctgtccttccaccctgaccccaggaagtgtaaactctgaagacaacactctttctgttattgttatccttaaaaaagaaaaaaacacatgaaataatttcacaagtttcaacaacaacaaattcagggcatctgcagagaaagaagtgggtcattgtctttcttctggtgctgaatgtcaaggtaaaataatatcttgcacccccattccacggtaccacccccttctggatttgtggttctgggggcttacaatatttgccagcaagaaaactgaatttccaacaaagggaaagttccagtcatcggggacttcatagaagaaattggtaaaaagaaagcgaagtctttgcccagtacaactgtctactaatctgctagttaaagcctgatgttagttagatatcatggagggctggagtccattctttagtttatccagggcctaggtgagctctagattgcttacaaattctacattctcacagaaaatcaagcatgcataaaaaagatgaaagggggggatggtggtggtgtgtggtatgtgtggtatatgtgcgtgtgtgtgcatgtatgtgtgtgtgtactatttcaaataaagggggatggtgggggggttgttcaagctggattttgctgctctaaaggggagcagatgatgagggcaaatctaaatgttcagataagatctttttcattttgtccattattaaaagactatttcttacacattctctctctctcatgattgacattgaaatgctacatttctcattgttaccttctgggtcttgttccatgaaggctgacatggatgtcaaatggatggcatctgacacccttacacaaagacacataccagtctgaaaggagattatttaatttttagcagaaaagaatccattctaaggatgatttattgtcattttgatcaccatttgtacttacaattccaaggagttaaattagaaaataacacactttctttaggaaaaaatatcaatgccttattaatttgccaccagtactcccagcttccagcatagcaggcatctgccagtccctcttgcacattcttcaaaggccaaacggcttgataaagtcagaagacccagaaaatgagaacaactgtttccaaccataccatcctctcaagcacaaagaagtttcctcttgccgtcagcacaagtggctaacaaaaaagaaggctaaaaattaaacttttcgagtccttcattcagactccattaggagcactccctctacaaaagtgaattcatgtttcgtttgaggtgggaatctatttcactaggagttaaatgaaacagcaaggaaattccgttagttcatctctgatgacaggaaggcaacatacaattcctccattcaccaagtggtttttggtctacaagttgtacaaaatgtttatttcagataactaagtcctctttcagtgcaaactaccactattatatatttaaaactgctctgcatttgtctctcagattactaaaatctgagctgttgaggtgactactgaaaaaaatctaaatgcaatctctactgtccaatcagaatgctatctaaattgctttttattatttaaattataaaacacaatttctagtagtgagaacattaggtttggatatctctgaataggcatagaaagactcaacaggttctacctccaagacagttactgcatgggtaggagtaaacattaatatgtctcttaatgctggctatttggttttaaaaatgaaggacccagatatagccttttgcgtaggatcagcctttaagaaaaattacaatggagctagcctcattttccttggggatgcttcttttaacctagagatcttggggacacttcttttaacctagagatctttcttacctgtcactctcaaccaagaaaaaggaaacacagagatggaatgcattaaaaaaaaaaaaagatcaaagggaaaactcaggaaagagagggcaagatagcaagagagaattctgaacacagccctgttcctgagccactgacacctttattcaatcattcttttgacaaccatgaattgactttccatcattactctcactccctgcacctgagttataataagcagtaacatgcatgagttttgatgtgccaggcatacatgtagagtgtactaagcactctatacatcttatctcatgcgattctttcaacagctctctgagacacatactattatccccattttaaagatagggaaagctgagacaccaagaggttaagtaatttgcccaagacccctcaactcgtatgcgtgctgcttctctcgctccctgaatttttttccagccctgactactaaactgttgatatccacagaatcaaccccgtttctttgaaatattgctaaaactgcgattagcttttcctgtgattcaagtacatctatcccagtcatgtgttactcgttagcagaaaattaggccctgcttttccatgatctacatttaatgacctcaccccacgtggcagggttccacaggaggatcatggccacctgttgggctgatagactgatggagccacagggggcttggacttagctcatctccttgtgttcttaggtataaaaggcagagaagcctgataagagcacccctgggcaagaggcctctggaggtcggcagcgaagtccaggcaactccctgcatatgctccgcagtgctccccctgtgctcaggctccaaactccccttgaaaatgagagagttgagagataaccacagattccctaaggaggttgggagttgcttgtaaaagacacattaatggctccctccaagcatgaaaaaaagtcatcattgtcattccagtttggggaaatatcttcagctcagctcttgggttcatggtgctaagcaagccaaggacacaagaatgtcccagagccaaactagggtcctccaccctatagtctgagatgtccctttccctccctggggcatcctgggtaggacaacatggatgtttaaaagcctcctcatctgcactgttggaagaagaaggtggggcaggcatctctctaacagccagccagttattgtagttccttctacaggacttgcctcaggggacagagggcagattacatggaaaaagacagccacgctcttcctgatgttgtcaaggactggcatgctccatggccgtcccctgcagttctgcaggttcttggtgtttaagaagcatcgtggactactgggacaaggtaattgggttgagatctaacagctggtattatacattttactctgctggaatctgcaacttatcctcggctgtgtcctctccctcaatccttacaatcagccaaccaccatagattctgcttcctccccacgaccagtacctgttgctttgatcactctaatggcgccttaactggcctccctgcctccattttggtccctcctccaattcctccacaccctgtgctagagggaattatggcaaatgcaacgatgacaatgtctcttccttgtttaaaacccctaagcatggcctgcaaagccttccttgatctctgcctggctctccagccttatctcccactattcccgctctgcagagaatattctggccgtgttgatctgttatggttgccctgcacactcatgtgtcacaagaattcattttttgatgaaagagagaatttgtggctattatgaccattgaaagctaacaagccccttattggacgcactccagccatctttgctcccaccagaaaggggctggaatgcgagtccagaaggaaatcagagcgaaggcctggacttcctctactcctgatcactctaggacaactaaaggaatcctcaaaaaaagggggcactacaggactgaaagaagaaaaaaaaagcaaatcaaaaaagattaagtattattagtacctaaaaagcagcgattttcttctattcaatttctagtgcccaacacaatatccagtgcatagcagatgctcagtgtgctggcttagtgtccccccaaaattcatgtccttctagaacctcagaatgtgaccttatttggaaatgggtcatcgcagatttctttaggtaagatgaggccatactggcctagagtgggcccttaattcaatattactattatccttatgggaagaggaagagaggccaggcgcggtggctcacacctggaatcccagcactttgggaggccgaggcatgtgga

SEQ ID NO: 1067 - DNA, 2951 bp, Homo sapiens
cgcttcagctacccaagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttttttgcagatttggggcgaggggtgatttggaaaagaagacctgtgtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 1068 - protein, 294 aa, Homo sapiens
ASATQERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 1069 - DNA, 94672 bp, Mus musculus
  misc_feature (1)...(94672): n = A,T,C or G
acagcttgagaggaagggcgaagggaagacgggaagaaaaaaagacaaggaatgggggggggggggggcggagtgaaaatggaacgaaggagggacgggcagaggaaggactccttggaagaaggtatgttttgagtcttctcagctctcagcagcgctggcactgaagagcggcttaagcagacagcaatgattctcagctagttaactaagaaggatggggcagaaggattgctgctagctccaggccagccagagctacatactgaggctatatctcagtaataaataaataggtaaatacagggggctggtgagatggctcagtgggtaggagcacccgactgctcttccgaaggtcaggagttcaaatcccagcaaccacatggtggctcacaaccatccgtaacgagatctgactccctcttctggagtgtctgaggacagctacagtgtacttacatatagtcaataaataaatctttaaaaaaaaaataggtaaatacagaaataaatgtgaaaccaggtgtggtggctcacacctggcatccagcatttgagaggtggatgcagggggatttgatcagttcaagggcatcctcagttacgtagtgagtgtgaggttagccagaaagcaatgtgcaccctgccttcaaacaaacccacccaaaatacatacatgcatacatgcatacatacatgcatacatacatacatacatacataatccttgcatacatacaaacatatgcctgaaaagcaatgtgtgccatttgagaagccagatagccagggccagacagacaggagaaagacagtgacagtggacacaatcgaggtgtattatatgcatacatgaaaatgtcacagcaaaattagttctcttccacatctaaaacaaactaacacagagttaaaaaataatattacactttttaaaatcctgcactttaatccgaaagaaatagcaaaggaatgttccacctagatgtcaaggcagttcctatgaaaagcaatggttttgttacctaccctccacttagaaaggtgactgtgaattttctaagagccaggacacggctgcttctcattgaattttaggtgtctggttgctttatgcccgatgaggggaaaggttgcctctggttaaaccaccgacagcattttttagtcttattcttagaatttaacttcttgataaactatttcagactcattttagatgtctgtggttttttttttttttctagttatgagattgaacccagggcctttgaacatatcggacaaacattctaccactgaattgcaacctcttggatatagattttattatgttgtgtgtattgtgcattagtttctgggcttatttgcatgcataataaagcttcggtgtggagaaaaagtaacatgtgggttggaggatagaggtcagagttattcttccaatttaaagtgggattggggtcttgaactcatgaccttcagtgtgcagcaagccctttctggctgagccagctcaccagcccggaggagatgttttggtgcacactgtctggggcacactttcccttggtccgtgggctacactgtccggagtgcactttccctttgtccgtgggctacactgtccggagtgcaccttccctttgtccgtgggctatgagggtgctgctttctgtcctctagtttttttctttgtcacagctcctgtgaggctcctcatcttgtcttctcagctatgcttttctctgagaatcagaattcatgaaaaatgactgtttggctacaaaatatcacaaaacactgcttagaatgatgccataaatcaaatcaaatcaaagcaaagcaaaacaaaacaaaacaaaacaaaacaaaagaaaaatggcaagttagtttgggaaagaaccattatttatcgcatggttccaagggaaaacattttccaagtttcaaataaattcagttgccaataaatcattgagatttttttttttagtagcctggagcttagtgctttaaaaatatttccagaatgctaggatatgtcatagattttgtcagaaaataaaaaaccttaagacataaaaataaatacagactgtataaaatttttttcagatattagctcggtatagtgtgcatacctttaattccagcactcaggaggcagaggcaggtgagtttgtgagtaccaggtcagactggtctaaaaaatgagttccaggacagccagagctacacagagaaaccctgtcttgaaacacccttcccctaaaaattcagagacattttactttaactcgtatatttagattttattaacatttgcaatctctaacatttaattatgcatatgccgtaatactagacctcttgaatataaaacgtaggtgtcctcatatggtgtgtgctccctctaaaataacaataacctctgcttacctaccgtggcaatcaaccactcgattcactgactgatcagtcttcggtttgagatgagtagaattgcatctgtttaagtcagtccccactttaccacacgtcaccagtggctcttagatccttgtcttagtcagcatctccctgtataaagttcagccccgaggaaagcgcttcctggtgtcggtgagaggtgcgtgcccttcctccaaaccgtcagccacttagagtcatgttcagggtctgcattctatcttatgtactttttagagtcttaataaatgactcgaagactgaataacggtctttatataggaacatgagtgcatattgcatatatagatacaaaagagatgggctggaggccgcagctgtttgtcattctgaccgctgtctgatgcagctctgtgtaccaagctcctcccttctgtcagtctcactctccgttttgtgtttgaatgttcaggtgtgcacatgtatgtttggagggtgcacacgcatatgaagggcagtggtcaacaatggatgtcttcctcagttgtttccctcttaatgcttttttgagacagtctctctcactgaaccctgagctaaccaatttagttggaccagctatcaagccctgggagtcctgtctccatttccccagagctgggattacagcacacagctgctgtgttgagccttttcatgtgctagatatccaaattcaggccctcaggcctgtatgggaagcactttatcagctaagccacctctcccagcactgtctccaggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacactcccagccctggaaacctggtccacactttacctcacaccctctctgtcactgctgctccatttaaaaagattatacttcacaacctctccaaggaaatatctttccttcctgcactcctattctctctgtaatgaatgtgctttggatggtactgaaggaccttcctgagttttctcacgtcttctgcggtccctgcaacaccatccccctggctcccacatcaagttccaagtttaagtagacaaagaacttagcctgacttatctgtgggaagccacatgtgccgttgcagagtggcactgactactgctggccaccatgcataagtttggacaaacaaccaatgtgtacatatgcagtaaagttttttgcaaagacactgcctggcccaggcatgataatgaggctttgggagtataaccaatcagatgtgagacatgcaaatgaggtatgataatgaggctctgtgaggtacacagagagagagagtagccaatcagatgaggaacatgcaaatgaggcgtagtgcataaccaatccgggtgtgagacacgcctctcctaggcctataaaagccgcaccagttctgggctccggggtctctttgcctctgcaatcaagctctcccaataaacgtgtgcagaaggatcctgttgcagcgtcgttactgctggccagtccggctcgcgcaagacttatcaataccccatctatcctgttccaccctcttcttcctcttcctcttgcccccttcttctcttcctcctccttcttcagggtctcaccgtgtgaactaagctggcctccaacttgtgactgatgtatgtgagcctcctgatctctgcctcaggagtgctaccctgatgtgtatccagctgctcatgcatccccaccccacccctcttttgagacaaagttttgctatataatctagacttgtctcaaacttgtaatcctcttccttcagccctccttaatgatattattatatgtcagtaccattatgtctggccacatatagcttttgctctgtgccatgaatgatgaactctatattcggtaagccatttgatctcacttcactgaaaagctaggcctgttgccatccctgttttactgatgaggaagtcgaggcacacaaaggttaaaatgactcatgtcaagatcacaaagacaagtgctgacgttgaaattaggctccatccagtgtgtggcagtagctggaaagctgcctcccacatctgaagtccttgttaccttatttgtttattagccatcactctgcccttgtttcagttgttgctgcataaccaaacattccaaatgtactgacttagagaagcaagatatgtctgaggaattggtcagaaattcagacacggcttgtacaaagctgtgttttctggatcacttgtcattagctggtgtctctctgttgcctttagctggtgactgggttggcatggaaggtctcagaaggctccacagccacacctgtcacctcagggattctccctgtggcctctctcctcacattgctccttgtttatttaaagcaaggtgtcttagttagggttttactgctgtgaacagacaccatgaccaaggcaactcttataaaggacaacttttatttggggctggcttacaggttctgcatttcagtccattatcatcatggcgggaagcatggcagtgtccaagcaggtatggtgctggaggagctgagagttctacatcttgttctgaaggcaaacaggagaagactgactgccaggtagctaggaggagggtcatccccaaagtgacacacttcctccaacatggtcacatctagtccaatgaggccacacctcctaatagtgccactccctgggccaaacatattcagaccaccacacaaactgaggtttccttagaacatggggatcaaaaccagagccctgtgggcaacagacacgctctgtgccactgagctgctgtgtctgttttcatgtttgccagtcttgaaacagggtgggacagacctcatctcaacacttagaagtagggagtgggaggaccaagaattcaaagccaatcttggttccactatttgaggccacccggggctatatgaggcccagtcttagagaaccaaaaactaaagcaaaccaaaaccaaccaacagatcctcctcaaaagaaaggttttaaaaaaagcacatgattaagtcaaagaatgggcagtcagttctttggacactcctgttccatgtcctcctctcaggggtagccatatttttggcaaggttaatttttatttatgtgtatgtgtatgtgtgtatcactgggtatgagcgccatgtgtgtgaagacctctgtgaaggccagaagtgagaggcagctgggagttgttccatgtgggtgcttgtaacgaaacttgggtcctctggaagagcagtgagcacgcctaacttctgagcatctctagccctactgtcctctttgtaatagttttaactattgtatgtatgcagtgtgttttgattgtattcactcccacttctctcctgctccccttgtgctgcctcccaactgcatgttctctctctctctctctctctctctctctctctctctctctctctctttctcctctctctccccaatggagtccaactaatgctgctgctctcatgggtatggatgtgaggcctttcactagagaaggggcaatctaccagtggctatgttcccaaagaaaaataaatctctccccctcagtagccaccagcttccaatagatcttaggtggaaccttatgtgccctccccagtcagtgctaaagttctgttttgatcttgggcagggaaccacagctgctgtgagttcaggaatgccaccaggtgtctagaagagcctttcacagcatcctccccacctgcagactctcttgttctttctgcctcttctgctccttgcagggcagatggtgatagagacatccttcttagagtgaacattcaatagtcacttattctcagcatttggacctcattgcatctcagcatctgttcctcactgcaaagagaagcttctcttatctaagagaaccactaagctagaggtataaacacaaatacttaaggcaggtttttgacaatcaggaaaacagcactagtagatttcctttagggcttatgacctttgcagccatgggctttatagtatgaggaatgaattccctccattggagcaggtctcaactcaaactagaaaacagttggttataccctaaacagcaatgccactactaccccaggggcatatcttgcccggcaagtctgtattgtagcatgcatggttctgtgatgagtaagacaattattatcttttctcctgaagtggagaaataaaataaaataaaataaaataaaataaaaactgtcctgacaccttgagaactagctgctagggaatacgtttcctgatgaattcctgatgagtttcatttcttgtgatgaaagtgtatagtgtcaggctgaagagatggctcagcagttaagagcactgactcttccagaggtcctgagttcaattcccagcaacctcatggtggttcacaaccatctttaatgccctcttccggtgaagacagtgacagtgtactcacatacacgaaataaataaatctttaaaaaaaaaagtgtatagtgtcttaccatcttgttactgtgagtggcaaccaagagcaatgccagcagtctggttgttttggggacattcttaaacctatttttccagggctgaatatacactttataaggatagatgtgtgtgatggtttgtatatccacagggagtggcaccatgtagaggtgtggccttgttggaataggtgtgacctggttggaatgggtgtgtcactgtgggtgtgggcataagatccttaccctagttgcctggaagtcagtcttccactagccgcctttggatgaagacatagaactctcagctctgcctgcaccatgcctgcctgtatgctgccatgctcccaccttgatgataatggcctgaacctctgaatctgtaagccagccccaattaaatgtttgtttgtttgtttgtttgttttaattttataagacttgccttggtcatggtgtctgttcacagcagtaaaaccctaagacaatgtgatattcatcactctttatatttctgaaaggccacatgggtgatacaaagtatgctaaaataacataactaagcatctagctacacagagaaaccctgtcctgaaaaacaagaacacaaaacaaaacacaaataaatggaggtagaatgttaggttgcaaaggaggtgaggtagaagaaaaataactaaaaacaaaaccacagagacttattttattgaggagaaagatgaggggttgcattcattttttttaaaaaagcgggtgagtctcaaaatggataagaagggtgatgccttaattccagggccaggattagcctgagaggacaaaacgtttcttttcaggacaggaaaaggaagacttcagttgcaggtggatactttggtagcagctagagggaatgaaggaagttcacctctgggagtctctcttgcctcagaactgtagatgaagacatttatttttcatttttatcaaaggaggcgggcagggtagagctcagtaagggattgagagctcccgagggcaaggttacctggggagagaattaggagataagatcttagtgtataaatgactggtgtaggctccgaaatactttggccacacggatgtctcagctgaagctgtgtgaccatcctgagaggagtgaagatattctgaggagagacacgtgtgcccctccttttgactagtggactaacaggataatgggccccaaagaactagatttcctcaagagtctcactggagaaggaagagattgggtttctgggtgcaaaccatcaggagagcttggttcttagttctgacaacttgtcagtttgctttgcaggaccaaccaagatgtgtttaccatgggcaagatcacaccttgagccttctacttatgtcaaggctccaaagatagacttagggggtttactgaaccagccccttagttctttttcctagtgcagtctcattgaataaatttctttcactgttgtcttttttagctgtgttatggaggacaggtagcttgttagggcggccagagtccaggcttcattaactgcaggacatccctggtttgtaccatttggtggcgccattctcaaggctgtacacttttctgttctagcactgaagttgataaggctctggtgagagaccctgagttggaggaaccagttgggaatttgtacgcaggggcattcgattcggggaatatatctatctttaatgagtaaataaatgtaactctgtaggttccgcgatgcacactctgtagcagcagatttctctctggcttgtgttctgagagcatctgttacacaaaacattcaagggagcacttaggggtgcagcgggaggattgcgaccgtgacaagtatggatggtagtgagactaagaagcaagcaaaaacaattttaacgctgtatattgaggagccctgaggaaatagtttcttcctactctttaccgtttaaggtggacacgcggcaaaggcacactcgggaagagatgacgtcatgcagcttaaaggtagctcgtattttcacttttgttatttctcttgagacacgttctcaaggctggcctcgaattcctgatcctgctgccttcatctcacaaatgttgggattacagacgtgtgcagccatgttctgataggtaagattttctcttcatttctcgcagtttgaggaggtaacaaaacttgcagtagtttccatcctcaagcgcggcctatcgttaccatggaaacgcttattgagttaggtcctttcactgagtcttcggttgcttctaaagtgcgcccgccctaggacgattggttctgccctgactgaatggtttgcctgcagtcactgatgcgttcggagcaatcttgatccctgtcggacgccgtcaccggctcttgcctagctccacccattctgcgggcccgcctctccagcccgccgccggaggccccgcccctacctggaggccccgcccccatgaatcagctgatctcgcgtacccgcggtgcagtcgggctcgcgccgggagaagagcgcggagctgcgggagcgtcaggtgagcccgcgcgggtccgggcggtccttgggttcgaaggcgggtcggcggaggtgcgggagcgcgctgggctggcctgcggggacggcgcctgcctgtgaagagctccggacgtggtggctcggcccgggtcccaccctccgggtcccagcgccccactgccgtggtcggagctgtgtggcattccttcgggtcccctcttcccgcctccacccacgctgcttacgcccatccgctcagagggttttttgaatgcccacagtgggcgcccagctggctagacagtgaaccttgctgagtgtcctaggtgggtttgccccaggatgcatatcgtggggaaaagtgaaggggggcggggagggtctgtggtttgaaacagcgtttgctgaaaatgaaaaggactttggtattaatcagtggtagtttgaccaaatccctaaatgtatcaagtcatcaaaggaatcatcgtgaagacaggaaagaacactggagcgatcttgaggaaatggtcctcacattgatgttggtcctccaggtaacagggctatttgcagacaagcaactgtagatttgtagaggcaagctactgtttagtacttctgtggttaccaaagagggaaaacacactggttgaattgggtggtcaagagcagcactttcttatagattaactgactgctgtacccaaattaaggttgttactctgttgttcttatatttgtatctgttttttaaatgactgtcaaggataaacttgtgtgatgtaggtttatttggagcaggtacaaaaatgcaaaaaaacagtaggccatacttttttgttttttatcatatacctgtatgtattagtgttctctagagtcacaaaacttatgaaatgtatatattaagggaatttatcatagtgatatacagtttacagtccaactagcccaacaacgggaatgggaagtccaagaatctaatagttgctcagtcccacgagggtagttattttagctggtcttctggataagctggaatcctgaagaagtaggttccaatagattcgatggcaaaggagtgcaggcaggcaaaggagagagagccttccttcttccaatgtccttatgtaggcctctagcagaaggtgtgacccagattaaaggtgtgtgccattacccctggatttggaatttgctttgtcccaggctagccttgaactcggagatctgcttgcctcattctcctgggattaaaggcgtgttctactttgcctgggcctaagcttttcatgaccactatgcctcaagacttgtgttgtcccatgtcaagatgtgggtcaaaagcctgtgtagtctagcctcaagatctggatcacaggtgagccatccatttctgcattgtagtttgttccagatgtagtcaagttgacaaccaggaacagccatcacaatgtgttaggtaatgaaatcagtgaaagatttcttgtttactttatatttttggttctttagcctatagtagtactagacaggtaatttgggaagaaaaattaaataatgtttaaaaactacattcatctatttagataatgtttgatttgtagtttgggccagtgttgaactctcatcctcctgctttagcttctgggctgctgggattacaggtgtcccaccgtacataccccaactttgggcagttggacagtctttaactcactgtgtagcccagtctggcctagaacttgtggagatcttcttgccttagtatcccaagtacaagtgggctttgccatacaaagagtgaattgtaatattttaaccttctgtttagtaatagaggcatagtggtaattcctaggctttggatctagaaataccttgaacatctttctttgagcctctttgcctcagtttccttatctctgcactggacttttctggtattagtacctacatgtatggtttatgtatcatttattactatgcctggaccctcagaaatgaccaatatatattagctctttatagttaacaactttcttttagtatatcatgagccaggctccatagtgaccttttgttttttaaaagtaggaaagaaattttgaatgaagcggagttacgtttattttttttgaaagatttatttatttatttaatgtatatgagtacactgtagctgtcttcagacacaccagacgagggtatcaaatccaattacaaatggttctaagccaccatgtggttgctgggaattgaattcagtcctctagaagagcagtcagtgctcttaaccactgagccatctcttcagtcccagagttgggcttatcaagaaaaggttataacacagatttaagcactggcatgaacagagtgtgggagagtgacaggtaagaaggtggtagcaagcaccctaatgaggtacaagcttccctgtctatagtcagcaatagatagtaggactctacagtggacacaagcttctctattgtcagtctctgatagaacaactatagtcatttcagatataattttataatttgtatttaaaagaaaaaattatttcaagcgaatctctagtaactttggtatttcataaaggcattttaatatggaaaatatgctgatataatctacacctagttaaaatttattacttcataaattatggctagtattggcagatatggagttcatagttaagaaaattcaaagctgtttcataatgttaaaatttgaaagcctgggccagtgaggtggctcagtaggtaaaggtacttgtcaccaagcctgatgactttagttcagtcctgaaatccacgataaaaggactgaactgactgctgtgagttggcctctgacctacacacacacacacacacacacacacacacacactaataaatgtaacacctttttttgaaaacatagtagcctatagtagtactagacaggaaatttgggaagaaaaattaaataatgtttaaaaactacattcgccgggcgtggtggcacaagcctttaatcccagcactcgggaggcagaggcaggtggatttctgagttcaaggtcagcctggtctacagagtgagttccaggacagctaggactatacagagaaaccctgtctcgaaaaaccaaaaaaaaaaaaaaaaaaaaaaaaaagctacattcatctatttagataatatttcatttgtagtttgggccagtgttgaactctcattctcctgctttagcttttgggctgctgggattacaggtgtgtcccaccgtacataccccaactttgggcaattggacagtctttactcttttttttttcttggataatttctttattttcatttcaaatgttttaccctttccaggtctcccatttggaaaccccttattccttccccccccccccccacctctgtctttatttttaagtgaagagactagtgaaaatattgctggaattctggttttagtttttgtgtgattagctgagtctaaaacaaatagtaactgttgctaagtctaaggtcttatgtagccaaggctccttttaaacatgttatatagtggagtagtccaggctggccttgaactcttggttctattgccctggagtgtggcctacatccatccttgccacgttcctctaacagtacttctaaagaaggccaccagcctgtaagagctttctatagttgttctttcttttaatgaagcagaggtgatgttggagagaaggctggttttttttttttttttttttttttttgtgacagggtctgccctggtctgctctctcttactgtgataaacaccatgaccaaatgcattttggtgagaagagggtttatgtggttcatataaccccatcgcttgagggaagtcagggcagggatgcagtcaggagcctggccagcactagtggcatgggcagatgtaggcctgtaatcccaacactccagaggcaaaaggaccaggagccgtggaggaaagctccttactgacttgtcttcaggctcaccctctgctagctttcttatacctcctagatttatttgcccggggctggcacctcctacaaaaaaaaacaaaaaaaaaacaaaaaaaacactagttcaaggtctcagtctgttacccagactagtctggaactcactctgtagtttaagatctccatctcccagggctggattacaggcacggaccaccacaccctgcttttgtgagacagggtttttctgtgtaatccctgggtgtcctggaaattgctctgtgctgttctggaactcagagatctgcctgtctctacctcctgagtgctggtattaaaggcatgccccactatttcctgccttcaagaaaggattttagtggagaatcaggcacaggtgttacctagttcgaggccagcctggtctacagagtgtgagttgaagtgcagtctggtctgtatatggtctgttctagtacagcctggtcttcataatgacttgcagggcagtctggtctatctacacagtgaattgcagggtggctagacctacatagtgagatgtctgcttgcaaatcccagtactccagagacgtaatcaggagatttcaagtgggagagcagcaagggcatcatagttctaggccagcctgaattgagttacagagtacgaagggttgtgtttaagtggtgtgtgtgtgtgtgtgtgtgtgtgtgtgtgtgatgtcaaagaccccatgtcaaaaaaaaaaagacttcttgaggattgtgtttaagtgtcttatatgagaagtcttggtggcttttgaaattacaaagggtttaaaatatgaacccaggggggctggtgagatggctcagtgggtaagaacaccccacccgactgctcttccgaaggtccagagttcaaatcccagcaaccacatggtgtctcacaaccatctgtaacaagatctgacgccctcttctggtgtgtctgaagacagctacagtgtacttacatataataaataaataatctttaaaaaaaaaaatatgaacccaggcatgcctgtaatcccagcatagagggtcaggagggtcaggagttaaaggtcatccttgggtatagagcctttgaggctagcctggggctacaaaggacactgactcaacttccaagaaagttttttaagtaagtgcatttccttatacttatttatttaaagaactttccttcaataaattagattataaagtggctagcagtttggtaatataaggaagtcaaaagaatcctttctgtaggcccatgctttaacaaacattttaaaaattgcatttatttatggtgtgtgcttgtgtttgccagtgggagtggagctcagaggacaacctgccagagcttctctccttcatcatgtgaccagataagctgcattctcacctgtgttttctggggcttcctggtgctgatcagggctgtagatcctgctcatcctaggatggatggtctttatctacgtgatctcagcgatccatgaaatctcagagctcggaggaccattttcagtaggaatttgggagacaagaagtcagtacctgagacatcaaactgaataaactataaaatattcatagattgttatacctaatcacaaaatgtacctcattgttaatatgagcctgggcgagtgtgaggtgaacaagcagggaggaaggtaggtggtggctgagatggcacaggaggactgctctggtggcacatctatctgacccttgttgcagtcactgggaggagtgctgtgagcacattgtggcttccagaccacttggctccgttcagagcttctacagaatgacatgtaccgcagagtccaactatagtaaaggtaggttgttcttgtctttttaaaagacagtcttgctatatagctccatgatgttgaactcttgatcctcctgcctctacctctcaactgttgggatcatagatatatacactacacctagcttgtgtgtgtgtgtgtgtgtgtgtaggctacaggtcatcatctgtcttcctccatctctatttgctctacaccgtccatccatccatccatccatctatccatccatccatccatctaaccatccatctaaccatccatcgagtctctcattgaatctggagctcactattacagccacgctggctctccagtaaggctcagggatcctcctgtcttcatggtgtgctgtttccccccatgcctcctcagagctgggtttagccatgcggctgagctggcttccacattggtgttgggaatctgcgctgaggccctcacgctagaacagctggttctttacccaccaaacagtctccctagcctgtgtttcttttttcaggagacctttttttttttttttttttaacttcactttcccattaatgacctaacaatttattttttaaaagtaataaaaagtggcagcttttatgtcagtgcttaagagaatcttggtgaattgtgacaaaggatgaggttgttctttttggtgttgcactcattttcctgccaggaccccgagtctcctggacttagcatgatggtgtgtttagcttatgccctttgtttggttttgctttgttatttgatatgtagtttagactggcctagactcatgatcttcttgccccagccttttgtgtgctgggactataagcatgcagcactatgcctggcttaaaaaaataattaaatcagtaagttattgatatacttttgagtgatgatgtaattcttttaagtttgaagaagatgcacaggtttgtttgtttttcttccaattgtcacaagtaaatgatgggattttgagcagttcattttgctgctagtgtgctagagagattagcttttgtctctctaagtccacaaattgaccgactgatccttctcttaattatcaagtatttataaatactttcctttcagggtcatccccagttccttgttcacatgacctgtgttaagatgttgttggtagcactgaccagatgatgacatctggctagtgctaactcccgggttttttcttccaccatctaaatatatttgagccaagttttcagtttaaatttggggcagcttaccgaacaaaggtaacaagaatgatgatagaatctcagtgaagtagaataatccaactgcacaccaataggaaaattgataaactgatttttcatgcaattgaatatacttgccccagtaaagtgaatgaattaggtctatatgtatccaaaggacattctatttagtgaaagaggcaagtgccagacggtatttctgtacagtaagatctgttctgttcaactgcgaacagtggcgttgtttacatatatggatttagcgaatgagagtgaacaggagtgtatttatagagatggtgggtcactgatgatggcttcagctccatgtggaactactgcaaaggagcttactggcagtggcatatacctctaatccagccctgggaggtttaaacacaattgcgagtttcaggccacccttagtggcagagcgaagcaaatttgagatattttattatgttcaaaactaggtggtgaggacataggtttagtaatttatttttataaatgactaagatggttttggggaactacactttaaatttttatatttataaccagggctctttccccgtatacattattatgctttgtagctttaaagtagtagagtctgaaacagctcttgtctcctgcagagagacagcagtgtgcctggcagctcctctgtcctgggaagcgctttctccaggaaatgagccctgtttaaaggcttcagagaagtcggaatggcagggattcttgggagagtggagcataaaaccggcttgaaattttaaagtgcagggagcaaattcattcataatgctgtgaaaggaatttggatatagactgactttaccaagattttatattgtcatgaagtaatgagtattttatttaatttgagttggttatagtagttaataaatgcattatcttgaaatattataattctaacagctaaatataaaattctcaagatactgtaacaacttatgcttcttatgccatgccaatattataaaatatttcataggaattttactgattttggaaaactctttttttttttttcctttgagacagggtttctctgtgtagccctggctgtcctggaacttactctgtagaccaggctggcctcgaactcagaaatccaactgcctttgcctcccaagtgctgggattaaagatatgtgccaccactgtccatcggaaaactcaattttccacagttggtataaaaaggaactaaataggcgttactgggcatttcttgtgcaatggccacgtacccttacttcttagaggactctcacaatcagaagtgtgctcagttctggtaggttaaaagcagcaagctgttggaagaagggttaggtgtggggagaggctcagagagtaaaaggtaccaagcctgaccacgttcattcagttccctcgactcacaggtggaaggggaactactgtcttccagaacttgtcctccgaccttcatgcactgttctccaccctgtgtgcacacaaacgctcacatacgcacacattctcgctctctctaaataaatgttgaaaagggtagcaaacaaaacaaaaaaaccaagcagctataaactgaatattggggcaaccttcaaaaaagggctgtgccttcccttaggttctcccttaaatgtagtcagctcatttgtagtggttagtatggatacaaagtgtaaaaaccttcatgctttctgaccttcaggagcttaagtgaggcaagacttagtaagggcattattctctaagaacaaagttataagtaataagtagctttctaaccaggcatggcttccttcctgctttaatttactgagtccccctactctggggactaaagtgtgtcttgaggagacgctgggatttgaagtggctttgactgttccagttggttagcatgcctgctcttacatgtgagttgtccccagccttgcatgcctggtaaaaggtgtcagtggcagggtatccggaaagaagtttttggtatctagaatatttgttgtcaaatattagagtctaagagtgccttaactcacatgtaaacacagaaaccaagactttaaaagcaaataattattaagtattttacccgtgtaaaataccaggttctcttaaattactatatccatagtgtgaactctggcttattttgttataacaaattataactcaaacttctaaaaggaaacactagtccggtatagtggctcatatatgtaatcttgggatttacaaggttaaggcaggagagttgcagagttcaaagcaacctgggctacagtgtgaagttctgtttcttaattctactccacctgtggagacaaaaagaaacaaattgtggatggctacttgaaaatctagtaattttgtgtctaagtcattagtgctgttaatctgtaaatttctttcagagctcatgatacagtttgctcaattgttctgctttctggtctctggttttaattttttttttttttttttgaaacaaggacaagagtcaggtgtagcccagggtagcctgtaatttgctatagctgaggctggtcttggcttttgatctctttccatcttccgtttgcagtctacaccatgcatgcccagtttacttcctgtcttagtgtgtagtcattttaaaaattacagtatgcatgcaatttccttgtgtatgtattcttatgtctatgtgtgggggtgtgtttgtgacatggtgagcatggagagatcagaggataacttttgggagccagttttcgcttttagactgtgggttccagggattaaaatgaggttgtcagttttggtggcaggcttccccacctggctatctcactggtcctgttcagttttaatcactgattataattactcttgtaaaaatatttgcttttaatcaaaatatcccatgcagagcttgggattaaacccatggccttggacttgttagacagatgttctacttctgaattgtattcctgcttccatatacccagatacctgttttaaaccagtgtaagagaatgagcatggtatggtggcacattcttgtattctcaatactctctgagcagagatgagaattgcttcttcagatgtgagagtagcccagttagttacatagccaattctaagccagctagggctaagagaacacaagttagctcctttgtcttgaggatactgtcttctctgtagagtgctatcacattagaaaaacataagctcataagatggtacagtggatctttggttacgggcagatcacttcagcccaatagtttgtggctagccaggacaacatgtaagacttcatctatccacattccccaccctaaataaaaactgagtgcattgaagaagcagaatgaagtctataggaagttaaaatctgggagacatgtactaaaaattagagcaatcttttgttgttgttttgtttttcgagacagggtttctctatgtagccctggctgtcctgaaactcactctgtagaccaggctggcctcgaagctcagaaatccgcctgcctctgcctccattttttttttttttttttaaagatttatttatttattatatgtaagtacactgtagctgtcttcagacacaccagaagagggagtcagatcttgttacggatggttgtgagccaccatgtggttgctgggatttgaactctggacctttggaagagcagtcgggtgctcttacccactgagccatctcaccagcccctctgcctccattttttccttttttcctttctttctttctctctctctctctttctttctttctttctctctctctcttctcttctcttctcttctcttctcttctcttctcttctcttctcttctctctctctctctctttttttttttaaagaatataggttccaagtcccttatttggaaatgttgagctatgttttggaactgagatttttctttcgtgaacactgtgtataactgtattaagtagtaactcccctgggatctgtgttagcttgtgatcatattgatagttctgcaacaagaagggcagggcagtatttaccctagacaaaataacagcccctcattggttcaggtcggattttatacttggctaaattgagatcatattggatttttgctgtgaaaaaagaaaaaaaacaggtagctttcagagtctttgactttggatttctgattctaatataatggaagtacagatggttcatagctcttctttttaaaaacaggatcttgcattcaattttcctgtcttagcctcccaagttatgggattataggcatacatcaccaaggtagcttatagtgtgccccacgcctctgcccccccactttcttttttttttaaagattgtttgtttgtttatgtgagtacgctgggcagtggtggcgcatgcctttaatcccagtactcgggaggcagaggcaggcagatttctgagttccaggacagccagggctacacagagaaaccttgtcttgaaaaaccaaaaaaaaaaaaaaaaatgttctggaaacgcataaactctattgcttcttggtcttttggctaagatcaagtgagtacactgtagctgtacagatggttgtgagccttcatgtggttgttgggaattgaattttaggacctctgctcactctcatcggccccactcgctcgggcccaaagatgtatttattattatacataagtacactgtagctgagttcagattcactggaagagggcaggcatcagattacgagtagttgtgagacaccatgtggttgctggaatttgaactcatgaccttctgaagagcagtcagtgctcttacctgctgagccaatctcaccagtgctttctcgtctcgtctcatctcttctcgtctcttctcgtctcttctcgtctcttctcgtctcttctcgtctcttctcgtctcttctcgtctcttctcgtctcttctcttctcttctcttctcttctcttctcttctcttctcttctctcttctcttctcttctcttcctcttctctttctcctctccctctctcctctctctctctctcttctctcttctctctctctcctctcttctctctctctctctctttcttaagcaatgataagaattctagactagaccatattctttttggaaatttcctgatcttgatattaaagcagcatctttatacagagcccatttcttccttacaggaagctgtgtagccagtggaatttaaatgtggtgttactttgataagaaccaaagtttacttagttttagtgcatcatttgatggttgcgtctttctgttgtgaaggtgatagtagcttgcagagtgatatccactgagtctagccttggcctttggctaacagaaagaacttaacagctacaatgattagcctaggttgcctgtctgctgacctgtggaaggtcttgaaggtaagtcaaccccacagtttctaacttcaagttatcgctgtttatacagtgtctttatcagagttagttaggacaatacaggccagtgcaagagagagactgttaacagaagagtaacagggtatagagctcctgtctccatgtagcacaaagactgaccttaccaagggagaggcatctttgaggagccccacagttggcctgtcttcagtttaaatgctatgtgaatggagaagcagtcatagaaatgccagagaaacaacattattgttggcttatggtttttttgttttgttttgtttttactgtgttagtgcataattgaggagaggtgttaatggagttggtaaatcccacccttaagtgtgtgagctttggacggcatgctctccttagttgtcacttctcttctttccatgacttcctgaaagaagtcaaatatcttaaagcctttaaaacaaaatgaagccagatttgggctacatatctataattagcacttgagaggatgaggtcagagatcatcagtttgaggctagcctgggatacatagaaagaccatattgaaaaagaaagaagggaaaagtttttacaatattattaaggaaaatgtctgtaaaacagaattgaattttctccccctacctttgtagcccaggttggcctcacaccctctatgtagctgaagataaccctgaatttcctgatctgcttctgccttgtgaatacttggattacaggcacgtgcccatttttgtgcacggtgggggataaaacccagggcttcatgcacgcactatactacccgagctgccttcccagcgctacatgtgagctttatactgttgctctgacacattgcttccaactctgtggcctacagcgttgcttactaccatacagtcccgtaagccaaacatctgctatgggcttaaccatgccaggaaagcttctttgactgtctttttctgcaggttttcccccaggtaggtgccactccttggcctttgcatattttgaaggtcagccatgtagcatctttcacccagcttccttatcatttctttctttcttttcttaaaaatgtctttgtatgctcctttattctatgtgttcatgtgtatacatgcattgacatacatgcacatgaaggtcaaaggacaatcacaggggtccattctctcttcccactgtatgggtcctagtgactgaactcaggtcaagtcagacagacttggcagcaaacacctttacccactgagccatcttaccagccctccttttttgttttttgtttattaggaaagtgtgtgtgtgtgtgtgtgtgtgtgtgtgtgtgtgtgtgtgtacatgtaagggcaggcaggtgcctgaagaggcaagaagtgtctggtccccctggagctggagttataggcaatggtgagctgcctggcatggcttctgggaactgcacttgtgtcctgtgcagtgcttgttcttaacttcagagccatctcataacactccatttttgttatatatttttgctttcttttaaacctcttctttttttgagtctagctcaggctagactgagactcactatacagcccatggtggccttgaactcatggcagttctgttgcctcagctttctgataggtgggaccataagtgccaccatcctcagtttacagcagttttggttgtgcagtcttgatgtggtggatctatttcaggaagtgagatgtggctgtactacagttccatgccctcctagaagggtcctctggctcctgcggatagtgtaaggatgcaatctgaagcgcaccccttggcctgcacagatagcccagagttagcatttccctgcacaccaggaagtgagcatcttactaaagctagttagcatcaccagcacagatttaggagcagttaggaattctgtgtacgcagggcagtggtggcgcacgcctttagtcccagcatttgggaggcagaggcaggtggatttctgagtgtggggccagcctggtctacagagtgagttccaggacagccagggctatacagagtaaccctgcctcaaaaaaccaaaaaaaaaaaaaaagaaaagaaaagaaaagaaaagaattctgtgtactaatagcattaagtttattcaaatttaccatctgtttatagtacctttcatccaaatttgatcccaaactgttctaaattaaacacttacaaggtagaaagtaatttcctccggatacacagatgggaaacagtgagaattccaggcagtctggaataaacagatggacctagatctccctgccagtgtgagttgtttgcagagcagtgaccatgccataccaaattataaatttggtcccagtattataaagtctacagaaatagggctttgttcttgtactttttttaaaaaatgaattttggtgccattaaaacttggaattgttaaattgaaatgcgtctggtatttcctttgtgtgtttgttttactttctttttttcttttttttttttttaacattgcgttttaaactcatgggttattattttcaaacaataaataatttttatttagctcttttcactgagtgattattgtgttttgaaacagggcttgttgtgtacccaggctagccttaaacattgtcttttttttactaattaatatatttatattctgcggtagtgtttatgtagcctaggctggccttgacctcaagatcatctagcatccatctgccaaatgttgaggtcacagttgtgtgccacaacaaccagcttggctttgaattttcagtctcctgcctcagcttccttagagctggaattgtcataagctactatacctgggttttgggtggatgcttttattttattatttggaggcacagacactggagaactaatccaacagagcccatgtgtgttgagtgctctaccatttaactacatcggcagcagttttagtttattaaactaaaatgggaacttccttggcattccaggcgccgtggccagctgtgttggaaagaagtggcacagagtgctagtgaatgttcagctcgtgggcacaggtgcccggcggtcagcacgtcccacaactaataagtaatgtcacagagctactgagctactgattggttagggggaatggcttctgccataccagtactcagcctgtgtagaacaaatggcaaatgtggggcctggaaacagctcattccagatccacatttctactagcccttccgggtctgaagcttgttagcattgcattgagattgtcttgggggaaattaccacagaagttccagtaatggaaaatgtattttagttaaacacaaagaaattgaataattaacatttgtgttcattactgaaaattagaatgacttggatatgatacattactgagatttttaaaaaaaaaatctttcccagttggaatttaagtttttatatgttccagagtacttaaaaagtaaccttaatataggtattacttttctatcactgtgatgaaataccataactatagcagcttataaaaggacatgtttaattgggcttagagttaaaaagggctgacagggaaggcagagtcgcagcaagagctgagggctcacatctggagctgcaaacagaaggtagagagtacattgaatgctacttagctcttgaaacctcaaagcctgccccaacaaggctatatctcctaagccttcccaattggggaccgaggattcacatagatggggacatcatttgcgatcaccacagtctctatgattgtactgaatatgttgatttgcagattgaattccttcctttataataatttttaagaacctgaaaaatctgtttcctggaacattacatttgatggccagcaggcgtcttataagctcagtgggcaggctcagtcttggtatttgactttgagtaggcagggaatgaattagttgaatagtttctctgaatacttatcactcagtgaatgtacacttgttagaggcctgccctccctctcccctccccctccagtcaaagagataacaatggcggagtattccaatgtcctccgcttctctctgtgcttacctagtgttctctattcaggtcttgagagagcttttgctaatgggatggtttggtgatggagtactcctcctgaccgatggactcaaagaagaaaaggtaaaatcattttttttctcccctgtcgtcctaggaaagcacaacaaacaacatggttgaaattaatattttttgagtttgattttctttttagtggtattaagtagaagcacatggttgcatttgtaattggtagcaaaagagacaaaattatttaaataaagatgagtaaagttgttattgtcttatgcttataaagggattttattatcttgaaactcttgtagacatcctttattttaagtttcaatccgtacttagaaaactactcacagaagattaaattgtggctttccttccatagattgttaagctcagttttaaattattattattattattattattattattattattattattattttgagatgggtttctttgtgtagccctggctgtgctggaactctgtagacctggctgggcttcaattcagagatccgcttgcttcagcctccttagtcctgagattaaaggcatacgctaccactgtgcagctagccctattataatttaaggaaatactgtttagcaaaagtagagatatttaaaaaaacgtttctgcttctactaaaatagaagaatatgtgtttgctagaagcaagcaaacaaaaacatcatgtatagcacacatcattgatcatagcacttgttaaacagaggcagtcagatctttgagtttgggccagcctggtctacatagagagttccaggccagccagagctacacgttgagatcctgtctcagtgggaagtgtggagagaaaagcatagaagactgttgtcagttaggaatttgattctttgaaaactctaaataatggaaaataatagagggtcctcaaaaaacttgaaataggcagataatggcggtatacacttgttatcccagcacatgagaagacctgggaaatatgagtttgaagcaagcccatctcaaaaaacaaatatttataaccgccccccccccacaaagatagtattgctgtataatcataagacagtctcactgtggggtatatatccaaagggaaggaaaaggaaatccatatgttgaaaagaaatatgcactcctctgatattggacaaaatatgaggtcaacttaagtattcattgatgggttaaaaaaagttgtgtatacagtcagtggcctatattcagccataaaaaagcatgcagtcttgttatttgcagcaacatgcatgggcgttttgttgagtgaagtaagacaggtataaaaagcctgacaccaccgactacatcctcttacttacatgtggaaggtaaaaagatggtctcttgaaattagagggtaaaataatgctttccagaacagggtaagaatggatgtggttaatgtatccagtgtctttgtaaaggaagcctagaatgttctgtcagactgtagggtgaatgatttagatggtaatgatctctctctctccttgcctccctccttctccttccctcccctcaatcatggaggcagagtcttactctgtagctccaactgagaatgcttgattgacccctagtcttcctactgttggaattgcagttgagtgtcaccattcccagttttgtgtatttccagatagctagtagaaaagattttgaatgtcccaaatgcaaagaaatagtctatgtttgatgtaaagaatatggtaattacactgaccacaacatatacatgcatatgtagaattaacatattgttgtactctctatatatgttcaagtacatgccagatacaaataatactatttaaaaaggttaagaagtagtaggctgaggacagttgtacagtgcttgcctgggttcaatccctagccccacaaacaaatgtaagtcagttagctttaaagtcaacagaaagtggaagatttcaattcctcatgttgtgtccatcaagttagaacacttgtgctgccaaattataaaacataaaaatatctcaggccttatttattgcttagaggcaagtaatttatgggttttgattgtcctctagccttttatataaatagtattatctgggctctggtgtcacacataaccaaagtgtaaataaagcaaatgttaattaaactacctgacccagctattcctaatctgtgctagtagaaggtgcatagcaagttgaccacttccctaaccctcccaccatgtacccggacatacagaagaagaaagtacagtctcaagaataattgagggcaaagataacagctttgagttctgggagtaattgttttgttttgttttgttttgtttttaaatgtttgtagctcaacagaggcagaaggatccaaagaaagaggcctagtccatgtctggcaggcaggatccttttctctaacaccagagaggttgccaggctggggtggaaagacagttcttcaggcagcccttggtgtgaggcatggagttcttctgactgaaggtatgaaaaggcggctgacccaggcccacagccctgctcatgcccgagtgtcaagtcgggcaacggttactgactactgcaggctctttgtgagctttgcggcagcttgtacccctttgttctcaaggtatatctcaactccctttacagaaattacattcatctgtacatttaacactttgtatgaactggcctggaagggggagctgtagtttacagtttttatggtagtcaccacgtaactgccctcatggagagtttcctagagactgttgtgtaccaggacagcgatgctaatgggagctgggaccttgaacacggttgagggccaggactgaccagagagttcaccatggcgccttgttccctcagctgccattgtttacagataagcaagaagtgagtgcagaatctaaactgagtgccatttgttggagctgtcttcctactgcccctgtagccacaggccacagtgtctcagtacagtgtgtcatggtggatctgtccatctaaagtagagacacatagagactcacttttaatcttgttgccagtttatcatagaaaatttgacttaagtcaagattctcattggcttctaattttaaatttatatttatattgtaggaactaagaagaaaaactctaggaaacagcttaaatctgggtttagaggtattacaaaataaacatgagtatatgagagttctttctatgacacattttaaattgatatttaatttaataaaatatacatattttattaagattttaggaaatacttgaaaaatgtgaactataagttcagtatatactatctatactatggatttgaaaatatataattctcaagagttcttggaagaactccggtggtctttctcttttttggcagttctgaggattgaacctggggcctcacataatcctacggaaactctggtactgagctatagaaccagcccttgttgtaaataagctgtttggaatatgttaattacagtgcctgaaacctttattaagtacgatatttggaggccttttattaacgtcataccattgacatctagagttaggccagtgagctggttcaggggtaaaggcacttgtcacacgaggctgacagccgagtctgctttgcatccgcatgagggctgaaggagagaacccgccccttggagttgtcctctgacctgcacacgtgctgaggagtgagcctcccccacacctcacatacacattaataatcatgtttttagtaaaaaatcctgtagaattgtagtcagggtgtggttgctggtgtaggaggctgaaacaggagggttgccacaagtttgaggctagcctgggcagcatggttagttccaagccagcctaggtttcagtgggagaccctgtctcacagaagctgggacagttgagggaaaacttctcattgttttcatgtttaagcaatatcatgcttctaagtgtccaaattacaaaaagaatgcagactcgtctcagctggggatgggtggagctcagtggtgtagtacatgcttagcccggaagccctgggttcagtctgtagttaaaaaaagaaaaaaggaaaaaaaaaaaaaaagaaaattttcatctcatatcatggcgtatggtgctgttttccaggagggaggttggcatagcaggacttttgtctcaggactgctggctgcctttgtagtggcctgtgatgctggctatgagtgggcccgtgctccttacagttcctttgtaaattctcatttcaatccagaatgcggaaagatgagtggagcgaaatgccctcagcttctgagttgagtctttgaaggtctgaaggtcttcgctgatgaaatgcttagctagctcactaatccctctcctttctcttttgaaccgtagatggtgaggtctacagctttgggactcttccctggaaaagtgaatcagcagaaatttgtccaagcagcccccttctagaaagtgccctggttgggcatcatgttattactgtggcaacagggagcttccacagtggagcagtgacagagagcggggtggtgtacatgtggggagagaatgctgccgggcagtgtgcggtagctaaccagcagtatgtgccggagccgagtcctgtcagcatttctgactcggagaccagcccgtcattagcagttaggattctgcaattggcatgtggcgaggaacacacactggcattgtcactcagcagagagatctgggcatggggcaccggctgtcagctgggcctcatcaccaccactttcccagtgacaaagccacagaaggtggaacaccttgctggacgcgtggtgctccaggtggcctgcggtgcattccacagccttgcacttgtgcagtgcctccctcctcaggatctgaagccagtcccagagagatgcaatcagtgcagccagctgctcatcaccatgacagacaaagaggaccatgtgataatatcggacagccattgctgccctttaggtgtgacattgtccgagtctcaagcagaaaagcatgccagccctgctcccagccctcacccagaggcactggatgagcagggagaggtgtttgagaacacggtggtagaagctgaactgaacatgggaagcagtcagaccacaagtggcagtgccatttccacccagcagaacgtcgtgggaacagctgaagtgtcttctgccagaacagctccgtcatacccagacacccatgcggtaactgcatacctgcagaagctgtcagagcattcgatgagggagaaccatgagcctggagaaaagccaccccaggtccaggtagctgctacatttcatagcataaatgttatttggagttatcaaggttatttggagttaaagtctttgtttttgtgctcctttaagagctgaagtcaagttcagcaagtttttttttttctccctcagtcaggctgctataattctgtctctaggctctaagcaagcctagagaggcgggagcctgtgctaattcagaaagatgacatgctgggcttgctttagttagaaatggcttgtattttgccatcctggcattttgcaccacattttggtagtccccagaagagtataatcagtataacgatggctcacagagctgcttctggactggactgcggtgtctcttcagagttcctaaagctctcccctctagcgaggttactaggctgcagagcatttagttgtaggcaagcctatgacaacttaacagtttctagacttggttctgcatgtacataatttaggaggccaaagcaggaggattgctatgagtttggggctagcctacactacgtagtatcaagccagcaagggctgcaattaacactcataaacaaaaaccgaaaacaaaaacaaaaagagagaaaagaaacgaaacttagaggttttccattatgtttcaggtttgttgtatttttagttttgttttcagttattactggtccttactgggctttatttgaggtggggaaatattttctattgtcttattctcattgaattctcactgaagacttcagagtgggtgacaccactgctggaaacagtgttccaaaaagacagtttctggtttgctcttgggattactggggatttacgatttgctttgtgccaaaggtggtagtgggaaggaagcaagccatctaatcaggaatgaactgtttctgctctttttcactcaggggctttacagccatgagagctctcagttctttattcccaaagctactgtcagagtacgaaggtggggtgtttttagaaacagtcttgggtcacacaaactctttgaacttgttggtacctgactttttttttttcaattaagagtaaactgtttataagaaaaaaatctaaagaaagcaacattaatttaccaagaatgtttatagaaaattcttaaactgtatgtgtttataaaaaaatttgattttcctgatcttaagtttgaggccagatcaggctacagaggtttttgcatcaaaaacaaacacagaaacgagtttgcccttttagaagtcattcctctattaaatttaaggctgaaagcttattgtattcagctcatttgggtatcaaattaccactattaaaattctgtattccaaaaaaaaaaaaaaaaccataagatatttcactttcctttgaacttattttgataaattaagtttttattatgtatattggttttggcagtgtgtgttcctattaaatttaacttaatctttgtaggtaacattttagccttacactgagcagaaaaatttatatgctttgttattggttgactctaaattctaaaattatgtcttcaatcaaaatggctagtaattaatttttccctactttatttgtttaaatacaattgaatagctagaatgtagctcaatggcagagcacttgccaagcatgcttgaggctttcatcacctcaaataagtaaagatataaaagtatacatgtatgcacacacacacatatatacacatatatacatatatattacatcattaacagtagcttaagtctatgggcagtgatttctgccttgccttgcctcccctcccctcccctccnnnnnnnnnnnnnnnnnnnnnnntcagcgcttccttcagatgccctcagggcacctgttaggagcatcacagatacaacaggacaaagggtggagtcacagtagcactgaacccttgtcatgagacctaagccatcagagtacttgcctttaattgtagttttcaagcctctgctgactgttttaattagattacttatttgcatagaagtaacttctaagtttctaatgtgtaaatatgtaatttgataaactatactgagtgcctgctgtatgccagatactgtgataggcactgggaattacttaaaaattagaagaaaattagaagccattgttacttctatttggtttgttgttgtttttgagatagcatttcactgtgtagcccaggctggcctgacctgtacaaacatactttgctaggtttggttctgaaatcagaataaattaaggaacaatgtgcatatctttggatataaaaagcagttttttcaaaaaattatatttttaattgtgtgtagatgtttaactatgtgtaggagtgggtttctgcatgtgagtatgtgcatgtgcccgaggaggtcagagttgttggatccccaggaactagaggtacaggtggttgtgaaccgcctggcatagtccctggtagctgaacttgagtcctctgaaagaacaacaagtgctctaaaccgctgagctatctttccagccatcaaccctatgagaagcagtagtttttcagtgtaactgtggttatatgtcaaaagctttttggtgtttattgagaatatctaatttttttctttttagtaaacagtatttgatatttcaacctagttttcactggtactgggaattttttattgaactttctaatattcccacaaagcatgctaagaacactagctccatgtatttaattattaacctattccttttatcctctgtggtaaccagagcaaaggttgtagcatgcccggctactgtgtcacaggagatagtcactgatggatcagctcgagagtgtagttgaggggtagtaggttagggcataaaatttcctcctatacaatttacatctaaatcttcattataaagtgttttagaaaaagccttcttttcttaatatcttatttcttctgtttcttagttagcaagtaatcagtttaaattttcctaaaagtatttaagtaataacaatttgagtttttccaaccttctacccagggtaccttgcattaaatccagttattttcttttttttatgtctatttactttttgggacaaggtcttactatgataggacaggcttgctagctttgaccttgagcacctcttgtctcagcctctccagggctgcagccagggccctttgaacctcaccctccttttcccgtgcttggttttataaagtggctagagagcatgttaacatgccactaaaaccatggcaccgagaccagaggaagctcgtagatgaagaactaggtttcaagcaccatttccatatagtatgttaactctgctatcaggaggggtgagacggaagatagacagttctgttgtcattggcctgggatttgctgagtagcccaggctggcttcattcttccccctaagcctccttaatgctaaggttacagacagacagatcgcctttggatctgttttagatttttttatgcagatagctataagcattaaactactgactgcttatgtttttatctactgtgtatgtgtgttagcctcttgtagaagaagcagttcctgatcttcacagtccaccaaccacaagcacctcagccctcaacagcttggtggtctcctgtgcatctgctgttggtgtcagagtggctgccacctatgaagctggggccttgtctctcaagaaagttatgaacttttacagcactgccccctgcgagacggcagctcagtcgggcagtgcctccacaggcccagaaagtctgaaagatctccgagaagagcaggtgaaacaggagtcactgcaagggaagaaaagctcaagtctcatggacatcagagaggaggagttggagggagggagtcgaagactctccctcccagggttgttgtcgcaaggtaatgcctcagtgcattgacttctggagagtcctgggtgctgccagcattgcatgctgtgatataacaacttagtcttcctaatgatcagggctgactctgaagtttctataaccgtggtttattaaaacagtgacaccattgcatacactagaaagcctttgttgcaaggaccctgatatagccgtctcttgtgagactagtccggggcctaacaaacacagaagtggatgctcacagtcaactatttgatggatcacagggcccccaatggaggagctagagaaagtatccaaggagctaaagagatctgcaaccctgtaggtgcaacatcatgaactaaccagtaccccagagctcttgactctagctgcacatgtatcaaaagatggcctagtcggccatcactggaaagagaggcccactggacaggcaaactttatatgccccagtacaggggaacgccagggccaaaaaatgggaatgggtgggtaggggagtggggggggggtgtgtaggaggcttttgggatagcattggaaatgtcattgaggaaaataacataataaaaaaaataataaaaaaaaaaccaaaaaacagtggctttaagagaaagctatcagtttctctgcttcagaaatagttacaggatgaatcttcagggtttttttttgtttgtttgtttttgttttttttgttttttgtttgagacaggggttctctgtatagccctggctgtcctggaacacactttgtagaccaggctggccttgaactcagaaatccgcctgcctctgcctcctgagtgctgggattaaaggcgtacgccaccacgcccggctgtatcttcagttttttaagaactatttaaagtttgtcctgctacgacattgatttataagatttacttcattagttatacattgttttcaataccataaaacattctttaaaaaattaacctagcaagatatagtgagccacacctcagtcctagcactctggaagcagaggcagtcagaactcagagttgcagggtagcttggtctacacagtgatttcccgaacagacagggccacatagtgagaccctgcctcacaacaaataacaacaaacaacaacaacaacaaagccaagaaaaaaaacccccactaactaggtagtcatccagatatataaagactttttttttgtttttgtttttaatttttgtctatgggtgtttggcctgcatcgatgtctgtgcaccatgaacacgtctggtacccatagaagcaggaggagggcatcagattgcttggaactagagttctatgtggaatcaaacccaggttctctgaaagagcagccagttttcttaactgctgagctatctctctagcacctcactagctttcttcccatcgtagaagtttaaatttttatgttttaaaactaatcccttattacatttatttgttatatatttgaaattaaaagttggcttgaaaaacattagcttctaattatgttttgaaatagataaggtatttgtgaaccttgtattttttaatagcatattctgtttttgtttattgtttgtttgtttgtttgttttcttgagacagggtcttagcccaggcagtcctggaactctctatagttcaagatgccctcagactctcagcagtcttcttgcctcagcaggcaatacaagcatgagctactacacccatttatttagcttactcttcggaatataagttctctgggatgttgataaatgttacacggagaagggttctacagccagatgtttggcagtgtgacagattaaacttttaaacaggcttttaattgcaggtctcatgagcatttctcaagctcttttgaccagtaaagccacactctgttgcaaagaagctaaaggtatttttataaacgccatgttggtgattgctttaggatgttccggtgaaagcattgtgtcttctgcttccccacccctttacccagctcttgtttgtcttcagtttcccccaggctcttaaggaaggctgcgagggtgaaaactcggacagtggttctgactcccacatacagtggagaagcagatgcccttctgccttccctgaggacagaggtgtggacctgggggaaaggcaaggaagggcagctagggcacggcgacgtcctgcccaggtgagtgccaccagcatttactgatggggatcagcttaggcaatgacctttttctcggggtctccatacacctatttcctccaacaggacacactactgtgcaccattagtgctgataaaaagctgtcaccttagtcctcagtgcctaacagtacaggactggaggctgggcatggtgacacacgcttttgatcttagcagaagagagagatgagggtgggtaagtgagtttctgtgagttaggccagcctggtctatataacaagttccaggccagctagggctacacagagagaccctgtctcaaaacaaacaaacaaacaaaaaaacagtaaaggactggagtgtccatgcacacttgtccatgtctggtttggtgtttgtttatcttggaatgcagaacatggtgttaggaataaggtggtatgtcattgagacatttgagtagttacagtttaacttacaaagaggagctgacaagtttctgatcccaaaagatgtagctatgcttcttaaaatagctattactaaagcattaaaatatgtgtacatcagggaacactgtcattttgcttaataggcattcccagaattaacatgcttgatatacgtgaagatgtgggatagactgtctgaagcagtgggctaacgtgctaacctcagcagagcgcagggagctgaaccggaagctgcctttcttctccctgtgctgctctctcttatggttctgcagcttccacatttctattagggttgtactgggaggtctagcctgggcttgaatttgcagtgatcctcctgtctgcaagtgctgggatttaggcctgtgtaccacttctagttcagattaaacttttggattacctagttcttaatggatcctggataataggatttaactactgatgacacaatgctgcagttaaaaactaccgagaattaggtgtaatatttagaagtagtgtgagcatatgcacattatttttgacattttatttttatttaacagcactagctatataatttgagaaaggccatgattcatgctgaaaacacttttccttgtgtgtgtgtgtatctctttcctttaaggcttcagccgttgtgtgtcaagtgtctggatggtaaagaggtaatccacctggaggcgggcggctcccactccctcgcactcactgcgaaatctcaggtaagaggctcactggagtgctgctctcggttggatgggaggctgttctgttgcaactctctctgagcgactgtactgtaggcagagctgtctctcctttgagcagttaggttgcactggacagtatttccagtttatagataaggggaggagagcaagagaagctatccagctcttctaaaaggcattgttctggctggtaaagcttccatttaactctagcccgagtttccaggtagtagagcctcagttcccttatgaagaagattcttagtgtgacactaagaaaaaaagccatttttgttttgaaatccaatttatacaaaaaccctaagaaaagaagtagttttaagatgttaagattttagttgaacagaaataacccgatactagaaacagacccatgtcttgactgtcttcagggcaggcatgttagaactacttaagaaacaagaccaagtatgcagtagattctgccagagtcactggcttcttttttgtagggcaaagattagaacttggtatattctatttctaaatggagaagagacttcagataagcaaacaaatagaatcatatgtgcttaagaacaaatattatgtgattttccccccagaaacctaagaagtagaaaaaaagatttgacatcaaattacaacaaagggtacacacacacatatcccagtgggtttcagtagggttatttaccgggacacatgcaccttaccagtggctgtgccactgaagaaaaggtgtcagtgagtgggacccatgacttcctatgccatgagtcttgtgcaggtggactagcctcaaagttgacattctccctcagcttcctgactgccatgatgatcataagcttgtgccagcaggccaggtttcatttctagtttctttttttgaaatgggatgagacaagctctcactttttaatccaagctgctggtactgaaaaattagctcagactaaaaacttctcccaccttcctgagtggtgggctttcagggctgagccactgtgtccagctaatacctattattttaacaagtagaaaattaatgtgaataatttctgcgattataggtgtttgagaaggttcagaacaagcatgcaagattaaacttatctgtctatctgctcccctgttgtttctgataggtttactcatggggcagtaatacctttggtcagcttgggcattctgagtttccaacaacggttcctcgactctcaaaggtacttttgtaaacctaatagcaacatattctgggattctgtgttgtatatttagagaaattgtttttatagccaaatttagtttataaatattttcctaaaattttttgattctttttttaaaaaaggctttatgacacaaagccattccttttccacttaaatgtaattcttaaaaatgtttttcttcatagctttaactgttcaatgaatatttataatactcctgtcctttttttagcaaaaaaaaaaagtcttcttttaagcaaacttttacttctttggtgtattcttttctttattccatcaaataatggcttctctctaaacttgaatttgacaagtcataattttctggtgtgtatgtgtttattttatagcttataccagggtaaacctattagtaacccttttctgtagcaaagctcaaggtttagatgactctgttgtatagattggttttcatttatgtaagtattagtattgagtagtagattctagtcccttctgtttcattctaggtcaggacttcccaacctttcccctgctctaacaccttgaagaaatgcccatgtacagccagtagtgcttgttcctgctacggtgtttagagtcaggatggtgtgagccagaagcacatcagaatgggatatggtactagggctgcctttcccgtccaagacagactccctgctgagagtaatagagattgtgagggatagctgcctcaattctgagaacgtggtccaaatttaaactataggcaaaatgcatgcatctctgcttaaggcccacagtggtggctctcccttcagtgagctcaattctattcaaacaagaagactggaaaaagcattggggaatgttaaattactgcatctagtttcagtagtagatattttccttttaaattagaaagttcttaattatgagtatgtatggatagccacaaaagccagtaggggcatctgatgtcctggagtgtgagctctggcatgggtgctgggatcatgggtcatctatacacgctcaatatgtcctcttaactgctgagccatccctccagccctgcatttagcatataacattttctcaatatgcagcccaactactgttacttaaacacaaagattcattgccccgtcattttaaaacaaagtagaagcacccctactcacgagggaaagattttggggctagccctggtggcacaagccaccttcttcccagcttctgggaaggctgaggcagaagaattgaaattcaagttctgcctgagctacagagcaagctcaaggccaacctggacaatgcagaaagaccctgtttcagaaatagtccagaaagggttggggctctagctcactgttggaatagacactcagcaatcatgaggctgcaagttccatccccagcaaacaaaacagaaatcttaccaaagacaatgctgtagtgtgggggtcagaggacctgaaagtctggtttgtatttagccttagccctacggaatttgttacaaggttagtctcacaacgttgtatacaaagtacagcatgaaggtttgttttatttggaaatgggtgtatatttgtttgtttgttgtggtctggagatgagaagaaagtccttgcatgtggtaggcaagacctgccacacttgagctacagccacacactacagccacacaccacaggactgatggtttgaaatcatcttaattagtctatgaaagctaaaaattgtctagtgagatttgagttagagtttttgttttgatttgaatcataaagcccaggctggccttaaattctcggttcccctatttcagcctccaggctcctgggattactaatggccatgtgctaccatgcccagttctgaaattggttttttgtttggttgtttgtttggttgtttttgtatttgttttttaaatttggtttcctggcattgaattcaggtcccaggttttagaggcaagcaccttatgtcctctgtgccattgcacaggacctcttatgtaagtctctttaaaaattactttatgtgtatgaatgttttgctggcacatatataagtgcattgcatgtgtgtctcaggttttctggatctggagttacggatggttgtcagccatcgttctggttccagatcttctgcaagtgtactgagagctgagccatctctgtagcctcctgaattggttttgattggagattatgcagtcagaacttgttggcttgctgaacttggttagagttggttgtatacccctgaaatcctggtactcaggtagtgggggcattcagcctagggaaccctatctcacacataccgactgggtgattcattcttctcacagtgaaccggtagtccattatttggatggtttaattttaagaacagagaaggtagctgagatgtaagtagtggcagtgcgtgcacactcacaataattgttgtgtagagcctggctggatgcacagggtttacctgatagaggctgaaggaagctggaggctgggagcagtgctttgctctagtacactttcttaatgaagtcttaggaggaaggccgtgcagcagacaggacagtggtaataatagtaagtagtaggttgcagggtacctagaagtctggctaccgccttttgatggaagctcctggggtactatgtggagtcctagtgtttgaaagccagcagtttctagagcttggttctcaagcatttgtttgcatttgtcagggtcacctgaaagctggaaccctcctgggtgatctgtggctgagagcttgcatttctaacatgtttccaggtgatgctcctgctgctgctgctgctgctgctgctgctgtaaagaccactctttgagaaccactggtctaggtgcctgtaggtggtttctcaggggtcctgcctgtttcagcattctgggagctggtgccagagagatagtgagttacaagtgggaactgaatctcagcaccaaggatgcagctggcaataatgaaatctagccttttcattatctagatttttttttttctttttaggtagatttttgtcacatggctgagtatcgatgggcaaaggtacgttctagtgttagagcagggttctagagtctccttactgtagactgtttataaacacctacagaataacattaaaactaggagctatgccttttccttcccatagtctatgttttcagatttttataagcttctgattcaagtttaaaagctgagccctagccttttgctctcttctgctgtaggtgggtacattgctggaagaggtccactctcaccggcatggctaacttccttatgccagcttaagtaatctgttctcttccatgcaacttgagttctccttggctgccttggacagacgttatctttctgtcgtttcaggttagcagtgaaaatggagtctggagtgtagctgcaggccaagattattccttgtttttagtggacacggaagacttccagcctgggttgtattacagtggccgacaggaccgtgcagaaggtgataccctgccagagaatcccagtggtacaaagactccagtacttctctcctgtagtaaggtgaactgcagtagaattgaatcctaaggcccacactctagcaccgaggagtctttgaacattgctgactgtagtgtccctgcaaagcccttctcacccttcccttccctccactcctccattcttgctgtactctccccacagcacctgtcaccatgtgaaatgctgtctgccctcctgtactgtgagggatatgggactttgtgactctctgttcattgctgtgtctgcctacgctgtttcgttgtcctcgaggcaaggtcttgataagcatgcagcccaggctggcctggaacgtgctgtgcagaccttctgcccccttctcctgaggagctgggaaccctggtgtgtgctggccggccgtcatgctccagcaccgtgcgtacacagtgatacacagctgctgaggcggcactcctgggagcaataccatggctgtgctttctgtttgcttgcttttggttgtgatgctggggttggaactcagggctttgtttgcactggacaagaactcacctctgtaactaaccccgggtccccccaccataccttctgagcctttttctttcatttctcttttgctatgctagtactggaacctactcatgcagcgaagtctcccagagccctcaggtgaattctatcagaagttctttctgttggtggacagtgctaacttgaggctcctgagccaagctcacagagacaggcagtcctgacaagtcactggtgggacttaacgttgggcccctgttcccttggccttcatttctgctagtttagctgcttctttctcttgaagatccacattaatgtctgcttttctaattctgccttgtttacttacatacttatatattagctagtttctgctttccccttattaaagtaactcacatccccacagagacatgtcaacagagggtataaccctccatgctggttcattccagattttctattctcattgaagaatgtgtttatggactgtagtttgtcgttggctttcttgttaataagctctgactgtattgagacaagaccttaattgccaaaggcagcattggccaaggtttggctcttgacctacatgtagtctgtttgtggcatgctgactggccctgggcaatagctggcctgtcaccatataccctgtggaagattcagtctagataaaggatgaaaggatgaggctctggtgtgtgtcaccagtttccttggaaggttaatagccacagtgtacagcctgcctgcctggttaaatgaggaaatgtaaataaagacattgattaattttgttcatactaggaaggttaaaaaaggttcctttcagagaagaaccttagcacatgctaactatagacagctgtgacatttatcacatatatacagtgggtgctgaccatatcagggtaagtggcatgcccatcaccttagacatcctttttgtgacaggagcattcagaatcctttcctactggctattctgagatattcagtggattcttttgttttgtgagccagggtctctctgcacagccctggctgtctcagaactcactctgtagatcctcctcctctgcttcccaagtgtagcatcagacatttcctttttccttgcagttccgtttgccctcgccagcttctgacctcacgccctttggtaaccactgctttctagtcagttgctgaggccatgctctatgtgtctgcgcccacaggtctcactctttgcccttcagtcctacccctgttatcacaaaaagtgaaagttcactttgggggctgagtagtgctccattatctacacattacttactttctttatgcgtgtttctgccaagggatacctgtgtgattcttctgtaccttggcccttgtgagcagcatgtgactacagatgtcatcttgacatactggtctgagctcctttggaagtactgagtagtggggttgttggatcttgtaatagttctttttataggtttgtttgtttgtttgtttcaggggccaccatacttttctttgctggccatactaatttaagttcctatcaatgaggtgtaggagcccctcattttccattttctttttcttttctttttttttttaaagatttatttatttattatatctaagtacactgtagctgtcttcagacacaccagaagagggcatcagatctcattacaggtggttgtgagccaccatggggttgctgggatttgaactcaggacatttggaagagcagtcagtgctcttaacctctgagccatctttccagccccccattttctttttaatgaaattaaattaattctgtctttttggtgatggccatcctaagtgcttctattggccatttgaggatcctctggaaaattccacgtaggtcagtttcccacttttcaattgcattatctgggattttttgttactgagattattcagttcctttttcactctggatattacccctttgttggatgaatagtccaaagatattttctcctcttctgtagattgtcccttcactttattgctcttccccccccccccatccccccactcccaaaaaaaggtttcagtgtaatacagtctcatttttcagcttttctttggctgcttgtgttttagggtcatatccagaaaaacctttgtccaggccaatatctagaagcacttctgcgttttccttaatttgtttcttgattttgatttgtgaagtagagtcttctattcaaggctagcctcaaattgatcctctgtctgggattgcaggtgtgtgccaccatacccgttcttttttttttttttttcccttgatgcatggtctcacactgtgggccagactaacctagaacccagtatgtggccagggtggccttgaactgccagcattcctccagcttcctctgagtgctgggattgattataggcatgagccatcctatctggctgtgttggcacttgaaagagacaggatcatacagaggccttgctatgtatggcgcaggactcctccttgtctcatgtaagtgagtcttgaggtgtgtaactcttttcttttcttttcttttcttttctttctttctttctttcttccttccttccttccttccttccttccttccttcctttctctctctctctctctctctctctctctctctctttctnnnnnnnnnnnnnnnnnnnnnnnnnnnnnnnnnnnnnnnnnnnnnnnnnnnnnnnnnnnnnnnnnnnnnnnctgtgtaactcttttatcattggtgtctttgtatgtctaaggtatcttggagatgaatagaattaggtatatatagttactcacatttagcagtggtatgtgagtacaccaactccaaagcaaatgagaagagctctgatatgttctgtttgtaaatcttcacttttaagctattggcagtttaatgactgcttaccagcacctggtatctgaacctttggctcctgtctgctgctgtgagcccatacaacatgccagattgctgtttataaatgatattttatccttaatctttttattttctacctgttttagcttggatacataagcagagtaacagcaggaaaagatagctatctagccttggtggataagaacatcatgggatacatcgccagtctccatgagttggcttctacagaaagacggttttactcaaaactgagcgaaatcaaatcacagatacttaggcctcttctcagtttaggtaagttgatacctcccgctgcctgcacccccagatcatccgggctcttgttttagctgttctttctgtattgtcaagaggcatgtttgtttgtctgctcatttgcttttgtagacagggtgtcctgtagcctcactatgcagctgaggaagagcttgaactcttgttccttttgtcgccaccatccagttgctgaggctgcaggtggaagctgccatgcctgccttttttttttttttttaaaaagatttatttattgttatatgtaaatacactgtagctgagagggtatcagatctcattacagatggttgtgagccaccatgtggttgctgggatttgaactcaggaccttcagaagagcagtcagtgagccatctcaccagcccatgcctgccttttttatggttggttctatgtttgtttgtttgtttaaggcccgggctgacctcagacagtcagtctcactactacctgggactataaggatgcaccacagtgccttgcttgctttaagaaagctgtttgtgttaatggtttattcctctaccccacacccctatgctccaagcaattcacagctgtttgcctggatgccccaactctgtcttcatattcccctgagctccttcttcctgtacccatagagactagagctttaggaagatgtggctgaagagagaagtatcttcttagggaaagttgtgcctagaaactagacttgagcaatacttctgcatcctagctagtcccttacacaccttatagcttccacagannnnnnnnnnnnnnnnnnnnccctgtacatggacaacagagatggagctttctctctttctcttacccccatagccagtgttagggctcaggatttaagctaatggtccaacacgttaggtttcacccttgtaaggaaatgcaggcttgtgtgctgagctcattgtttctagtggaaaaatacctactgtaccagctaactcagcaatttgcttttgtttatttggattttgtttgctctttagtttttgaattagggtcttacgtatcctcattagccttcaagtctccaaggatgattgaacttgcattcctcatgcctcctgaatactgcagctataggcttggaccaccacttctgactaatgtaactgtatttgcgaatacagtccctatgtaacttgaggatttttattttttgtctgtaatctgttttgctttgtaagggttatagagcccctgttgtgtgggctctcaggaattatgggatttgggcaagagaaagaagcaacagggacttcctgggttgttttgaagaaaggggagtctactgactgaccaggtcttgatttctctgttggtctttgttattttcttcttcagcctcattgctagaaatgaggaactgcagcctaggaaagtcagataattagctgtgccctaaaatttagagtgacctaggccacctgaagtgtaagttacctgtgtgctgaagaattgggcttctccctgggtcaagtgcatcagcagccaatgcaaaaagtttaagatgctaaataagagcagagcccaaacaagcttagttgctagagctggcatgctcaaggccctgagtcagttcccagccctgcataagtcagggcatggtagtatattcttgtaacctagcttgtaggagggagaatcagaggatatgaaagttcaaagtcatcttaaaaaagaaaaatatctatttgtaagagtgaatttaattcttggttgctaccctgttaccactgtgtgaaattaaattattcatttctctccttttgttttacattacctattttcaaattttaacaggtattagtttcattggattcccaatttacctgttattttttcaaaaaaacacctgggaaacttaaaagaaacatccatcctgagatgctaataccaaatcagtcatctgacagttcctatagataaggtcataagtatggcttatgtgcacatgtgagcccagaggagaacactgggttcttctgtcactctctgtcttactcctttggttcagggtctcatactgaacctggagctcactagtttttagctagactggtggtagcaagctctgggatcctcctgcctcccaacatccatttccacttgaggttgtaggtcaggtcttcctatttgcacttttaactactgagccatctcagggattaccgaagttgatttttgtaatgtttttggaagtggtttgcgttccatagattagaacttgtttcaacagagtaagtattctcagaaagagcaaactcgtaagaaagcatttggttttcatgttgttatcattttgttgtagaaaatttgggcacagtgaccactgtccagctgttgcaggaagttgccagccggttcagcaagttgtgttacctcattgggcagcatggagcctcactaagcagctacctacagggcatgaaggaagccagcagcctggtcatcatgaagcactcaagtcttttcctggacagctacacagagcaagtatctgtcccatgtcatgtgcagtcacaatctgcaaggggagtctctcctcagtcagaggagagtggacagggacagtgctgccaggcaggagaactgagaagcagtgctaccttagccagccatagttttgcagtgctcaaattcagtcttcttccttaaggggaaaggggtaacaacgagttctcgtattcccttctgttatgatctggaatgtcgcatggcttcagaaggaccacgccaggccagatagttccacgtgaggtttattgggagagagaggagtaaggtggcggcagaaagagaagggggggaagggagggagaggggagagagagatcaggggagcctttctttatatatgagtgatgatgtaatcacaggtgaaggtgggaaatgagccaagtggattctgggagtatggtggctgttgccttggcaacaggtgttcaggtcccacctatgtgatatcacaggtcttggaggtcctgataccaacactttctatgtccagcagcaggtgatagcatactttatttacacacagtattctgtcataagtctgcttgttttgtttacttaaggaaattataccaaaatatgaggaaataaagaacaaactcatttacagctgtgagtgtgaagctgttctgagcctgcttttaactgctgtgtgatgggacactgcagctacgtttaacataaccgtgccttctgtgtgactccaaggctggttgactacgcaaggttctttgcatgtttgtaagaaaaatgtaccaagtatatttgtaaactatttctcgttttttcttgatttttattttggtatgatggaggcattaatttaagtgttattttaatgtagaccaggtgacactgttagtttgaagtatgtgttgtttttatacgtagttcatttattctccatccatctgacagaaacggacccagtgtcagcaagtgccaggcactgcacagagttacagcgtggggtcagtgagaaacacctgttgtggggagttcctgtcatgcccgtggtttccttgggctataaatatcccaaggactaatgaatgcgtgtttattatcgaaagctacaggcagtgctaatcaaaaggatatttaaagttgccctttcctccctaccaattgaaataacctcctgcagttaccttaggattttcctttcaaacttagtgtaagtgacttcagccccaggcaaattaaatttactggaagctgttgtctaggaagaaatatctttactttagtcttctaactcattaaacttaaaaaaaaaaagatagaacttgacactagtttatttttacaattagactttgttatctgcgtgaagtttcagcttcattgtgcagttttctgtttttgtcttgtacttaccaccatccctccatttccttttctttctattacttacggccttttgctttaaaaagcagtttttgataccttggctactgtttaaagtggaataactattcctataggtaagataaataaaactaacttacatcttaaaggactttaccacagtggctcctgttttggaagactctctgtccccgtcagtatcagttgcgtgctagtccaagagtatgaagagagccttcctgttcagaggagcttgcctcctccctccatttgctctagagcattggttgtattaatcagcgtgttctgctctcagccccctacacccctaagtgttttcacagccttcaccattcattttctgacgatttaattggagaacttgaaatgaagattaaatttccatttaaaatcctacagtttcaagcatgttttctccagcttgtttagtttggaagtcctacctgccaggcaggtctgaatggcacagtgcttttgaagaaatctctttatgttactgtccctactgaccttgcattgatcactcccctgttgaatctacctgttgtcttcttcattaacattgaggtcacaaagttctcacagtcatgaagaagatttcagaagtgactgcatatgcacatgaaatttcattccatcactaatgcctatgtgtctgttttttttccacccaaggtactgcacatcagtttcaaatttcctggttatgggaggattccagcttcttgctaagcctgccatgtaagtactctactcctttcagttatccttctcacagccatagagtatagtgagtgagttcttgttaggtttttcttttattttttctgtttttgtttaattctttagagtttcattaaaaacgttttttatcatattctttgcccttttcaagcttctccctgactgtgtgtgtgtactgtcacattgtctgtgagttcatctgtttatcagccctgttatgtctgaaagatggtgtttccttgaagttaccaccttggccttaaaatctttctgcctcctcttctgcatagatccctgtgccttgaggggaagggtgtgataaaggcatttaatttaggcttgagtgctcccattacagatggttatgagccaccatgtggttgctgggaattgaactcaagacctctggaagagcagtcagtgctcttaactgctaagccatctctccagccctgcaactaagcttatttattcttgggaagaaggagcttggggaatctggttagttttaggaacttcctgcaagtatttggacttgtttaccttcctgcttttggaccttccctgcaggacagaatgtttcagtctcagaggaaactgttcatgacacgtcactgtccttccagctcttagattctttgtcctctcttcctcaatgatctctaagacttagagggatggctgtagatatccacctacggataaatattagccactaggccccagcaacggccttttgttctctgtgagtggaggctgataacacaggcgaggtactttcctggctggagtctagttatttattcatgattttcaaattataatctatcttgtcagaagtgtgcttccttttaatattttcgaagagtggttgctgtttctcattttgtaaaatgttatattagcatatattaattatacataataaagcttaattgcagcatttacatacacgtatagagtgtactttgattgcattgccctctcttcccactccttctattccttcctcttctcaattactacccttcctcttttgtggctttttttttaaagttatttttaatgttttaatgtctttctttctgtccccgtgttattgttaagagtgcttttaccaggagcatggctattccagagcatcatatctgtgactataccactgaagaaagtgcctctcccttccatattaaccaaccattagttatttcttagagtcctttgggaagggtggagactcttgttttatatttcattaacttctaatgttttatttgtgttcacctactagtctttcagattcataaatttagagttcattaatttattattatatattattgttattatttattatattatcattattattgagacagggtggcccaggctaggtttcagcttgctgtgtagctaaggttctccttaaactcctgaccctgctgcctcttcctcctgaatactgggattataggtgtgtaccaccacacctggcttgtcttagtcctgtaattataattcaatggtcagcttgtgttgacagttgaagggaaaggaagagcatggaagtattagttctatgctagtggtttgcaaagggagctttctttcccactgaagtttgtgttcagctgtggccagacctgtgagattcctttgactttgggctgtgaaaataacagaatggtgtgtcatttgtcatttatcctcttaaactgtgagatgcttgatcatttcctggaacatggggaaagatctgttactagccacttcttttatgttgctaccattgctacaccttgccctttaaaaatattataattctgttattcatacctgggacatgtcactgtatctatattcattttataacacctaggcagtgtgttcagaagttactgcagtgaaactttctatgtcatatcattcagatcgttcatgccagatggtccactgattctttttccctcttttccagtgatttcctaaataaaaaccaagaactcttgcaagatttgtcagaagtgaatgatgagaacactcagttgatggaaatcctgaacatgctgtttttcttgccaatcagacgacttcataattatgcaaaagttttgctaaagcttgccacttgctttgaagtggtaggtttcgtgtgtgcccctccaaatactcgggaagccaagagtcaaagtagtttgtttgcattaagtctccttaagatgttgggccccggggctggtgagatggctcagtgggtaagagcacctgactgctcttccgaaggtccggagttcaaatcccagcaaccacatggtggctcacaaccacccgtaatgagatctgacgccctcttctggagcttctgaagacagctacagtgtacttacatataataaataaatcttaaaaaaaaaaaaaaaagatgttgggccccattaagctaatatttatgtgtgtttaattaagatttctttctctgtgaagtagtagacgtagaaaggatagcaggctagaaggagcttgttttccacgctgtggattcgtacctgctcaggaccttattcggaccatattcaacccacagtgagagctgctcctgcatgtgtcaggcaggtggagtgcatgctgactcgtagtcacagaacctgggggagagaaggcattactgaggttcagtcgccgctggcctgggttcttggtagagacacgccaagaaatgtgatttcactttgtttccagagaacctgtaccagccccgaggttccttaaagccgtcacatcctggtctgcctcctgagctcggccaactgcaggccacagtggagggactcatcagagtttctccatgagatcctcctgtgatcctgtaggggtttcttttttcagtctggttctaattttagcttaaaactgatgtagtttagccacgcaggtttgagtgactggaacacaatgggctacagacttagttaataaagaaaaaaatctttcctagatcagattagaattgttcgggaaaagtagggtgtggggcacttgtctgcaatccctgcacatggaaggctgagcagcagaagagtttgagggcatacatggtaacaccttgtccaaaaacccctgtacttgcgttaaaggctaattctggagaatgacgagtcctttagtttgccattaaggccccacatagtagacaccctcttctgtttttcatgtttccttccatctggtttgtcggttcccatcccagggtgtcattcatgtgcttggcatatccttctggaaacacagctaaccctgtctttggtctctagcctttgacgcccgtgtccaccaacacttcctgaagtcaggggtgctcttcagactgctccatctcttctgcctgcccgtctctggcttggctcctccacctgtctctgtcagcttcatctcttgagtttcactggtgctccatccttggactttgtcttcatcatacagtaccagaatcacctttggaagcttagttagcacacagcacactcaccttccatcactgcaagttacaatttaccaagtctgacgtataaggtagatgctatattgtgtgcatatagaatatatatatttaaaacttctccaagtcaaatgttaattactcctaatgtttatttagcgtttttcacataccagtcactgttcatttgttctttcctccctccctctttctttcttcctgtcgttcttccttccttcttgcctttcttcctgtctctctctctctttctctttctctctctctctttctttcttttcttatttggattttcaagacagggtttctctgtgtagccttgctttgtaaaccaggctggccttgaattcagagatctacctgcctgtgcctccccagtgctggggttaaaggcatgcaccatcacacccatctttgcagtcactgttctgagcatgctctgtattctcctttaattcatataccaaccctatagaatagctgtgaccattatccctctttacagatgagagaattgaggcacacttgaaaagtagcgagctagaattctcatctagacactctgacatcagtctgttcttttaactactccacttataggattttttttctcttatgtaagctactaactggaccattgcattgtcttgtgtgtttttataagttcccaggagacaaagatcatggcctttggtcacttagaaacttattgtttcttaaatgactgtggcaaactgtgagaccttgggatgtaattactcatgaatgggagggcctggcctttcatctcacctttgctcattcgcacatgcacatcagttacactttctcatgggagttggtttcctttgctttgctttggtttgctttggttttggtttgctttggttagctttttaaagcagggtttctctgtatatctctggctgtcctggaactttgtagaccaggcaagcctcgaactaagatatctgtctccctctgcctcctgagtgatgggattaaatgtgtttgcctttgttaaagggttttgtttttgtttttaattaaaaatggcagtatatgtgtgagcattttgcccacatgtatgtgtgtgcaccgtgtgcttggctggggcctatggaagtcagaagagggcatcagaatccctgacactgagcttacagatggtttggctctgaaggcttggtgcatagacccccagatacttttgagggtttgcaaggtcggagtgctttgctgacacaggaagacattgctttttctctgtagtgtacgcattggtaatgcacaagctgaagtcacagcaggaaccaaggcaagtgacaccacaccacaccacaccagcctcaagcctgcagttaagaccaacactactaattccctgaaaggtgtccaggatgaaccatacggatgactgtatgctgtactctaggctgcccttgaacttgtggcagtccttctctgtcagcttccaaagcgctgggagtggatgcctgtcaaactgaactattaagagcaaaatacatggagacatgtgtttgtaattttgagcttgacaatttctcaatatttagaatatctttctgatgaaaaaagtaccaatgttattttttggtgtataaaaggtattatttggatgttgtatataatttagtcagtatttttcaaatgttcagaccactatgttacaaaatgacatactcaaagccaaggtagacctgtagattttaacacagtaaaaatttttgtattacattaaattgttaatgacatttattatttcaatttatttgactgtatatgtgtgtatgtgcacgcgtgcaagttgaagttagaggacaatttggcaggaattagttctctccaccaagtaggttctaggttatcagggttggctgcaagcacttttcccactgagacatatcattaactcaactagttaatttaatagaacagtataacattggttgcctgacttccagattacagattacaacaccttttaggaaactactggttagcaagttttctttaaatgtgtaccaggggaatgtccacagttgtttgaaatagctattaaaatactccattttcaaactagctatctttatacaatcaaattttctatgtctatttcaactaagcagtataacataacagattaaaaacaaaagcacagctattgtctcaaaagtcaggtaataatgggacttttaaatagtgtgagccagtgtcatttttcagtcaaaattcttcctgttttgggaaatgacagttgttatttataatcttgttggaagtgaattaatcagtgttttatatttgtattttctaacatgatagtatctatagtctcagcccacctgtccaataccagaggaccctgggaacaaagcaggaggccattctctgggtcctgcagctctgcagctctcttcccaggactgtgccagtgtctgcccctgctcacatgcactttactggcgcactctgagaccagcctgttccctggctccctttactgtgcatctgtgttctcaggctgaattgtcttcccgtgttgactgtaactcgtctgaaccgctcataggctgaagctcgtgggcagtgttttatgctcttacccccttgttcattggtctctagacatctccagagtatcaaaagctgcaggattccagttcttgctatgagtctcttgctctccatcttggcaagaagaggaaggaagcagagtacacactgagcttctggaagacctttcctgggaaaatgacggtaaccctgcccactgtcgctgttccctctggccctccttgcttgttggtaacaatagcgttggatgattccctcctgggaatgcagtcatgagtgctctgaatcccaacacctcccctggttcccaggagccctctgcagcctttgcccttaggtttgcttgctactgttttaatctcctgtgtggtcctaaaatctagttttaggaaacgtctgatgcagcaataagctatgactaaaagtgagtctgacggctcactgaagtttgtgtttacttgcttgtaggattccttgaggaagccagagcgccggctgctgtgtgagagcagtaaccgagccctctccctgcagcatgccggcaggttttctgtgaattggttcattctcttcaatgatgccctggtccatgctcaggtaggtgggattcttagctgaaaagaactgtccacttggtggacagttgtgagctgcttcatgatgggctttgttgaaaatgtggtattggacaatttcactgctacacgaatgtcagtgtactcatagaaatctggaaggtacagcctactgtagacccaggctctctggtaccacctagtgctgccaggctgtggcccacacactgggttattgtacttgaagactgttagcagccataacactatggtaaacattagtgtatcagaatatacacaccatgtttggtatactatgatatctataagatcactaggcaaaagggattctctattgttgcttttgggactgtcatcgttttatgactgatatgtcattacatagcacatggtgtatactgtcaatttattttaagcattgttatgatttatttgtaattattgagcaaatgaatgtttatctcctgtggtgtttgcgatatttgagatctgtgtgtgtgtgttgttgctagttgcagttgaatccaggaactcttaaatatgaaacacctcctctctcattaagctgcatgctgagccaagatttttttttctagcttgagaatgagtgtcagccatgggaaagggttcttgtagcagagatgggaagatccaccagaggtagcaatgttttggtgatagagcagagatcttaaccatcgcaaggggctagtactgtaatgacgtggaaagacttaatagagacgtgagggtggagcagactcgtcacagatgtgcctttatgttctctttcagttctctacacaccacgtgttccctttggccacactctgggcagagccactttctgaagaagctggtagcgtgtgagtgcctcttctcctacgtttatttccttaagtggggtggtcgggttagcaagcttcttgccctcacttcccaacacatgagaagtgccccttgctaatacaatgtcctgtgtgccggccatggtaagcggcacacatgagaagtgccccttgctaataaagtgtcctgtgtgccggccatggtaagtggcaggtgggcgtccccatgcctccatgctgtggtgacagagcactgattctgtgtatcttgtccgttgtgtggagctcagattacagcatgaacccttaagctacttctcttctccccatcgggtgggggaggatgtctgcaaggacaggttgccaattggtgcttatccatgttaactttttaggaatggcttaaagataactacacctgaagaacaattcacactcatttcttcaacaccccaggaaaaggttagtgattgcttctctcttggccttttctgtcttttatgttagtaaaaaaaataaatactgttgcttcattaataacaattaaatcaaaactagacttgccttttttgttttcccgaaacatagtcttgtcgtgtagccctagctagccttgaattctttctgccttaacctcaagtgtcaggaatactccaggatgcccgattgtccttactgaattgtttgtttgtttattcactcactcattcatttattggtagatcttcctctgtggtccaggcgagctggttcacatctctcaataagcacagtgataggcaatagaaaaagtactgcagaagagccagcaatactagtataggcttgatgacttattgctttaaacttgctgacatgggctttttgcttctagaccaagtggcttcgggctatcagccaagctgtggatcaggctttgagggggacgtccgatttcccactttacggaggcggcagcagtgttcagagacaggaaccacccatctcaagaagtgccaaatacactttctacaaggatactcgcctaaaggatgccacttacgatgggcgctggctttcagggaagcctcatggcaggtgaagagtgcttcatatttgtttccagggaagagagggtgacaatcacatgatagaaggagccatgactatctgaaacgttaattgacagtcactactttctgcttatgccttccaggggtgttctgaagtggcctgatggaaagatgtactctggcatgttcaggaatggcttggaagatgggtaaggatgtggtttaaagcagaagatgaatttaaatgtgctcacaagttatttaatgttgggagttgcttttcaaacaagcggttgatttatgatgtctaggtatttgatgctgtgttaggattcacacagaagatatgtgggcttgtagacatggaggatgacatttatgtgagccagatgacacagcagtgtcacctttacacaggggacatagagaaattttattttcagtggttttatagaaatactcctctccactccccctccccccccccccgacttcctgtgttgaggatagactccagggtcttgggaatgccgggcaagtgctctaccactgagctacatcttaggcctgcttttatgcagtttcaaatttgtttctctgttaaaaggggaattttgcagtggtgttattgtagcaatactcaactgacaccgattttgtataagtttgttctgttttcttttttcattgcattcattcattcacttatttattcagtatgtgtaatgtatgtgtctcggtacatacgtgccatgccccatccagttctctccttccactatgagagtaccgaggacttgaacttgggccaccaacatgacagcaggtagctaatgcttttaccccaagccatctcatagtacatcctattatattttctgttttgttttgttttgctttgttttgttttgtttttcgaggcagggtttctctgtatagctctggctgtcttggaactcactttgtagaccaggctggcctcgaactcaaaaatccacctgcctctgcctcccaagttctgggattaaaggtgtacaccaccactgccctgnnnnnnnnnnnnnnnnnnnntttctattcttgcacaaacatcatgaccaagaagcaagttggggaggaaagggtttatttagcttacacttccatactgctgttcatcaccaaggaagtcaggactggaacttaagtaggtcaggaagcaggagggatgttccttactggcttgcttctcctggcttgctcagcctgctctcttatagaaccaagactacatgatttacccagagggatgctgtgaattagtgacaaagacaggcaaggtcacagatgccctgcttttcattggctttagaataaagcatctcaccagtgactcagggcagacctggggtccactcctctcagactttgcatctgtgcatcttcttatgatttttattcttcttggcagatatggtgaatacagaatccctaacaaggccctgaacaaagaagaccattatgtaggccattggaaagaggggaaaatgtgtgggcaaggagtctacaggtaaaaacctgcattgcaaaggttgctggtctcatgctgcctctccagagaactgtgtaaagctaaagcttgtgtggacagaattcccaaggagcagatttagtctttttaataaccaaaactgtgtaccaactcgtcattgaaagagcatcccctcctctgtggcatggctcacgtctccattgcacctatagaacaaaccctgatatctacataagtcttgcctagaagtttaattttttacttgactttgatctcgataaaactttatgctttcctccttctcattgatagctcattatttcattttccataaaagactaaatacatttcttatgttaatgcaaaatattatgttatctttgatttttgaggctcagttcttcaactagaagtgctacccataagcactttgtaatgtgcatgttatctttctgtcctttccaaccacagctatgcctctggtgaagtgtttgaaggctgctttcaagataacatgcgccatgggcatggtctgctccggagtggaaaactgacttcttcttctcctagcatgttcattggccagtgggtaatggataagaaagcaggatatggcgtctttgatgatatcaccaggtacagtctgaaatgaaaagcagggcatctgcttctgtctctgtgtgtacagggaaaagataatcttcctacctctcacgctatttccttacttttaattatttgagcatgtgtgtgtgtgtatgtgtgtgtgtgtgcttgtgtaaacatgagtgcactgtctgaggaggacagaagagggcatttgataataccctggagctggagttactgggggttgtgagctgtggatgttggggctgggagttgaactctggtcctgtataagaacagtacaagctctttattgctgagccatgtctctagccccgcctcccaattatgaagacttgaacatcttacacctgtcttagccagaagaccaagaagcaccaactgcagcttcttaattgacagcattaagaaaacttttcggtttggaatggtggcacttagaggtgtatgcttgtaatccagctggggaaagccgaggcaggaagatctaaagtttgaggccagcctgggctacatagtgagactgagttcacttcactcagcacaccaatggaaagaaaaagggaacttaccataaggaaacagttggcaggatttttttttttttaatctcatgggccaaattacttcacaaagtcagggtcattcagaattcacatgggtactgttttcctacatatacaaagtttttactgcctcaaaagctatcaaatcttttaattaattgatttatttcatttgagatcagctctgtagcccaaggtgaccaccaaggtcccagattccttatacagtcaaggatgaacctaaacttcagaccccccaatttattttccaagggctagtactataggtgtgtgacaccatgcctggtttatgcagtcctgaggctcaaaaccacagctttgggtttgccaggcaaacattctatcaactgacttacatcctatgccttctgaatctttattgtacagaaaaaaacaaaacaaaacctttaattaaagtcaatagaaagtagggatgggtggtagggatcagtgacagatgacagcactgttggggctggacatagactataaatatagagcgtcttcctgtcatgctcacacaccaggaattaagtccacttgcttaaattcaggtaaccaagccttagacagcggtgtgtttcttttgctctcacatttgatttggtctgtttacttggatttagtgtactgcccctctttatgttaagcaccacagcttctgtaataacgggagtttttttgtgtgtttgtttatttgagtgagttgaggagagccttaaagctagacttgaactcctgatcccctcccccattttctctcattatatttggactataggcatgtgccaccatgtcctgtcataatgtgaattttttcaaaattacctttatgggtcagcaagatgactccatggtaaagacttttgtcactgggcctaaggacctgagttccatccctggacgtatgtgatagaagagagaactgactccacagattgtcctgtgccctccacacatgtgctctggcattcatgccccgccccaaacacacaagttgaatagaaatttttattattttttttaatcaccaaactaaagatagattttttttctttctttcttgagacaagatctcactatgtagccttgggtgccctgggactcgtaatgtagatgatgctggcctggtactcacagagatcctcttctcccaagtgctgggttaaaggtgtgcattaccatgcccagcaaactgtatgatttcacaagtagtttatatacctctgcctcccttttacctgtctcctgtcactaccaagggctttgagcctgcaccaccaagctatgtcctgccttaatttatgtttttcttctctctttgagaaaagttctttctctctagccagggtctgtctggctctaacttgatcctcctgacctatccttccaagtggtaggattgtaacaatgacccaccatatctaattcatattttattattttttttgtagcgattgtaaaaaaccttctaagagggtaaaaattaaaccttttatgacaaactttaggaaggaaaattgttcaaaggtttgattcaattatcctttaaatttgtggtgttcttttttaattacatattttattgagacagtcacactgtgtagctctgcctagtcttggtctctcagagatctgccccctgagtgttgagaatgaaagggcactccttgaagttatcaaggaagcttgtggagtgttgtcagtctgctgggtagtatgtcagctcctgtgtgagtgaggcatgtatgtccctcaccatcacacctctctctgaggagatggaatgagccactttgactgggtgatggtggcagtccagattaggcgtgtaatgcaggtccctgtaagaggagtttttctcactttgtccttgttttatttgtctttcatctttgttttcttctgtgcaggggagaaaagtacatgggaatgtggcaggatgatgtgtgccaagggaatggggtagtagtcacccagtttgggttatactacgaaggcaacttccacctgaataagatgatggtgagtgggctctttatatgtgtttcttgtcagctttggaaatctcctgtgtccctaacctttaaggttttttaattaatgttctacttttgttttggctccttgagatgaggttgcactctgtaatccaggccaggctgggaccctggtgaatacctacctggcttggaactcatggaaaaactgcttctgcctctctcttgatcctgggaccccaggcctgagccaccgtgcctggtcctgtgtgactttcttagaacaatttcctactttgcagatggtgggaggctttgtgggtgtggctgcatgcactttcaggtcttctgtggtctgtcttgtgacttgtgttttgcttcttcatacagggaaatggggttttgctttctgaagatgataccatctatgaaggagaattttccgatgactggacacttagtggaaaggttggaaacaactttctttgcacactctcatttatttttcttgactttagaaagtttttaaagagtctaaattcattttgtgcattagtattccattgcctcggtctgttttcccattaaatctctgatgcctttagaaggaattggccacaaacccctatgtcgtcaaggatgcccttgagcttctggtccttcggcccctatgtccacctgctaggattagaggaatgcaccacaatcctcaatcttttgtgtgtttaaacaccaactctgactgagtatctgtgtgttttcccgcagtgcttgggtttctatttcagtggtgtctgtttttcatatccttccctcttgtgttgggattaatttgctcttccctcaccccactctcccaagatagaatctgagtgtgctttagaccctctggcattttctagggcagagagatgctagcagctgtggccactcctgagcactgtcagtggtggcctgtggctgggggtacagtgtgcttcacacaacgaatagtcttcccgttctcctgtccttcttctttaccctacctgtgaattattttcatgtgttctctctgggcatgtgcatgcatgcatttttgtttctttatcagaattgagaatgtcaaaaaagaaaattacaaaggaaagtgtatgatactgtttttttttctcttaattctgtaaatttaaaaatttttctttttttttctttttttttttcaagacaggctttctctgtgtagccctggctgtcctggagctcactctgtggaccaggctggcctcgaactcagaaatccgcctgcctctgcctcccacgtgctgggattaaaggcatgcgccaccactgcccggtttaaacgtttttctaactccgcttctcttttgctttatccagggaacgctgactatgccacatggagattatattgaaggttattttagtggagaatggggatctgggataaaaatcactgggacctacttcaaacctagcctgtatgagagcgataaggacaagcccaaagccttgtgagtcctgactctgggggagttactgaatgtttttcagttatcttgctttcatcaaagcaggttaatattttaaagcaaattcaaaattttaaaattgttctttttaaacaagacatagctatgtcagctgccacctatatagatggccacacacaaacacacacacagagtgcatacacatgtgtgggggtacacacacacacatacacaatgtacagacacgtgtgtgggagtgcacacacaatgtgcacatagtttgggtcacagaagtcattgcagtttatggtagaaagtctttatccttagggatggttgttcacaaagcagagatgaataagtttggtgcggctctatcagcaggaagctggggaacctggccgtggcagcagacgagaaatggagagcagtgtttgaagaatgctggcgccagctgggctgtgagagcccaggccaaggggaggtttggaaagcatgggataatattgctgtggccttgaccacgaaccgtcgccagcataaagacaggtgagcacacccctgtacagcacgtggcagcacagagacaggtgagcacacccctgtacagcacgtggcagcacagagacagacaggtgagcacacccctgtacagcacgtggcagcacagagacagacaggtgagcacacccctgtacagcacgtggcagcacagagacagacaggtgagcacacccttgcacagcacgtggcagagcacgtgatgtcagggacttgaaaccagacagtggtcaggtttgctatatgcagctgcagatgcagtatgattgctgtgtgatataatttgtaagtctgcgggcttggaagctgccagccagagtgattgttcgcggcttggactggttgtctcagaagaaccacctcattgaaaggaaaaaaatgtgtttgtatattttgaacctgaaactaagttgaatatgagtcacagctgaatcgtatgaggtgatctggggaaggggtgacatatagccatagattttgcctagagctgcagctctgccagttacaggagcaatgaggatggcaggagttcctaatgtgctcggcttggtggcctcttctgtccctccaggagtggattctgcaggccagccttgtccatcgtgcagcttcatcagtgagatgcaggggaggagtcagcactgcaggctgtctgcagaaccactgtcaggaaaggagcttgatggggaaatgagcgggagcttgggcagaggtgacagcgtgcacacctatagtgtaactacacaagccctattggccagacttaggaatggggtagtcagggaggcctcttcccaaaccttgaggagactcataagggggaaaatgtaagttttctttagagaaactgataatcttcctcctggaatgttgaaatttagtgtgtgttcatggatcactgtgccagctcttacccaggcatgcacatgtgctatctatccctctccccttttctctctccctcctactctcccccctccttggtttgcgtcagttgcatcatttttaatttagatattctcagattattcacttaggcatctagagactctctaggttacttatgaagaaactttactacattcaacagaatggatgcacagaatgtgttctgagagtgcaagcaagggctgtgcacaggtcatgggttccttacatcgaagagtggttttgatctttagtctgaatttggtctgagctacatttatttcctcaatattttgggcttttttttttttttggtaagatttatttttagttttgtgtctgtgtgtgtgtgtgtgtgtgtgtgtgtgtgtgtgtaagtgaatgcatgtgcctatggaggctagggactttggatgccctggagctagagttacaggcagttgttagcaacctgtatgggtgctgggaacctagcccagaaccttagcaagagtggtgcacactcttaacccctgagccatttctctagcccagtcaatcgtttgagtctttctaagtaaaaacaatgaaattgcttcactgccatggcactcatagttttattgctgaggttgcttgcttaaaggccaaaatactgttctggaaagatggcttaactcattgggaaatggatgttccagcatggacaagaggtggctaatgttggagttagctagcataaactttaacacaatgatggcagaagtgctctgatgagcagccaaagtcatccttgaaataggtgttaaattgaattaccaggtgggagagatggctcagtggttaagagcactgactgctcttcctaaggtcctgagtttaaatcccagcaaccacatggtggctcacaaccatccataatgagatcatatgtataagatcgccctcttctggtgtatctgaagacagctatagtatacttaaatataataataaataaatctttttttaaaaaaagattaccatcaaagaagcagaactaaccagtaccccccccagagttcctgtctctagctgcatatgtagcagaagatggcctagtcggccatcactgggaagagaggccccttggtcttgcaaactttatatgccccagtacaggggaacgccggggccaagaagtgggagtgagtgggttctataagaagaaccaaattcaagttttagattgccagagtacagtcccttaaagacttcagctgggcacagaagcagactgaggtgctaatggaggagacagtgaacttgggggtcagtcggaatggtctgaagaaacacagcaaaaactcaggtggggtgggaatgaatgcagagcctggagaactgatgggcttaaatgtctaaaatattctagaagaaaagaaccggagagatggctcagtggtaagaccactgcatgtacttccagaggattaaaaagcccaccagaattctagaacaggagaaataataatgataaggagtgggagtttttgagaccgtaatggttgagaaaggctcaaggtttggtaaaagataaacatctaagctcaggagctaagtgggttcagtgtctagaaaagtgtgcactacacgcagagccccccagtgagtgagtgtgtgcagcgtgtaagcaagagcctgcagcccagggagaaatggcccaacatttccaaagcactaaaagaaaattacaggtggacttcctgctcacctttctcctttagcttttatccttttctccatccaactgtcttcacctttcctagctttgctaagcattttaatggaatttccctgaaatagtcctaagtatgcttgcaggtaggtgtcagctctgtttctactgctaaaataccaagaagggtgcctagagagaggaccgaggtttacaacagcctcagagcctacacaagaggctgctctcgtagaggtcccaggtttaatttccagcacccacatggtggctcttacagtctatgactccactcctcagggatagggatcacttctggcatctgtggtcatgtgcacacatatggtgcatgcatacatatgtgtgtatagatatatacgtgtgtgtgtgtgtgtgtgtgtgtgtatacacacaaacatatgcatgcacacatattttttcaggcaaaacatttgaaaacaaaatatacctaaaaattttaaaccatgcagaagtgcttgctttgatctttgtgtatagctgctacatttgattttctagaaatccgtttttatgccacttttcatttgcatttgagtagcaggtcaggcatgtagagtacatcaggctgtgctaggtgaatgtaaactcttgtagcaggtcagccaataccattttgagtgacttgtgtaacttgaggtcagctgctgttgctgaacgtgttaggcctgggctaggtcagtgggtgctcacggtgagcaaggtgggtctgtgtcagaccctccccctccccctcagctgctgacggtttgacgtgtgctttctcacatgaaaagctggcctttctgcttcctcttcacagtccagaaatactaagccgctctcagactcagaccctggagagtttggagtacattccccagcacattggcgccttctctgtggagaaatatgatgacatcaagaagtatttaataaaggtaaacaagtcaaagtgacatcggctttgtgaatgaaacgatcagacagctgggtgtggtcatgtacacctgaagtttcagcacatggaagggtctaggccatctgctaaaaaatatgtagttaggctgagcaacttgaaaccgtgtcttatccctactcttccttccctccccccccccccagactctccaaaacaaacaaggtcatcattcaaaggttaacctaatattggttttactttctctgttttgtttgctaaatctttgatttttttttttttaaatgggtctcactgtgtatcccagattggccttgagctcagggcaatcctcctgcctgagcctcccaaatgcagagattataggttctagccactaagctctaatttattttcttcttattgatagataataattacattttataggaaacagtataatattctggtacatttatatattatatatcgatcaattcaggatacttaggtatccttgtgatgaaaacaaagtcctttcttctatctgttttgagctgtgcaatattgttagccataatcctcctctgtaaacaacaccattgctaactcttctgcagtagaaaacctgagccataaaaaaggacaaagtggaatttctgatgtagagtattgtactggctagttttgtgtcaacttgacacagctggagttatcacagagaaaggagcttcagttgaggaaatgcctccatgagatccaactgtcaggcattttctcaattagtgatcaagggggaaaggccccttgtgggtgggaccatctctgggctggtagtcttgggttctgtaagagagcaggctgagcaagccaggggaggcaagccagtaaagaacatccctccatggcctctgcatcagctcctgctccctgacatgtttgagttccagtcctgacttccttggtgatgaacagcagtatggaagtgtaagctgaataaaccctttcctccccaacttgcttcttggtcatgatgtttgtgcaggaatagaaaccctgactaagacaagtatcatcaccagaaagattttaacatttccaacctaacaaaagtcagcctggcacatttctgtaagttcagcccttgagaggctaagacaggaggatcaatcacaaatttgaggccaacctaagccacgtaccagaactctatttccaaaacaaacaacaatgaaagaaagaatagatgctggagagctggctcaacaggtgagagcagaggaccctgcaactgctggcaacggctgtcctgggcttctgaggcagctgcatgcaatcacactgataatttttaaaaaacctttaaaatatataaaaaggaaagcaaaaataaaacctgttgtaggatgtatatggaatgttgccttgaagaaaagcaagtcctgacgttgcttctgctgttgtacagtgagacctgtctcaaaacaacaagtatccccaacgctagcgccttacaccaggtagactaaagatgtggaagttaaggaatctgacttttcctgacactggggaaatggttttttagggactgctcttactgcctactgatcatgttccttgtttctggtctcaggcctgtgatactcctctgcacccactgggcaggcttgtggagaccctggttgcggtgtatagaatgacatatgtgggtgtaggggccaaccgccggttactgcaggaagctgtgaaggagattaaatcttatctcaagaggattttccagcttgtgaggtaagatcgttacactgaaagctgcagagtggtctgtggcatcttcaaccggagtctagatgttgcagccttgtgaggtacttgagtgtccccctctatcataggaagtactcatctaaaaaaagctttatgctacagatccataaagagactaaataatggaagtgcatttttaattgttcatgtgatatttactacctcatataactgaaggctaaaataaactctggttttctaagtctaatttggtgtaaaatatagtagtcatatttgtatttaacttggaggcttaatcatgcctctaaaacctaaccacagaatagagttggtggaagttcagtccctgaggatatgcccagtctggtcccttcccacgagcagcatgtgtactcatatactcagtaggagccagtgagcactccaggctcaaccagacaaagcactgacaacagaagagttgtcatcttcagcctgtgagctagagtaaggcagaacacagcacatgcagcgcagccgtgtggaggaggacactgaggcagaagccagaatgaagtgcttgctgcctgcttcaggtctggacgcccaactgaccagaaagtatcgagaggagacagggttaaaggagccaggaactgtcatagagaagacagatcctggcagcagcaagctggagttttaaaccaacaaatgagttccctactgagtcacttaggaatttgccccagaaatgttcttatattaccaaactcaaaatgctcagcacacttggagtgtgtcaggtttggaggagccgtgtgtctgtgaaaagcatccgtgcaatggagtgtctccattccagccttggctaggctgtgtgctataaagaactttctttactttgttttttagtattcccagctataaagagagcagaggtgggtggcaagctgtaactccacaaaaaatagacaatattataagctgcctttgaaaggtcaagagttaagtctctgaaataaaccagacagtaaacatatggtgggccccagcaacatcccagaagtcaaagataaacgcctagggcactggtttcaacttccgtgctgcaaccctttaatacagttccttcctcaggttgtggtggcctcctcccccgtaacattcctttgctgctacttcctaactgtcacttgctactgttaggagtgtagcataactatctgatgtgcaacccctgctccacaggttgacgaccacttctctagaactcacgtcaaggcatggagaaaagcaaacctagggagtagtcagaaatttagtccattatcatttgaagaactaactttcagcagcaagtctgcattttagagaagatttctgaaatttatatctctgtagttcagttggggttatattctggtttgagtttctgattagagttgatgcaagttgacttcgggtagagaattccttagtcagatgagcccctgcttgggggattttggaactgtcactcagtcactccgttcccattctgtaggaagcaccacacattnnnnnnnnnnnnnnnnnnnnccctggggtggtaaacagttgtttctaggaagacaaaaagaaagttttaagaaccgtcaattacaaaacgcattcagtccgttctgctttttatgtgctttcttttagtttggaaacattgtatgtcatcattttcatgtattctcttatttttttacttattttttaaatttacactctagattttattctccccccacccccggtccaccctccaactgttccacatctcatacctcctccccacccacttgtcttgactaggatgtcctcactgcccatccccccaccccaccagacctctaaaccccctggggcctccagtctcttgagggttaggtgcatcttctctgactaaacccagacccagcagtcctctgctgtatatgttttgggggcctcatatcagctggtgtgtgctgcctggttggtggtccagtgtttgagagatctcaggggtcctgatcctcctatagggttgcccttctcctcagcttcttccagcctttccctaattcaaccacaggggtcagcagcttctgcccataggtcgggtgctaatatttgcttctgactctttcaactgcctttgggtcttccagaggacctagaatcttatggcttgttttcgattttcacttaggttcttgtttcctgagcttcctgaggagggcagcacaattcctctttctgctcctctgcccactggaaggagatccttctgtactggaaaatcggattccagatccgagtcaccagaaccagggtgagttgagctgggtgaggtagtgaggatgtggtgtgaatgctgcacggactcccgaagaacctcaaagatggctgctttccccaggcccggtttcctcatgtcctcagtggctgtctagcttcctcgtggtactagctgctgtcagggagggagtagccacatgtggtcagtcaggaaggcagctgagcaaaggcaatttgtgccgagttaggtgaccctgcaagagcagcctcaagatggaatcaaagcgattctcagtttgctttctggtcatccaaaagaattggcagttggttcaagacagtcaactctacctgtatcaagcagcactcgtaaaaccatcctgtgaaccttgcagtccataaggaagcgccatctctgactagtgttcttgtgcctccttcccacttctgtttgtagttatgtagtaacaagttctggcttactgcttccggtgctgctgccacggctctacccacctctcttcatgctctatgccctggataatgaccgagaggaagacatttactgggaatgtgtgcttcgactaaacaagcagccagatattgctctcttgggcttccttggagtacagaagtaggtactgtggttgtgagcagaaccaaaagtttgaattgaaaattccttcagcactgccaagaatttattggcatctacttgtgtgtatgtgcgtgtggtttctcagcttgctcatctgccctgtcagcacagattaatgatcttcatttctgagagggtccaaaggtggttatgaagttcctttatatctgaacatgggtttttacataatcatataaaaactaaatggctcgtcttagctaataaagatgtgtaatttatactcccattccttagaaaaagttaattgctttaaatctttggtgttccttcccttttatccgtcccacgtcatttgcaattgaaagtgttagacttaaacattttcatattatctcaggcatgggttctccttccagggatggttatcatcctttctctagagtggtgatagagctgattccagtccacttaagagccatatattcacgctatcaaaaaagtgtatacatttttgttgggaagttattttttcaatggaataatttagtaataaaaatgtgataaatgtgtaaatgaaggacctactctggactgtagtgtgcagttattggatgtagattgaggttataggatgacaaaaccccctgggatatagtagctgctattgccaatataaaaaccacagctctcatcttcaagggaataagaaattgttcattctagagccattataagtgactatggatcaggaacacagatttaagttatcccaaattccgtgctctaacatggaagcagtttttatagttttacagaacaaagaaggtcatcaatcaaggaaagtttaaaatgcattgagtatgccagagagtcagatatggtgagacaggcaggcaaggtgtacggctattgtgtagctattttatagacccaagatgctatcttatgacattcttagctcttggattactggaaaagtgttctactaagttaatagcttctatgagatctttatttattatcatggggtgttttttcagattcagagccaggagtggctgtttcagaaggctaaagttagcccaagataaagtaattagcctttgaacctacaaattccagtctctcagagcactgagatcccagtcagttcattattctctgcagacacaggctctttccgggagttttcactcccagccagatatagtttcttctcaggagttttcacattattaagccatttccaggatgtttactaaattttaggaaaaaggtaaataaaaacatgaaacccagaaccaatttgtagaaaagttgttaaggggagcagggaagccaagataaccatcatctttataaagggtgtgtctgccatactgatgtcttagactaacaatttatgatttcattgtagaaaattctggccagccaccttgtcaatccttggagagagtaaaaaggtatagtggattttagttcctcatcaaacatgcttttctctgttctgaaggactccattttacatgagcagtgctcatgttaatgccagttatccccagcaggctgggtcctctgagatgttcatgttcttgttacagaagacgcctctcttctgacactcattctccttatgcaggtgttgtcaaccacaaaggatgcttgctttgcatctgcagtagaatgcctgcagcagatcaggtaatgcctcatgttgttgaacagtcagacaaatcaaagtagtggctcctgtcctgggagagtagaaagactacaatggtccccacccccttcctctccattttttttttcctcgatggtatcttgctattttattctccttcctactcctaaatgttgtcagtataaatggaaagatcagaaagtctctttgcaaacatctgggctcttttactctaatatgctcttgtgttttccaaggagtagacagcctgcctggagatttatctgtgtgctcctatcattagccaacttttcattcagaaacggaattccagtgggtcaaagaaaacattccgtgtgggtcctcccaccataatctcttttctgacttcttttcccaaacattgtaggattccaggccatccctccacattctggctgcctagtgtgtctaattgaggcatgtgacctggagggatttttttttttaaatgaataagagatggctttattaggaaaatcataggatatcttttacactttgttttcacaacagcacaacatttactccatcagacaagcttaaagtgatccagcagacctttgaagagatctcccagagtgtccttgcatcgctgcaggaggacttcctctggtccatggatgacttgttccccgtcttcttatacgtggtgctgcgggccaggtatccagtttttcctgacatcgttgggtttaccaagtctgcttgtcttgaattgatgctgctcctgtcagaatagaatgtcacttgggttaagctgttgtgtgtctgtgtcatcagttgattctaaaggagggccacttagagacagcatggacttcccgtccatctctttgtctgacacaggattcggaacttgggctctgaagttcacctcattgaggatctgatggacccctttctccagcatggggaacaaggcatcatgttcaccaccttgaaggtgagtgcctccctgaacagttctcagtaagtccgtccttctttccttccttccttccttccttccttccttccttccttccttccttccttccttcccacagtgtaaaccacgtggtaactgcttttctttctgtccgtgctgctttcgttctctttggtggagggatggtttatttccaagctggcctgcaattcttagtcaccttcctgccagtgcttcccaagggctgcagctgcaagtgtgagctgccatgtctcacctactttcttctttgaggaaaaattcagtgtagactttttttttcttttattaaaaagacctttcatacggtatattccgattatggtctcccctgccgnnnnnnnnnnnnnnnnnnnnaataaaccagacagtaaacatatggtgggccccagcaacatcccagaagtcaaagataaacgcctagggcactggtttcaacttccgtgctgcaaccctttaatacagttccttcctcaggttgtggtggcctcctcccccgtaacattcctttgctgctacttcctaactgtcacttgctactgttaggagtgtagcataactatctgatgtgcaacccctgctccacaggttgacgaccacttctctagaactcacgtcaaggcatggagaaaagcaaacctagggagtagtcagaaatttagtccattatcatttgaagaactaactttcagcagcaagtctgcattttagagaagatttctgaaatttatatctctgtagttcagttggggttatattctggtttgagtttctgattagagttgatgcaagttgacttcgggtagagaattccttagtcagatgagcccctgcttgggggattttggaactgtcactcagtcactccgttcccattctgtaggaagcaccacacattcagtccgttctgcttttcacatgctcacttttagtttgggaacattgtatgtcattacttttatgtattttcacagaacattttcacattatacagtacaatttgtcataactgaaagagaagttctttaagctggacagtggtgttgtacacctttaatcccagcactcaggaggcaggggcaggtgaatttctgagttcaaggccagcctggtctacaaagtgagttccaggacagccagggctacacagagaaaccctgtcttggggggggggggggagaaaagaaaagaaaagaactttaacgtagatgctactcagatcacagtgcagtgtgcatgaatgtgtttctctctgcggataaccagaaacgtattactttattactttactcttcccatacacattttgctttaaatccctggggtggtaaacagttgtttctaggaagacaaaaagaaagttttaagaaccgtcaattacaaaacgcattcagtccgttnnnnnnnnnnnnnnnnnnnncttccttccttcccttccttccttccttcccacagtgtaaaccacggtgggtaactgcttttctttctgtccgtgctgctttcgttctctttggtggagggatggtttatttccaagctggcctgcaattcttagtcaccttcctgccagtgcttcccaagggctgcagctgcaagtgtgagctgccatgtctcacctactttcttctttgaggaaaaattcagtgtagactttttttttcttttattaaaaagacctttcatacggtatattccgattatggtctcccctgccgccattctttccagtttccatccagatccacatgttttctgtctcttgctaaaaatcaagcaggcattgttgggttctgggtggaagccaagaaaactcactttggaagcttaaaaaagaaaggttcactttctgagcgagcgctcagggaggcggtcagttctggatctgaacctcgttcccgaagggagagtgtacaatgtttttaaaggatgggaacacaaagcaaaggggagctgcagggtcatccgattgtatttgggcagtatgggctaagcaagggagtacccattgaagatttggctgtatccagggtacctggcttcaaggttcctaattcattcttgtagactttaggtccagagctcacagtgataagggtacaaaggagtgggtcagctgtatgtagttacttagggcaaaacaggcaattggttatgtacttttataacttacacaccttgatttagataacagcaatttctgtattctgcactgggctttgttcccatctgctgcaggaggaagcttttctgatgatggctgagcaaggcacagatctatgaatatagcagcatgtcactgagagcattttattgctatgatccttcagccaaactgttgtattttgttttcctctaggtccttggcctgtctaggcgcagattctcagccacccaaacagcattgtatatggactccatttcatggagtggccttaattcagctcagatagtggctggtcactcccacaagccgtgtgccaccattgcaccagcatgtcttacagacagggtttgcagggttgctgtttgcctgtctcctttggtagtgtgcagagcaccttctagtacccagtcagtggggtgaaggctctaggcaggcacggctcaacctctccatgttcactgagttgtataggtgttgtcagcagtaggctcttaccatcaggttgtgaagagctctcaggagccttggcaataacctgaggtttgttttgttttgtttttgggggaggtgcttcccatggggcacctttggccaagagctcagttaaatgtaacccatttctgatattggaagcttcacttggtgacaagaaatgtccatttggggttctgtctcccctgttatttggagatttcatttaaattgccttcctgtatgtatgtatgtccatgggacaaatggcccttagttttagctgtccttcctgtacccctctttcagtcccttccacccctacctgtgtgatcctcccactccaacccccgctcccatctataaccatctgttctattctcccttccagggagatccatccctaccctcgtccctctgtgcttatctgtggataagtatcttgcttatcaatgacttaatagctaacatctacatagaagcaaatacatatcatattttttgggggggtctgagttgtctttcagtatagactgaatacctttagaatatatgttgttggttctaaaagcacgataatgtattaaattagaataaatcagacctatactgccaggcaataaaatcttataaaaacacaggttttaatatgaagtcgtgtgttatagtcacatgagtaggcagtccctaatggtaaggataatgctcatattagcaatacagtactgtaatttccatatcataaaaggaaactaaaattgggaatacaaattatttaataaatgtttaagaaaaggtactgtggttttagcagtttgggaggtaggctgaggtagagaagtgtaggtgctttggggtttgtagagcaaaggaagacgggtctgtgaaacccttaggactgaacatcaggttcctggcccaagttaactttttaacattaatgtttctgtgtataaactgagaaagagaaataaagagcaagctgtagtgacatgtctacagattcttcatagtcctgctgggaagccttcgttcccagggaacattagtgaatgtccataaggacatgctcaggctcacttaaagccatagaaggccagactgaagcgtgtgcctaaaacaccagcagaagtgttccggttctacccagtgctggtgggtttatagtgaggcccctttcccacattgctggtaacagggcagcgagcagttaggctgctctctaagaacagttactagagactgtcatggccaagcgctggtgtgtttgactcaggatcccactccctgggatttctcctaagaagtcaagagtggaaattgtgcaccactctggtgtgtgagtcctaagcacacaagcactttgggatcactgcttctcagaaattcagtcttggaaactctgacttgctgtgtggtgtgtggggctgctcagccttcgagtagtaaatgtggacgagctctgctcacattgtcccgtgtaccctcacacttcccagtcaccagtgaatagtctcatgttaatcagtaaagaccggtacacagaggaaatagagggcaagtgtttgttgttgttaattccgattaggctacagtagccattggctggagagagcttggtgaggtagacaatgtgccttcagtaagggattgttttttcccaagtcttaaagaaactgaatctgaatttgtttggattttcaggcctgttacttccagattcagcgggagaagcttaactagggcgcctgacagcttgaggaccggattatctgctgcggaggctacagctatggcacaggcaccgactggaggctgatggggcaaagaacagtgttgaatacagaatggacttttgtgctgttttggttgtaatttctgagccttactaataattagagcccagcatggaaaacatactgtatcattcaaatggagactggaaaaggagatagggatagagtagagtctttggcctgtgctgagatccacacacctacttagaaaaggaaactggttaccctttcctgtagtgaaagctctcagctccatgcagttccaggaaacctttccaggaaagctgcttagatgaaaagaagttgatgactgtgtttaagctcctggtttgtctaattccatttgcagttacccaataccctttggcaaggagcaggttttacttgaactgaagcagccatcccttgccttcctagacctctcccaggcacaagtgcagcatgctactttgctaggggtgggggtgggggagaagaagttttaaactgtagttttaaccttttgtaagcccctttaccaaggcatttgtggtcagagagctcccacggggtgactatgacatcctggtcccctcgtggaatgcatccacataggatcttctgcctgctgactgaaaagaacataggaatacactggagtgcaaacactgccgtgccaagctgctccaaacctcactgatccgaggcccactgcctacccaggaggcccgtaagcttcttagcacaagctttgtgtggagactgaagatctgcacatgtgaggaagcagggagctacagtggccctcagcccagtctgcgggtcttccctctacctcacactgaactcagaagggaaggaaggagagacgcacatgggattctcccacctcagaagtattgtgacagcaccgcataaccacggtttgctcttttacaagcagcctcacaagtgtgggttgtgggtgtgcgctggagcagtgccactcgtagctgtttggataccacaggtgctcttctgtctcatctgctgtactcggaggcgagcgcagtggcctgactcatgggaaatgactcagcaggcggcaactacttttgaaaaggatcatgatttccgagctactttataatcaagacaagcatttgttaacatactgttttggaatgttggctgtaatgtaacagcagttttcataataaatgacattcatctctacgaagctgttctatgactgtggaagaaatgacatggggcagactgtactttaaagagtgctcagtttacagtattctttctccacattgtaatccatgcctcagacctcaggaacccctggggtttttaattcacttaactactagccaatttctggcaaagagcaagttaattctgatcccgataacccagagacaaaggtctccaaggaaaactgctgctgtgagtaagacagttgtgggctttgtttttgtttagggaagggctagaggaacaggtttaggaggatagcactgtccgcatctctccgcctaccgtcttctgccaggccgagctgctccctgtggagagggaccaactctttctcatttcgcatatttttagtttgtgagccaagacacaaatgccagatttggctagtaaagccaaagtaattgaacacctacctccttcagagaaagatcaggaggggctaatagtgggaatggatggaaacttggacaataggaccagagaaattctcaaatggcagcatgccatctcacatctctgagaacccgttgcaattcaatcttctaatttcagttttaagagaagctgcctaaccactgtattttcctcattctacacagttcttgagttgcagcttaaaacaataaattttcatgtgtgtgtggaaaaccctaaatctccaggcactgtctgtgactagaaataccagcacctatgtaactcacagcagccctcagcagtgccagtctgggggctccctttccctatcggtgaatagctatagtttgctgtgtctgcgctgggactccaacccagagcttcccgactttcctctactctttcccactgcctatgccccgcagatgtgttctgcattaggccttgaaaagctgaagttaagaaaagtaaaagcctctggtgggtgtagtggcacacctttgtagtctgagcccttgagggtggaggaagttcagttatccttggttatacacacagtttgaggctaccggggctacataagactctgtctcaaaaaaaaaaaacaaactaaaagtaggaaagatttgaaggggggcgattggtgtttgttatctggaaacagtcaacagaaatattaagggcttgtatgggagtgtagtactcatgtgagagaaagctcactgtggtggaggataatgtaaatgagatgttcccttgcagggacagctagggctgctgcggaggcttagaagaggtccagggttagcctgcaagggcaggattatgccaaagaggatgcacagagcttttctctagagcatcaggtgactggcagctagcagcctcctggtgcttcctgcttgcttctctcttgccaggagcaacactgtgttttcatccttgcaggtaagagtctgctcgcaatgccgcatttccagaaggcaccagcagcagctacagataatcgtgggtagtctgtgttaaagtggttgactgtcctacagtaccatctcttaagcgtggcacagtgcgttgtcaaagagttcaagtgaaactgtcccatcttctgtgagggccttggatgcagaggaagccagcaggccatttctcagggagggttgcatatgggctttttcaagatttccatattgaaaaatactttagaaaacaagcctagtgggtaagaggtcaggactttgaatagcaattgttttaaagcagaaggaaatgctttaaatgttttaattataatgtttaattacaatttaattgtgtgtgtgtgtacgcttgtgtgcaagtgtgcgcgcatgcgtttgtggaagccctggtgcttgtggaggtcagagaacaactgaaaacagctccctcctaccatgtgggttcaaagtcatcagacttggcagcgaatgcatttcctgctgagctaccccagagacccaaagctgaattttaaggtaatgctgcgtacattccaggtattcatggtgaccacttgctttataacacagtttttaattgccttttcttattccctacctctttaccctataaatcacctgtctagaatccttcattctggcgcaattcaaaccaaggcacttaaacacataaggttattatttaaatccacatagtgccccaccagtaataaaaaggataaggtaaagaaagatatagcttagctggtagaatgcttgtgtggcatatgtgaagtccacggttcagttcccagcaccacataaaccatttgtggtcacacatgcctgtcacacaaccccagcccttgggaggtggagaccggaggatgagagcatctggtgatccttgactagagagaaagtctgaggccagcatggactacatgggactctgtcaccaaacaaacaggaaaccaaccaaaagcaagatagctgaaaacagctccctcctaccatgtggatactgtgtatttaagcgtgtgagtgtggatagatagcacagaagcacacatgtgagcctacacaaaaccctgaaaggatgtagcaactttgaatgcaggagtaaatagactccaggagtgctgtgctgtagtggtttcctgagtcacaagcaggattagcgctgatagaatgattttctgatttggtagactacttggtaaggtttaatgtgcaatgtgttaattcttcaattatgatggtagcgtttcttcaaatttattggtttcttgcaaactattttgtgtttgtaagaagaaactttgtttgtttgtttgtttttgtgttttttaagacagggtttctctgtgtagccccagctgtcctgtaactcgctctgtagactagtctggtcttaaactcacagaatcacctgcctctgcttcctgagtgctggaattaaaggcgtgcgccaccactgcttgaaaagttgagttatacattcaggtcattctggggttgatttatgtttgtttcttcagtgacatgaagttagacacttgcacattctgcagggacagtgattatctatcacatagaacaagttctaagcctttccctgagacccctaccttccctttgcccttgcctccttcgccctgtcctcatcctgccggctgaggtataaacatgacagctggaaatgcaccatcttggagcagatagatgagtgctatgtgcaccccagggctgggccagggtgctggtgagcctttcacatgaggctgacccaagtctggatggtctctgcctcaacactgtcaaacaggcaatgcagaaacttctattccaccaggccactcattttggatttcattttgtgagagtaaataaatctagagcagtgtttttatttttatttttttaattaagtagtttaaattgtttgctatagatgagtattgaaattgatagggtaagatacaatgagctacctaccatgtgtttcaatctatgcaaaatgtccgagagactgtcatctaggatttagacaggttgtaaggtggagcagaaaggctgtgtggggaaaaatagccagatcactgttacattgtctccaggttagaagactatgccaggacagtaaactgtcacagagttcatccaggacagtatactacctgtgtcacagagttccatacagtcgcctaacaggaattgtgcaactgatcagcaagctccatgaagaaccacaaagtgccatatgcagaatggagcatcagggtgtgttcaggccagggaggccctctgagccctcaccagtgtgtaattcacccaggcaaacagatggaaagcaggtagataaaacaggacatgtccgttattgtaagagatggatggcctgctgagatggctctgtgtaaaggcacttgcccgcaaggctgacaacctgagactggtccctctgacccacatggtggaggaggagaactgattcctgcaacctatcctctgacctctaagctaaaatgaattatacacatgtgagtgtatgactgtgtatgtaaacaatttaaaacaatgtattatagacgaaaggtggggtagggggatgtttgtgggagaatagttttctctttcacacagctaggaacagctgatttggagaggaatatcataggacaaggctgttgtacctgatgcacatcctagtgtgtgtgccctagtgctaggcttgcagaatattgttgaaaatatgctccagggtgctgagcaccggctgcggtggctgagtgacaatacgccgtctgtcgatcttcgtcttattcctgacttcctttccaagctccagcagggaggatgagacagtctgacagaggagcagagctgaccaatgaggacagagctcttcccacgccacctgatcctgagaatggtatgtgtctccagagttccttcctaggccagaagagatggttggtaatatctgagtatgtgatcaagcacacagggtggcttgccttcatcctcacagggagcttctgcacctttgtccactagagccagtgttgatagttctgcaagccactgtcagtgcaaggaagacattgccaccaaagggtcagagccccaccaggccacactggtttatagaaaactcagaactgcacaacttgttcgcatccaaagtaacagttaaaagagatttttttttttaataatgaaaaaggcaatgatttactctacatgatgttcctttacttggtaaacgattgatagttatatcaggaaatttaatgaaggaatgaatggcagaaggttcattgagtgaggatgctagtgacctgagtcagaaggcgagaatcaactccctcaaactgtcctctgacctccacatgctagctaagtaagtaaaagtaagtaaaatctaatgggagggccggccagatggctcactgggcaaagactcttgctgccaagacttacaacatgagctctctctccctgggatccacagggccaaaggtgagatctaactcctacaagttgtcctctgaccttcacccaattgctgtggcatgcgtgcccccgtcccacacaaataatgcaatgtaactttaaatttttaaagtctaatgggggaggtttgcagtaacactttcaataaatgattttagaaagaatgaacaaaaccaactgtgtttgacttggagaaggaaggtcctggaaacacctgcatggtttagagacaagttcccgcctggtaaggaggaaatggagaaccattgtgttattctcagtgtctcatgttaggcacagttccaagagggtgttagcttatgtgcagtttacaaaagaaaaattttcacagtttgttacataaatgataggacagggcatggagccttaagccctgtgttgtccccttgtacagagtacctggcaaactcagcagtcacagaagccccggtcacaacatcttccttgctgcccttacccgccagctgccctctgaccttttctaggtctctctgggatcctgaggctcctactgcaggaactgagccttttctacagccgagatgtgaatggtctgtgtctcttatatgacctcctccattcaccatggctgcaggctctgctcaaggtgagtgcttaaagcctttctttgctctggctagcaaaagcccgtgtattagaccatccaggttgctgtaaagctatgctaaaaaagtgttggtttatttatttgctttttaaaataaaactgcttctttatttttgcatacttttaatttgagaaaaaaacctcgataaaaccccaattcaacacatctaaccttactgtcaggtagaggaggatttcctgtcttactataaaagaacagggaagaagaaaacagaagcagagagccaggtggatcaaggcaagtcatggctgcttgaggagccataggaaaaactgcataggtcacagggtttccaggggcaactctaaactgcttgcacgtgagatgcgttctcagcatcatcaggaacaggaatggctggactcctccactatcacccatcatcatcagtgcccaggcccactgtgatcatgggtggggtggatctcaggttcctcaggagagaagccaggaaagaagagtgcagctttaacagcattgcctccacatccttgacaaccttgcttctgccagtcccagccatttgctgcagggtccccataactgggtggtcagggttgatttccaagtgctgtttgaccatgacatagcccccgatagagttgtctcatagtgcctgggcctctgtgaactgctctgtgtttgctgtctagctactgtgctcatcacagggtagcaaggtgaggatacatgcctattggagattgtcatcttctccatcttctccttcatgatctttcagagattctcaaaacttgagtcactgccctccatttttcttactggtggcaccagaacgcctttggatgtttaagagtccaggctcttcccatcaacaacttgagctgccaaacttgtcaagaggctcaaagacctcttccccacatcctcaactcaacctgaaggtggagttggcctctcattctttgctctcaccagtgatgcagtaggcaaactgctgtgtttcctcatagcatacatacactctgtctcttctccaggctgagagggtatggcagcacagtagctcagagaagcatcgctggtgggtggaactttcatggactccaagctttagattcttagagaatacccataaaacttcttgtagttttcttccagcttcaagacctggatgactttgaagagtttgctctgctggagcagtttttggagatgttaaagggtggggcttcagaatcaaccatgccacagatgaagctgagatactttggtatcacctcatcacggctgtcgcacatgaacacacaagggcataggttgatgtcattccttttgttctcaaagaggtcaaagggagctagccaatggataaataacaatgccctggattccaactagccttctacacaaaagcgcttggctgctaagtgtcttctcagtcattgttgaggctcttaaagaatcttcatattcctcctgagtgacatcatcactgtttctggtctaagcagacttggctttgttcagttcttctgatcaatgtatttgtcctcagtcttctttttatctttgccagtgacacactcgtcacctgatccggaatcttcaagcttaggtcttttctcatcgtccttacctttctctcctttctctttctcagcctcatcatcactgatccccttctccagagagtaatggggtggcccaacactgcacgtgctccttcaccagcacttgactcttctctgttctgtctgggatcacttttggtggtacagcgagctctgtaaagtgcctgcctgacatgcacagagccctgggatagaccccatcactgtaaaacaggggtgctagttattgttctattgctgtgaagagacaccatgataaaggcaactcttacaaagcagcaaacgggccgcttgcttatggttttagagggtgagtccgggattttcatgatgggacacaataactatgccactgaggcaggagctgagagttttatatcctgatcttaaggcagatggcagagagggagacactgggcataccatgggattttgaaacctcaaagcccacccctgtaacacatctcctccaacaaggtcacacccactccaacaaagttacattttctaacccttcccaaacaataccactccctagtgactaaattttaaacatgaacctataaaattcattctcattcaaaacacttactggtaagatggtgcagacctttaatcccagcaattaggagatagaggcaagataatcagaagttcaaagtcatttatgactacaaggtcaatttgaagacatcctggatgtcttcaatgagaccctgtctccaaaaagtgaggagaaaagatacacaaacatacacacacaagaggggggagacagacacacatacacaaagagacagacaggcacacatacatccagagagacagacatagacatgcccctgtttgctttggaagcatttaggaatgaaaaactatgtctgctcttttctttactgtctccaacttcttttggaaattcctgtgatcacaaatcagttatcacaatggccacattatactctcattataaatgatcaacaggttcttttgcttagtgttccctatagctgtcaatcagcatagatcacttctacatacctgagtaccggccctacagaagagcagaaagctcactcatcacagatatggataggaaagggtaaactgcctcttggacctcctttctccacctgtaagagaaatctgattccccaaataagatgacggacagcactgtgaagcccagcaagcattgcttacttagcctgacctcatcctgtacagaaatgccacggaccgccccagtcgggtatgggggtccctgggatgaggttcctcgaaagttaggttggtaaaaatttggcagtgacaaacagaaacaaacacagaggcagtttgaatctgagtgtattttgcaactctcaagcatgggtttttatgcattaaaaaaacccaaatatttctggagtccaccttcttgagttctttatatatattggatattagtcccctatctgatttaggatagataaagatcctttcccaatctgttggtggtctttttgtcttgttgacggtgtcttttgccttacagaagctttgcaactttatgaggtcccatttatcgattctcgatcttacagcacaagccattgctgttctattcagaaacttttcccctgtacccatatcttcgaggcttttccctactttctcctctataagtttcagtgtctctggttttatgtggagttccttaatccacttagatttgaccttagtacaaggagataggaatggatcaattcgcattcttctacatgataaccgccagttgtgccagcaccatttgttgaaaatgctgtcttttttccactggatggttttagctcccatgtcaaagatcaaatgaccataggtgtgtgggttcatctctgggtcttcaattctgttccattggtctacttgtctgtcactataccagtaccatgcagtttttatcacaattgctctgtagtacagctttaggtcaggcatggtgattccaccagaggttcttttatccttgagaagagtttttgctatcctaggtttttttgttattccagatgaatctgccgattgccctttctaattcgttgaagaattgagttggaattttgatggggattgcattgaatctgtagattgcttttggcaagatagccatttttactatattgatcctgccaatccatgagcatgggagatcatttggtgaaaggacccagatattgtgagactatgctggggcctagcaaacacagaagtggatgctcacagtcggctattggatggatcacagggcccccaatggaggagctagagaaagtacccaacgagctaaagggatctgcaaccctataggtggaacaacattatgaactaaccagtaccccagagctcttgactagctgcataagtatcaaaagatggcctagttggccatcactggaaagagaggcccattggacttacaaactttatatgccccagtacaggggaacgccagggccaaaaagtgggagtgggtgggtaggggagtgggggggagggtatgggggacttttggaatagcattggaaatgtaaatgaggaaaatacctaataaaaatttttaaaaaaaccaaatattacaactcttagaagatgtgttcagtgaagcaattacaactaccatcattatcatttggcacagtaaagcacaaaaatcaagcaaacattataactttgaaaagatatattcagtgaatcacaaatagaacagatactatcatgatagaaatagaaatagaaatagaaatagaaatagaaatagaaataga

SEQ ID NO: 1070 - DNA, 5814 bp, Mus musculus
atgaatcagctgatctcgcgtacccgcggtgcagtcgggctcgcgccgggagaagagcgcggagctgcgggagcgtcagatggtgaggtctacagctttgggactcttccctggaaaagtgaatcagcagaaatttgtccaagcagcccccttctagaaagtgccctggttgggcatcatgttattactgtggcaacagggagcttccacagtggagcagtgacagagagcggggtggtgtacatgtggggagagaatgctgccgggcagtgtgcggtagctaaccagcagtatgtgccggagccgagtcctgtcagcatttctgactcggagaccagcccgtcattagcagttaggattctgcaattggcatgtggcgaggaacacacactggcattgtcactcagcagagagatctgggcatggggcaccggctgtcagctgggcctcatcaccaccactttcccagtgacaaagccacagaaggtggaacaccttgctggacgcgtggtgctccaggtggcctgcggtgcattccacagccttgcacttgtgcagtgcctccctcctcaggatctgaagccagtcccagagagatgcaatcagtgcagccagctgctcatcaccatgacagacaaagaggaccatgtgataatatcggacagccattgctgccctttaggtgtgacattgtccgagtctcaagcagaaaagcatgccagccctgctcccagccctcacccagaggcactggatgagcagggagaggtgtttgagaacacggtggtagaagctgaactgaacatgggaagcagtcagaccacaagtggcagtgccatttccacccagcagaacgtcgtgggaacagctgaagtgtcttctgccagaacagctccgtcatacccagacacccatgcggtaactgcatacctgcagaagctgtcagagcattcgatgagggagaaccatgagcctggagaaaagccaccccaggtccagcctcttgtagaagaagcagttcctgatcttcacagtccaccaaccacaagcacctcagccctcaacagcttggtggtctcctgtgcatctgctgttggtgtcagagtggctgccacctatgaagctggggccttgtctctcaagaaagttatgaacttttacagcactgccccctgcgagacggcagctcagtcgggcagtgcctccacaggcccagaaagtctgaaagatctccgagaagagcaggtgaaacaggagtcactgcaagggaagaaaagctcaagtctcatggacatcagagaggaggagttggagggagggagtcgaagactctccctcccagggttgttgtcgcaagtttcccccaggctcttaaggaaggctgcgagggtgaaaactcggacagtggttctgactcccacatacagtggagaagcagatgcccttctgccttccctgaggacagaggtgtggacctgggggaaaggcaaggaagggcagctagggcacggcgacgtcctgcccaggcttcagccgttgtgtgtcaagtgtctggatggtaaagaggtaatccacctggaggcgggcggctcccactccctcgcactcactgcgaaatctcaggttagcagtgaaaatggagtctggagtgtagctgcaggccaagattattccttgtttttagtggacacggaagacttccagcctgggttgtattacagtggccgacaggaccgtgcagaaggtgataccctgccagagaatcccagtggtacaaagactccagtacttctctcctgtagtaagcttggatacataagcagagtaacagcaggaaaagatagctatctagccttggtggataagaacatcatgggatacatcgccagtctccatgagttggcttctacagaaagacggttttactcaaaactgagcgaaatcaaatcacagatacttaggcctcttctcagtttagaaaatttgggcacagtgaccactgtccagctgttgcaggaagttgccagccggttcagcaagttgtgttacctcattgggcagcatggagcctcactaagcagctacctacagggcatgaaggaagccagcagcctggtcatcatgaagcactcaagtcttttcctggacagctacacagagcaaaaggaccacgccaggccagatagttccacgtactgcacatcagtttcaaatttcctggttatgggaggattccagcttcttgctaagcctgccattgatttcctaaataaaaaccaagaactcttgcaagatttgtcagaagtgaatgatgagaacactcagttgatggaaatcctgaacatgctgtttttcttgccaatcagacgacttcataattatgcaaaagttttgctaaagcttgccacttgctttgaagtgacatctccagagtatcaaaagctgcaggattccagttcttgctatgagtctcttgctctccatcttggcaagaagaggaaggaagcagagtacacactgagcttctggaagacctttcctgggaaaatgacggattccttgaggaagccagagcgccggctgctgtgtgagagcagtaaccgagccctctccctgcagcatgccggcaggttttctgtgaattggttcattctcttcaatgatgccctggtccatgctcagaccaagtggcttcgggctatcagccaagctgtggatcaggctttgagggggacgtccgatttcccactttacggaggcggcagcagtgttcagagacaggaaccacccatctcaagaagtgccaaatacactttctacaaggatactcgcctaaaggatgccacttacgatgggcgctggctttcagggaagcctcatggcaggggtgttctgaagtggcctgatggaaagatgtactctggcatgttcaggaatggcttggaagatggatatggtgaatacagaatccctaacaaggccctgaacaaagaagaccattatgtaggccattggaaagaggggaaaatgtgtgggcaaggagtctacagctatgcctctggtgaagtgtttgaaggctgctttcaagataacatgcgccatgggcatggtctgctccggagtggaaaactgacttcttcttctcctagcatgttcattggccagtgggtaatggataagaaagcaggatatggcgtctttgatgatatcaccaggggagaaaagtacatgggaatgtggcaggatgatgtgtgccaagggaatggggtagtagtcacccagtttgggttatactacgaaggcaacttccacctgaataagatgatgggaaatggggttttgctttctgaagatgataccatctatgaaggagaattttccgatgactggacacttagtggaaagggaacgctgactatgccacatggagattatattgaaggttattttagtggagaatggggatctgggataaaaatcactgggacctacttcaaacctagcctgtatgagagcgataaggacaagcccaaagccttgaagctggggaacctggccgtggcagcagacgagaaatggagagcagtgtttgaagaatgctggcgccagctgggctgtgagagcccaggccaaggggaggtttggaaagcatgggataatattgctgtggccttgaccacgaaccgtcgccagcataaagacagtccagaaatactaagccgctctcagactcagaccctggagagtttggagtacattccccagcacattggcgccttctctgtggagaaatatgatgacatcaagaagtatttaataaaggcctgtgatactcctctgcacccactgggcaggcttgtggagaccctggttgcggtgtatagaatgacatatgtgggtgtaggggccaaccgccggttactgcaggaagctgtgaaggagattaaatcttatctcaagaggattttccagcttgtgaggttcttgtttcctgagcttcctgaggagggcagcacaattcctctttctgctcctctgcccactggaaggagatccttctgtactggaaaatcggattccagatccgagtcaccagaaccaggttatgtagtaacaagttctggcttactgcttccggtgctgctgccacggctctacccacctctcttcatgctctatgccctggataatgaccgagaggaagacatttactgggaatgtgtgcttcgactaaacaagcagccagatattgctctcttgggcttccttggagtacagaacacaacatttactccatcagacaagcttaaagtgatccagcagacctttgaagagatctcccagagtgtccttgcatcgctgcaggaggacttcctctggtccatggatgacttgttccccgtcttcttatacgtggtgctgcgggccaggattcggaacttgggctctgaagttcacctcattgaggatctgatggacccctttctccagcatggggaacaaggcatcatgttcaccaccttgaaggcctgttacttccagattcagcgggagaagcttaactagggcgcctgacagcttgaggaccggattatctgctgcggaggctacagctatggcacaggcaccgactggaggctgatggggcaaagaacagtgttgaatacagaatggacttttgtgctgttttggttgtaatttctgagccttactaataattagagcccagcatggaaaacatactgtatcattcaaatggagactggaaaaggagatagggatagagtagagtctttggcctgtgctgagatccacacacctacttagaaaaggaaactggttaccctttcctgtagtgaaagctctcagctccatgcagttccaggaaacctttccaggaaagctgcttagatgaaaagaagttgatgactgtgtttaagctcctggtttgtctaattccatttgcagttacccaataccctttggcaaggagcaggttttacttgaactgaagcagccatcccttgccttcctagacctctcccaggcacaagtgcagcatgctactttgctaggggtgggggtgggggagaagaagttttaaactgtagttttaaccttttgtaagcccctttaccaaggcatttgtggtcagagagctcccacggggtgactatgacatcctggtcccctcgtggaatgcatccacataggatcttctgcctgctgactgaaaagaacataggaatacactggagtgcaaacactgccgtgccaagctgctccaaacctcactgatccgaggcccactgcctacccaggaggcccgtaagcttcttagcacaagctttgtgtggagactgaagatctgcacatgtgaggaagcagggagctacagtggccctcagcccagtctgcgggtcttccctctacctcacactgaactcagaagggaaggaaggagagacgcacatgggattctcccacctcagaagtattgtgacagcaccgcataaccacggtttgctcttttacaagcagcctcacaagtgtgggttgtgggtgtgcgctggagcagtgccactcgtagctgtttggataccacaggtgctcttctgtctcatctgctgtactcggaggcgagcgcagtggcctgactcatgggaaatgactcagcaggcggcaactacttttgaaaaggatcatgatttccgagctactttataatcaagacaagcatttgttaacatactgttttggaatgttggctgtaatgtaacagcagttttcataataaatgacattcatctctac

SEQ ID NO: 1071 - protein, 1521 aa, Mus musculus
MNQLISRTRGAVGLAPGEERGAAGASDGEVYSFGTLPWKSESAEICPSSPLLESALVGHHVITVATGSFHSGAVTESGVVYMWGENAAGQCAVANQQYVPEPSPVSISDSETSPSLAVRILQLACGEEHTLALSLSREIWAWGTGCQLGLITTTFPVTKPQKVEHLAGRVVLQVACGAFHSLALVQCLPPQDLKPVPERCNQCSQLLITMTDKEDHVIISDSHCCPLGVTLSESQAEKHASPAPSPHPEALDEQGEVFENTVVEAELNMGSSQTTSGSAISTQQNVVGTAEVSSARTAPSYPDTHAVTAYLQKLSEHSMRENHEPGEKPPQVQPLVEEAVPDLHSPPTTSTSALNSLVVSCASAVGVRVAATYEAGALSLKKVMNFYSTAPCETAAQSGSASTGPESLKDLREEQVKQESLQGKKSSSLMDIREEELEGGSRRLSLPGLLSQVSPRLLRKAARVKTRTVVLTPTYSGEADALLPSLRTEVWTWGKGKEGQLGHGDVLPRLQPLCVKCLDGKEVIHLEAGGSHSLALTAKSQVSSENGVWSVAAGQDYSLFLVDTEDFQPGLYYSGRQDRAEGDTLPENPSGTKTPVLLSCSKLGYISRVTAGKDSYLALVDKNIMGYIASLHELASTERRFYSKLSEIKSQILRPLLSLENLGTVTTVQLLQEVASRFSKLCYLIGQHGASLSSYLQGMKEASSLVIMKHSSLFLDSYTEQKDHARPDSSTYCTSVSNFLVMGGFQLLAKPAIDFLNKNQELLQDLSEVNDENTQLMEILNMLFFLPIRRLHNYAKVLLKLATCFEVTSPEYQKLQDSSSCYESLALHLGKKRKEAEYTLSFWKTFPGKMTDSLRKPERRLLCESSNRALSLQHAGRFSVNWFILFNDALVHAQTKWLRAISQAVDQALRGTSDFPLYGGGSSVQRQEPPISRSAKYTFYKDTRLKDATYDGRWLSGKPHGRGVLKWPDGKMYSGMFRNGLEDGYGEYRIPNKALNKEDHYVGHWKEGKMCGQGVYSYASGEVFEGCFQDNMRHGHGLLRSGKLTSSSPSMFIGQWVMDKKAGYGVFDDITRGEKYMGMWQDDVCQGNGVVVTQFGLYYEGNFHLNKMMGNGVLLSEDDTIYEGEFSDDWTLSGKGTLTMPHGDYIEGYFSGEWGSGIKITGTYFKPSLYESDKDKPKALKLGNLAVAADEKWRAVFEECWRQLGCESPGQGEVWKAWDNIAVALTTNRRQHKDSPEILSRSQTQTLESLEYIPQHIGAFSVEKYDDIKKYLIKACDTPLHPLGRLVETLVAVYRMTYVGVGANRRLLQEAVKEIKSYLKRIFQLVRFLFPELPEEGSTIPLSAPLPTGRRSFCTGKSDSRSESPEPGYVVTSSGLLLPVLLPRLYPPLFMLYALDNDREEDIYWECVLRLNKQPDIALLGFLGVQNTTFTPSDKLKVIQQTFEEISQSVLASLQEDFLWSMDDLFPVFLYVVLRARIRNLGSEVHLIEDLMDPFLQHGEQGIMFTTLKACYFQIQREKLN

SEQ ID NO: 1072 - DNA, 28544 bp, Homo sapiens
  misc_feature (1)...(28544): n = A,T,C or G
aataacctcagaagtataaagctacaaatgtatgagaaacaccatttagccaggcatggtggctcacacctgtaatcccagcaccttgggaggccgaggtgggcagatcacccgaggtcaggagtcgagaccagcctgaccaacatggagaaaccccatctctactaaaaatacaaaattagctgggtgaggtggcacatgcctgtaaccccagctactcgtgaggctgaggcaggagaatcgcttgaactcgggaggcggaggttgcggtaagccgagatcgtgccattgcactccagcctgggcagcaacaagagcgaaactctgtctcaaaaaaaaaaaaaaaaaaaaaaaaaaaataagaaacaccatttgaaagtttaagtttccttttgtgccctctgaagatggtaaaagttgactgaaagaaatttaagtcggctgagtgtggtggctcatgcctgtaatcctaacactgggaagttgaggtgggaggaatgcttgagaccaggagtttgagaccagcctaagcaatatagtgagacccctgtctctctaaaaaataaaaaataaaaaataaaaaaagaaaagaaaagaaaaagaaacttaggtcattcaaaattcacaaaactaaagtagcataagagaatttaaacaaactttccaaaaaattttttggtaaattcatagctttatatgtcctaacttctgaagttgttaaagcttaaaactgcactaaggtttctgggacatgagcatactgccggctgtgaaccctcaggtgggctacttaacccctctgagcttcagtccctcatctgtaaaacagatataattcaggatcatgggccaggtgcagtggctcacacctttgggagaccaaggcaggaggatcatttgagcccaggagttcaagactagcctgggcaacatagcaagacgccatctctatttttttttttaattcagtatcatgcaccagcatatcacaagccttcattaaacgctagtcattataattattatcattcttgttaaaggctgtgtgatactacactgtataaaaactcagcaagggccaggtgcggtggctcacacctgtaatcccagcactttgggaggctcaggtgggcggatcatgaggtcaggagatcgagaccatcctggctaacacagtgaaaccccatctctactaaaaatacaaaacattagccggtagcacgtgcctgtagtcccaactagtcgggaggctgaggcaggagaattgcttgaacccaggaggtggttgcagtgagctgagatggcgccactgcactccagcctgggcgaaagcaagactccatctcaaaaaaaagaaacaaaacaaaacaaaacaaaagaaacaaaaaaccttgttggatctctgtcctattgttggacatttccattgcttccaattctccagtattaaacaccacgttaaggcgaacatcctgaaagttaaagtagttttgaaaactctctcaaactatatcttttcctctgctcgtacaccaacacaacaacaatcatccacacagaagtcttctgtgatcaaatgtgtgggttttttccctaaatgccaagcagcagacaccaactgagtgccttccaattcgattctgacatgatctacccggagatagtgtcagatcccacagattgaggcctcagttcccaagactgcccacccagccccaagacaccagttgccagtctggcctctggaacttctgaccaactggcttcacgctggggttcctacaacctcctctttgggcttaatttgctggagtgggtcacagaactcagggaagcactgactgacttttactggcttactgtaaagggtattacgaaggatacagctgaagagatgcatagggcgagatatggaggaaggggtatggagcttccatgccctcctgggcatgccacccagcctccacacgttcagctattcagaagccctctgaaccctgtcctcttggggtttatggaggcttcacgacatctgcattccttcctcccagagtatagggcaggaccctctctggggagggtcttaagactcgcaatcagaaaggtgtgggaaaattagggtcctgacttggggcaggtgaaagcagagcaggagaaggtcagagagattccgtttcctggggcctgccctgaggcccaacacattatagccaaagaccgtaacaagggcaatgggagctatgagccagtagccgaggatgaaaatcaatacctaacaccacatgggtttttttttcccccatctttgagggactttacatctctgagggcttttcagtgaggaatttaagctcatagaggggttatgccctgcctaaggtcacacaggaactatggcctccacctcagcctttgcctccaacccaggacactgctcagtgtccagtactgtttctgcttcttaggaggcctccacatccccctgcaccccaaaatcagttgggcccatcatatctggggttggggacctctggactccaagtcccccacccttgctccctggaagacagtgtcccctccatacatggtgctgtgaatgctggtctgcagatccctgcttctccctcctgtactaattttagctcctgtgagtttcctgtagggacccagtccagcctccagggcctctgaactggaagctgtgagcaaggcagggggtagtggccagaggaccctgtggaatgttctctcctggagcctgaaatcccagggcttaaagtttagctctgggggagctgggggtaggaaatgaggacccccagtcacaaagctaggctaggatccagggactcagcctagggtgggggtgggagctgggcagcctaggcctgtgccacagcagctggggcctgctgggagttggctgtccctgacctcatcagccccaggctcagctcagaatagctgtggggctgggccaggcctgtgtcagacctgcgtgtgcttgagcatgtgctttgtgtactaaggcactggtgcacatgggagtgcatgtgcattctgcatgcagctttgtgtgtggctgggtatgagtctcaatggctccagaatcacaggtgccattcacatacgtgtgtgttccctggagtagtgtgcaggtctgtgtccctgtggatgggcacatgatctgcacacgcatacccagggctgccactagagttgtgcaacttggagtccttaccagtgggttcaatggtagatgggtccatgtggcacagggacccacccattccctgactgtggaattgtatctgtgtgcagcgggtgtgggagtggtgtgggtgggtatacacatctgtggtgggattggctaggggcccttggctgtgctgcaggggactgaaggcaggtggactcagcagaggctgtcctttgggcactaccagaggccttacctggccccaagccaagaatgagctgtaagagaggctgggcaggtcttgccccatttagcagataggaaaactgggcttgcaatgcccatgaggtcacccagggaatgggggaaggactggtctgctgcccagagctcagtcagcctttctattcccctagatgtggctgaacaggaagtctgtgctctagggaggaagccgtgggagcccttcccttcctgctcgagcccaggcagcactgccttccctcagctgcacgtgcagatgatgaaagtgaggcccagagacacctagcataagatcagatctgtcctgctcggggccttgccccacctgtccctgttcgtcacaagtggtgaggccatatgctcctcctgaggccatggccactctccagcccttgcctccctcctaagccccagggatgcctggtggcccacacccatgctctaggggacccatagatcctctaaaccgtgctcatccctgaaggagccccttgaacccaccataccccttcctctcagagtcccacataaccccgagaaggaggcgcaggtaagatatttcaccagcaggggcactacgttacagagaggccacacactgcctggatcacacagcaagnnnnnnnnnnnnnnnnnnnncactgcctgtgatccacagcaagaggaaagcagcacaaggccccataccagctcttccagaatgtaccgctacctcccactgccccacaggcacaaaggatccccacagggaagaccttggaggcctgtttagaacctgaagcctcagttcattccacctgctggggcggtggctctgccaggctgtgctgtagactcagggagccaagtgccccagcagacagtcccgcaggccaacagggctgtgaaggggagtgggggccaaggtccggagcctgggggtggagggcatggggaggggggaggctttcccagagggccagagggacacctcaccagaagcctccttgaggtagcccccacccaccaacacagcaacacctctagcaggcagggaccagaggagcaaggcctttgggagtggagcccctcaggcagcagggggtgcagaagggggcaagaaaacaaggctggaaaaggggaggccagagctagggcgggctttggcaatgtggggagggatggagaagcaggaaggggcggctctgcaggattgggacccaggaggagagcaatgtggggcaaaagggtgaggtcactgggacctgcagtcactcagacaagggtcccaggctggaaaccctccaaggggtgatgtgcagcttggcagacagtaaactcccacctcgcaacaacccaagggagccaggggatgagcttggcaggccccaggcccctacttacctccactgggggtctcttcagcctggcaggttgggggatgcctcccacctcctcagtagggggctgagtagggggctggtgggccaccctttctgctcttccacggccgccttggaccctgagcctccccctcactggaacctgagtgccactgagagcaatgggtgactaacctggtggccagagggggaatcaggctgctgacggggggcttctttgttacaggtttgaactaagttccctcccgctcccggggggtctgtcccagataagtcttcagccaccctttccaaggtctcaggccttcgcacaaagcacacgcggccggcttcatgctctactaggcctgttgagactcaggagtggggaggaaaggggacttccccaaggtcgcacaggaggggcggccggccgtggacacccagcccagggggccgcagggcgcctcagtatacccctctacaggctccaagttccacgaacccacacagcgctccgcgtgtgctggcttctgtgactcagggcagacccgggaggtcacggggctgcaccacaggctcgcagagcgactgactggcggggcgaggtggtggcacggcggcctcggagccttgcaggggaagcggggcgcgagaggcgagcctgagtgtgcgcgtgggtgcgtagggggcggaggggtcaagactcccacttttcctccccgcgccgggtcccaggggcctccggatcccgggggacgccagagggaggcctcaggagaggcttggggcggcgggacggatcaataccgcgcgccagctcctcggtggcccgcccgtggcccccgcaactccagagcaacacccggaggcggggcggggcggggctgggcgaagggggcggggctggcagggggcgggactggcagggggcagggtgggggtgcgagcgaggagccgcacaggcagtcccggcgcggggcaaccacagcgctcaggtaagggcgcgacgaagggcgcgcgtctgcggaccggtgtctgcgctccacgcttagctcgtccaggtgggggctcccgcctcctcggctgctgcggtccccgcccagctccttggtcccggcggcagtcatcccccggccgtccgagtccctcgtaagataccccgctcacagcgtcgtcctccctgcctggctgctagcctgcttgggttacggggcagcgccccgggcctgacctgagccgtggtggcagggccacggggccccagccagcaggagagactgccaggaggaggtgacgccggctggttagggcggaagggcccgacccgggattccaggaggtggccttttcgcatgggagcggcatggcaaatgcctggcggccggaacaggagctcgggtctgggaaactccagcgactgagtgtgtgcctgggcagggagaggaagggaagctgggacatatgcgacagcagggaggggtgcttgtctaggacaagaggcttgtagccatggtggggccgaggaagggtgcagcggggagaggcgagcatgagactgagggatcaggtgtgacagttcagcgccccctccctggggcagtgcgtgtctctactctcccccactgggcaccagacaacgaaggggctgccacggcagcccatgaaaaagcctccacagcaggcagaacttccctgcctgttcagaccaggaaataccagagtgagtgagtgtcacgacaaggtgtgtcaggggcctaaggagccaggcctgggagaggacagggaaggccccagtgaccctgcccgggagggacctagcgtggacagaggccaggaatgcagaggagagaccaggtctggctactggttagagcgccacaggggcagccgctgactcacctgggcacgccgtgactggccagttctgtcctcaccctgccccaccccaccgcaccccgtggtgagcatcagggctgcctgaggacagctgtgaggcagggcccgtcaggatcttgctctgtgcctcaggtgagttgcccaccctctctgagccatctagctaggtgaacctggtgggctggagccagaagtctgggtctgagccctgcacaagttctacacaagggtctctggaccctcccattgttcctgggcctcagtttccccatctgtacattaggcacagcctgtcactaaggaacctttgaactggagggagggagagggtgaggaagctatgcccttgactggaagggggaaggttagggatgggacaggggttggggaggggggtactcctgcaggatcctcctcatattaaggttcagcacctcctcctcctgccctgcaaacgtgcacactcatgcacattcacgctgcctcacccctgcacttacactctcctcatcacttccaggatgaagccccagactccctagcctgggagctgggtccctcagggtcacctaaccagaatcccagcttccactgcggccttcccccaacccactgcctcaccagccatgcttaacttctgcccattcctctgggtggtgtgactcagtttcccagggttatagatccctttggggccacagatgtggaagactcccagattaacagttgccaacttgagtctggaggactcacccccggagtcataggctgctttgtggggtgggggagtctaaggaccagatccccacacccagagaagcccccttccacctgtttgtccttttgaggggagacttaagtagtttgaaaagctgtgatcctctttggctgggcgcagtggctcacgcctgtaatcccagcactttgggaggccaagatgggttgatcacttgaggctaggagtttgagaccagcctcgtcaacatagtgagatcccatctctaaaaaaaaaaaaaaaaaagaatagaaagaaatacaaacaaataaaaagaaaaaaatgctgtgatctggttgaacccccatttcgtagaggggtggctgaggtacagagaggagtaaggctgtggataagttgaagcatgtccagggctgagcagccaggtgagggctgctcctgggggagcagctgagactgggcagtggggacgagggacaggaagcctgaggaggagaggctatctctagggtcagagagctccttgccagggtatggtgtcggctggggtcatggtgctggccccccggagagtgtagggatgttggtgttcaagtcttcctagcagcgagttatttactgcagtatcttttcaacgtgcactgatctggttcctagtctgcatctcctatcctagcctcaccctttcttctaccttcccaaccaggcttggatatcctcacctcttagcttagaccccagctgactgccagctgagagtgaaaaggtcacccccaaagcgcctttccattccagcagtttcgggagatacgggtgagagttaggtgggcctggctgcacccctattcccttggctgggctttccttgtctgcctgagctgacctggagccccctgtgtcctgggggcctgggtctgcctcaggggcccacagagggagaagaagctgcagcacagaagctgcagctgggtgtctggtggcttccccttcctgcctctctctctgcagcctcaccctctcgaagcagcagtagcaggaaaggtggggcaggaatgcctggcccgggcctttggccagagctctgagggacccgccccactccattccagagccaattccctgggagttgtaggctctgccaggggcctgggatgcccgcatggcactctcggggcagggtggagaggggagggctgagaccccttcccactcacccttttgggtctgcctgtgtcacctgcccatcgttggctgccctgattttgtcccctgccccacacaggttggctaactccaaagcctcagcgtgtcagagacaaggagagagacagtctgcgggtcttgggctaaaagaccctctaactctccgccccagatacctgatcaggtcatttgggcagatgaacattgccaagtgagggtaccagggtctggtaggggagggctttgttggagtagagcctgtagcctggctgtgggggtaggtttgagcccaggcctctcttcacccctccctttaggcaggacactgcattcccaggtgattcctgcctgattggaaggtccctcactccagggcaggaaatctcaaggctcaagcccacctgcccaccccaagggcccccacccatccagcaggcaccccttcagggtggatggttgtgatcagtgatccctctgtctggttaggggaccatggagggtccaggctcccatccacattgaactctctctcactgcctggcactatctcctctacaactgtcatacatttatttccccaaatgtgactttggatcccatcattaccttgctctaaagtcctccatggctgtccacggccgactgaggcacagtgaagctgtggtcctttggggtgctgcttggtgggctgccctcagaggctgggccctcacacccatgagcctttactctcagggttcctccacttgcctgctgggtcctgtcttccttttcatttcttgcccatcattcgtggctctagcaggaggcctccggactcccccatacctccaaaactctccttgcttacacagcctggttgggtgacagggagtcccgaaccatgggctagaggacagggctgggatcctctgacagtatgaccctgtttatagagactgcagaatccctgaagggagacttgatggaaaggaggctaagaccagggcactactaatactatcctgggcacttgggatccatggtggatatttgagcagaggaatgagcaggccaaactgggcttaaagaacatctaccctttggggaagaaagggttgcttcccttggcagctctgagctctctctctccttcagggacccctcagctgggcctaggcagggagcagggcagaggtcagtggccagtccaggaactcccctttgaggcgatctgggctcactgctcagttctgatgtgggtggtcatggaccttgcttctgggcaccctgcctgagaggatgggcactggccttgctcctgtctgtgctatctagctgtaacctgtgccctacctaggaggccctgagtccggcacctggccatgtgcaaccctgaggaggcagctctgctgcggctggaggaggtcttctcagccaccctcgcccatgtcaacagccttgtcctccagcccctgctcccagccggtgagtctaggctttctagtggggagggaagggcaccgaggaatgatcccagggacaggagacctaccttgttggacttgctgagccacagctttctcaacctcaaataggagtggtgacacctggtatcagcatcttctgatgcaggtggtgcgatcttggctcactgcaacctctgcctcccaggttcaagcgattcttgtgcctcagccttctgagtagctgggattacaggtgcctgccaccacgcctggctaattttcatatttttagtggagacaggggttttaccatgttggccaggctggtctcaaagtcttgacctcaaatgatctgcccgcctcagcctctcaaattgctgggattataggcatgagccactgcgccaagtctgactgctccttttttaaaggaacgctgaggggccaggccatgaacctacctgtagcccagaccaggctgtacaaagagatggaattcctcctttcccagggtaaaaaactggaaactgccctttgcttgaattttcatcttgctcccacctagggcacctgatggtgccgggaggggaacaagactgactggaacaggatgcctaggttttacttccagtttaattctcacctgtgaggccttggacaggtgcctctgtgcatctgtgaaatggcagaggactgtgtgaccctgtggacttcacattctggatctgagtagtccaggatgaggaggcccagagccaggggggaattcgtgtatgtacttagttccctgaggctgtcagggttgtccctgtttagtgaggagtgggtgtgtctcctgtttcctcctcgaggatactgcccactgctccagcctgcccttcccctgctcagctctagggttcaccaattctgtcctgcggatcccagggatgcagaccctgctgcagctccagggctggccggtgctggtggctctcatgtgaacacctggggcctgtgcatgttccctgggagatggagcccacgtcctctactcacagtgtgactgtactccttccccagccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtaagaccactggaggtggggctggggctcatccctggtgtcagagtgacacctggcattaaggttcacctggggttggggctcacatgggtcagggttcaagcaaaggtttgggctcagtccatggttggtgctcacctgggttcagcctcacctgggcttgggtattcgcctgacagcaggctcagacactccagacctgaggcttggggcctctcagggaagacagactgtatgttagaattgtcttgttggcccaggagttgaggtctccagtgcccagagccaggccactgtgtgggccctcagggctgcagctgactagtgggtgggatctggggatcccagggaccaggggcttaggtctggggctgaggactgggtttgcagggtgtcccctgtgctgcctgcaggtacattgagtcctacacaagctgcatggtggtgcaggccttccagaaggcagcaaagaggagaaggtgagcacagggctggtgcactggcccctgacagggtgggagtgcctgagtgagggtggggtcggggaagccccctccccagagcagcaggtgtcacagcccacaactcatcctggaggactcctggctctacaaatctgcactgatccacactggaagagaaacagggaaggcccagtgaggccaggaacagaatccagacccgctctagctgggctggccttggggcggggaaggaggggaatcccttcagggtggatggttgtgatcagcaatcccttcatactctgagatattgctcttaaacctgtgagggcaactcaggtactgtgttgatctgatagggtagaggttttgggcctggggctggccctgggatctgaggggattagctggggcagggaggtggcggtgtgggtgcaggaatggaggaaggggtgaaggtggtgcgtggccctctctacacgcagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggaggtgggtaccaggggcagcagcatgtggggaagccgagggaagggagggatagggcccagactcagggggctcagcctatactcaggaaccctagtacaagaaggactcaagccatgccggcaggtgggagagggttgaggaagtcacaggcctgtcctgtggttttcaggggacatgggggacgtggcccagccctgaggagggggtccgaagacatggttctgtcctagggaatcttagtgggtgaaagcactgcccttccctgcggtgtctgaggcacgtggccctgccctggtagagccagcagagacccagagagcaggggtagaatcacgtcctgggaatgaggacacgtgggcccagggccaagctggggaagcaccttcatattccaccccctgccccaccagcagaagaggagctgtcagggagagaagggcaaggtctggcctagattcaggcctccccaccagccgggaccaggactgggctagggaagattccagtaagctctcctctcactggctgccctgtcccccttcagcatcacccaacccgggagctggtggtgaacgcagtcaccctctttgggaacctgcagtccttcatgaagcaggagttggaccaggctgtggccacacaggctctctggcacaccctgagaggccggctgagggtgagttgggggcctgaggggcagttagggagggggttccacattgggcatggagatgttggggggcttgagctgcttgctgtattctctgggcctcagtttccctatatggaagggggagtgatggctgaagcaggtggctgtaaggtccctctgtccagccattcttatctgtctgctgagcacgtcctgggccaggccctgacccggcctagggaagaggcaatcagcagaaccagtcctctcccctggggatatcaccgatcacacccttgcgtcactgcccaccatggcatggactgcccctgcagggaggagagtcccctgtgccctgaggtttggacctggtgtggagaattaggagactaggtagaggaacgagaattgtggaagggaggaaggggtggccgagtactgggagaggactgataggggcatggctggggccgtggcacagaggtgtgggaggggacactgaagcttcaagagagccaggaatgtataatcagtgcatttctgcctatctctgacccagggtccgctccaggtctactggagggggcctctgggaggtgtctggggtacattgggaggtggcagagtggcaggcagcttgcaggacagaggtgcctaagccttgtactgtcctctttgccccaccaggatgtgctctgcacccctgctcacagactccttcaggacagccaggacgtacccgtgacggtcgcaccgttgcgggctgagcgtgtgctgctctttgatgatgccctcgtcctgctgcaggttggggtggggctgacccaaggtcttgaggccacagtagggttctggggtctggctggaaaaggagcagtaaaggggcatgctgctgggactgagaaagtgggctgggagggatggtcagggatagaaaggcgttgtgttggggaggggcggtccactggagctgtccccagaggagcatgggctgaggggaaaggctgtccagggtttgtcccggcttcagcccttcccagctggtgtccttggttacatgtcttcaccttcgttttcccatcgggaatgtgggggtcattgtgagtgagtttgttctacagtagacaccagacaactcttagttcccattgtactcaaatgagagaggaaccccagacagaaagtcatgggtgactgaggggtgactaaggagggctggatgagaaggcttctagagaaaagtaccctacaggagcagtgcctgggctttcagcattgtggaagtcagaagggagccaggcctgaggctgggaattgttacatggccagtcaccaactgtggttcatccatcctgaaatcatgttgtcctggtgaggtccacagcacagtcttctctaccccttagaaggttggcctggaacccccttgcagacaggtggccggggcctggcaggaagctgctgcccagcctagacctgtgtcccctgaagcctgattttgggattggttctgatttagtttgaattcccctccactcccaacttcacactccactccaggtacactgatgagctactgtcccttccctgtgctagccctctcctgacgctggacctttgcacatgctgttgtgtctggtgggccatctcttgtccctggcctgcggctggcaagctcctcctcacccctcaggcctgggcctcccacgtcctccccattctggtatggagcagtgattggcctgactgggccgggtaggaagttgctacacaaaatcttcccataggaaggggctttttttctggctgtcagagcaggatggcattccaggtagaaggaacagtatgagcaaaagttcacagtgaggagaggttggggcaagctcatgaaggtgtgattgtggagtggccctgatggcgtagtagtggtctgtgaggtcttaaatgttaggctcagcagtgtctcaacccccaggcagtaggagccatagagaggtttccagcaggggttgaccaggtcccagcttcatttgtagaccactctggtagccacagggggctagaggctggttctgagttcctggccaagctctggggtagaaaggacatggaggagctgtccctgaggtggggagcaagccagaggggagagggactcagtcctggacatgctgggcagaatagccttggtggccacacaaggttgagcttggggcaagccttggccagagggtaggtgagcatctggcctgggctctggatgactcctgtgtccatcctcttccagggccacaatgtccacacctttgatctgaagctggtgtgggtggatcctgggcaggacgggtgagcaaccccctcggctgacaccccaggccttcttccctttacccccatgacacctgcccacaccctgggactctggcttgggcccctccaccctcctggacaaagctggggcctactcatcacctccgtctgtctaggtgcacgtttcacctcctcacgcccgaagaagagttctccttttgtgccaaggactcccagggccaggtgagtgtgggtgagctgtgaactgcgggagcggggtcagaggacagggtaggaagagggcagaagtatgcaaccctgcagggccccacaggagtgccggcgagtgtctggcaggcttctggggacctggtcagagtaaatcggggtcaagcattagaatgccaaaaagaacagggtatttttctttctaaagacagaattgggtcctgtgttgatccctgccctgaggtcttgtttggcccctctgggcaggccctgaaactgcagaggaggatctcaggttgggtggagggcccagagagtagcaagaagcagttgaagggtccccaaggtgacaaaatggagtaggaggtggagggtggagggggtggtacctggagctaccccagaaggcttcctggagggaaagcctccagcagcagtgatccccttccccatgttccccctcccaccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagtgagtggctggagctctgggtggcaaggtgggactccctgggggtctgcagggcagagagcagcacacaaacctaattgtctcaggacatgttccaggagcggttactctctgtggacagtcaattctcagagtccctcttaagtcctcttggactgggcctggcccagagacagtctgtgccaaataaagtcttgatggtgacgctagaggacaaggggcagcaaccacgcgctggccttacagcctgcaggtgccattccattcttaggagggtgggagaataattctcacatctgtacctcattgtctggcagtgttgaaatggcttgcacacattctatctccatcggtcctcatgaagacgctctgtatggagtgcttttacccatttcataggtacaaacactgaggcctagtgatgggcataacctgcccaaggtctcagggcaagtgatagggtgagccggcctcaatcacaggtctgtgtgaccccacagacaggcaagcctttatagaccatgtggccccaccccatgccacagctgggaaaacagacccagagagcagaagggactcacaaggctacactctcaagcacctccgctagtttctgataccctgcctcctttcagaaagggctcgagaagacttatgaacaaaaggacagaaaaaacacagaagtggggaggagggtggtagaaaccccacagaccagcattaaacttgagcttgattcttagctctgagcttcctgttggtcaagggaaaaaagggaacctagatgtctccagggctttccttatgggatgtggtgagtgtgccccatgaggctgctggtacagttgggccaggagtagaaaagggctaaaggggctttctgcaaggaatgttcggagctcagacaagagggctgggtgggtgcagggagcccagtccaagggaagaggaagggaaggcgtctgagaaagtaggtggctgaggttgctgaggggtgggtaggcctgaggctcgtgaacctccactgtgttccaggggaaccctgaaatggccggatgggcggaatcatgtggggaatttctgccagggcctggagcatgggtaaggctggctggggctactgctgggaggcgtgcagtgggctgaagggtgctttcctcccctgctgtggtcaccagcccggccccatcctgaattcccaaacctcaagcaggaacttagagacaatccggtccagcccccgcccactgtaccaaaggggaaccgggggcctgaatagggggcccgtctcagctcgaggtcacagagggagtggtacaggccaaaaggtgctccaaggtgctcgggaccaggctggagggaggggtcctgagaggggccctttgaaggataggaaggctgagggcctctgagagtctccctgttgtctggaaggctccttgggggcagggatactcctgggtggcatggagtaggtgtaatgggcgtctcaggtcagggctgatccccacccccacaaccatgctgtcagcttcggcatccgcctgctgccccaggcctctgaggacaagttcgactgttacaagtgtcactggcgagaaggcagcatgtgtggctacggcatctgtgagtaagtgaccctggctggggggttcatgggctgggcccatcctctgggctgagctccatgaggcagagctcgttgttgatggccctccccaggtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacaggtgagcgccctgcagccaccactcccaggacggaggggtggacagggccctcacagaccagattgttgcaggacacaggctcctgtttgtcccccactgtgtctctcttaagcccctcacttcccctccagtccctcggttgctgcggaggctcaggctgagcgaatcttggtcacgctgactgcagggtcgcccccgcccctcacccctcctcatggtgttggagaggcatttctgaccccctgctctgtcacgtctaaaaactgcagcccttgctggctctctgggctgtgtgataaagccctggatccttggcctggcaatcacagcctcgcctgcttctctgacctcaccccagctgcgtctcctgggcacccctccagcctttctggaccactgaagtccccacgtatccatcacatgctcctacctccatggctttgcacacactcctattccccctgtccttcctgccacctccacggagaagcctcccagatgcccttcccaggctgcctccctccctcctccattctctattcctcttgggggtcctgacctctctggcactgtgtctgttgagtggattcaggtgatgtcactgccccttatctgcactccctgccgccccgtgccagcagagtgcccaggaggtacatgggaatgagtctgatccaactctggccacattcctctccttccagaggtgagcgctacattggcatgtggcaggctggtcagcgccacggcccaggggtcatggtcacccaggcaggtgtctgctaccagggcaccttccaggcggacaagacggtggtgagtggagtgtatcctgggctatccctctctttgcaccccactcccgctgggggcactgaggctgagctgaggcctttcagggagggatgggaaagggggctgtgttcctgggtgctggagggagccagaacctgggcaggaagccagctctaccacccacctcccctggccctggccaatccctgctctgcctgaccttggtttccccatcagcaactcaggttaagaatacttaccatagactcaatgaactagcaagaatggagcacttgctcatgatgatgcattagctgacattcacagagtcctaacttgacacctggctctgggctaagctcccaccctgatcttgtgggatcttcccaagagccctgcaggttgatgtcattattatccccagtgtgtccctagtgaatgacaaatgagaggttcagagggatcagaggacctgctccatgtcaccttcactgagtggcagagctgacactcacaccctggtctgctgagcctggccgccgagcctgggactcccatgtttgcctcacccatacccttccaggtgcctggggaatgtggggctctggcctgatggctgttcttgttattatggtctgttggtttgtttatgctctacttcattctcgaaaggattgaaggaggccttcaaggaaagaggaagacaaggggaagaataagtacacaaaacagatttggaaataagccgaacactaattgtaaccctttcggctctgagcttcccggcagcccatggggcaagggagcctggtcagctctgccgttcccagggccagtgacaagcagggaagcagggatgtttcagagaaagccccacatttcttgagctcccaagggcttcctgaagaagccgctggggtgaggagccagggcggagggtgtcatttggggaaatccagggatggggtcctcggggctggtgcttagcaggccaaaggctagagtcccaattaggtacagtcctgtggggcgtgatgaggctcagggcccctctcgccatgtgtcagggcacatctcccttctttggccatctctctccaccctgagtttcctggcccttcctcacccaccctttctaccctccctggcttcctctccccaagggcccgggcatcctcctctctgaagacgactccctgtatgagggcaccttcaccagggacctgaccctcatggggaaggtgaggaccactgaggcccccctccacaccctgccaaggccttggttggtgtctgtaatctccccacttagactcagggctgggggcaggtaggggagggcctgtcccacctcccttggagccaaggagtgggcacagcaactccaccctgccacagagttgcgattgattctggagtgaggtgagaggggaccagtggccttgcctgctatccagagggtaccggtggtctcctggctgtgtccctccataccctcctagttcagaatacacgccctccaccagtaccagtgcctcgagcagctgtccctggaggcactggccttcagtgtgtgcctccctgagctaacccaggaaaaggcaatgtgtccccgctggagcctttggaaatgtaggggctgttttggtttcataatgactggagcaaaggggtggagatcaggttgctatgaatgggacagcctcatgtggcaagacaccgccctcctcaggcgttgcctgtccctgggcttacccccaccccagcccctcagtggtggtctccccactcttgcctgtgagtcccttctgcatctctctcctcttcctacctcagaggtgagcgagcccctgagacgtgggcacagctgttggtggggggctctggcaggcatagaggattatgaacccctcagcatggagcagcttgaatggatggcgggaagcccattcattagtccttagcctctctgacactgatggacaggcttgtggcctgtcatgattggctggaagggtaactgggcagacagacatccctgctccttctcctggctcccagggcaaggtcaccttccccaatggcttcaccctggagggctcgttcggcagtggggcagggagaggactgcacacacagggtgtgctggacacggctgccctcccaccagacccgagcagtacctgcaagaggtgagtgcctggcccctctggctctgggcctatctggggatgtgtctgtgtttccatcccaaagactcaggtctcctcagaggggcctttttgcacccacctcttagccctctagagagttccgagagcccagggtgtacaactccagtcagagactcttgggatcaggggctgtgtggatataatgcggtacaccacaaaactggagagaaatattatttgtaggctttgcttaggtcctgcttttttttttttttttgtcttgaaaggatacaatacggtttacaaaccaaacatacaggaaaaaaaaaatagaaaataagagcatatgttaaccttaaaagaaagggatatgtagacatgtcctacggcatttacaactgatcattgagcctggctctgagtttcctggcagccaaggtaaagaaggaaacttgctaagtggaatcacagtcattatcaaggagtattccagagaaggatagacttcttttcctgtaggaacagagttcctccttggaaaacagttgctcttgttgcgtctgttgaggaagactcagtattgcacagaggaaggaatctgtgtgggtggcagttctaatgggaagtggtcccaggcagcatttcagatgtagggagggagtacagttgactacttggcccgctgtccctgcatgctgcttctccctgacagcaggagctgggagtggacagcaatccctaggggcaggccccagcccgggtgtgagtgtgggctgcgtgtagcctacgagcatgacactggagtgcagggctccattagacatgcgcagccaggccccagcctgttggccagggcgggatcaaccacaggaaggaaccagctgtaagggagggcagagggggatgtcttggaggggaatcccagactttggacactggtctctcttggaccaagaccccctctctggcttggcctccagatctgcccacctttctgtctccgtctttccaggattccatatgcttctgtctgtcttctcgtcgcagggtagattctctgtccctttctctgctgctcttcctcctggagccgtggaggtcagccccctctgcatggttcaatccatccacccttcttggggcttgatcctgggccaggctcatacccccacccctccaagggcctgggcagagtcctgcctacctcagctccatctctctctgccccatcacccaccctccatccccatcgcaggcagctgggcgtgggtgccttccccgtggaaagccgctggcagggagtctacagccccttccgggactttgtgtgtgctggctgccccagggacctgcaggaggccctgctgggcttcgacgtgcagagctccagggagctgcgtaggtctcaggattacctgtcctgcgagaggtgaggccggctgtgtgagcatgcacaggttagggtgggccggggagggcttcctggggggagggggctgggccgaggtgtgggtgagggatgctgtgtgtggtgcccaggacccaccctgaggacagtgtgggcagtatggaagacatcctggaggagctgctgcagcaccgggagcccaaggccctgcagctgtacctcaggaaggtgagagccctgctggggtggccaagggggtgacattgtcactgtccctggtggggaagggctcccatttttcatagcagggtgctgactgaaggggacaggcctgtggatcccttgtcctcagaggacctcagtgttctcgtgtatgagatgggagaagtgttgggaggctggcgtgggcatgctgtgctccagaccccggtgcttagtctctctctgttgcctatgcactggcccaggctctgagcaactcactgcaccccctgggaaagctgctccggacactgatgctgaccttccaggctacctacgcaggtgtcggggccaacaagcacctgcaggagctggcccaggaggaggtgaagcagcatgcccaggaactctgggctgcctacaggtgggctcggtggcaaacgggacagctactgccctgtgacactagtgtgccctttccaggcatcagttctgccttgcatttgggaggaatgccaagtgtctgattcaacaatgaaccagaggcttggtcagtgtgcagctgctgagcaaaagggttagagggtggggaggtgagagcaaaggcccagctgcagccctcagctagagtccaagacccaaccaggcgctgggctgactctgaccccaggtgcactctcaccccactgtaggctgagcttggccctggactcggaacacacctgcagtcccaggctgggctgtgaccccatgaaacactgcaaatagaagccttagatgctatagttccttctgctgctggattctcaggctaacatcctggagctccaaccttctaacttctgtggtttgagaggatgaaccctgcaggccatgtccacagttctgagaggccacctgcttttgcctttgttgactggtggtagaactccagttctgtggcaaggggcagccacaccatttctctctcattgactcacaggggtctgctgcgagttgccttagagcgcaagggccaggccctggaggaggatgaagacacagagacaaggtgactggcgcaggtctccttggggcctgccgtgtccagggaggcctcatgcgtctgctcctaggacctcccttggggaaagaggtgcttctggggaagtgctgggcattcactctattgaccaaacattgtgcattgatcgtttgtggattagaatgacccatgacctctgttctgtgaggaaccagggagggggcactgctacaatgcattgaatgcatctttgttctaaatgtatgatcccaatctcatctttcgcatgcagaaggtgagtagctccccgaggcaccctcctctccctgcacacagatggggaaaccgagggctggtagggatgagcctgaggttatacaggagttaggtgggcatgaaatttgtttcccccagtccctggagcaaaccttacaatttgcctttagattctagacctgaaagtgttcctgatcagagaggccttcctgtcactgccttgcaggaggcaagggaaatggggttagacattagggaggattccccgcccggagtcctagcacagcaaaccaggaggtggaactgaatcagcctggaatggctgctgagagctcagctgcaagttgctggtccatctggggccctggttttgctttcagtcaaatggggatccaactcctgccccacctgccatcttggttgtcaaagtcaaaggagggaatgaagttatgaattgaattgggcaaatgatgactgagaacaggcttggaaaaggttttctggggaggaggaggctggaggccaggacactgtttgttgtggaactaggagctctttgagacgagactccaagtagtaatcccagaccccaccttgctcatcccaacctgttccggtctccccatcagggacctccaggtgcatggattggtgctgcccctcatgctgcccagcttctactcagagctcttcacgctctacctgctgcttcatgagcgggaggacagcttctacagccagggcattgccaacttgagcctctttcctgatacccaactgctcgagttcctggatgtgcagaagtaagccttcccttcccccgtgccgtgttagccaggactcaaactcgactcagactgtcttcagccaaaaggtggggctggggttgataggttcatgtacccaccaagttctaagcttatgcattcaggtgtggctggatctaggtgttcaactgaatgacagagggaagcaccttccatttctgttggtctttctcagcctcccccttgtggtgacaaacaccataagcaccaaccgctcaaggttcataccctcccagctcctctcccagagtccccacaggagctggcattgccttccaacagctccctcagagcccctgaagtccctcactggctcggcttggggcttgggtcttgagcccacccctgagtgccagccgtgattgaccaggcctgcctgaatatccactgctgaggctggggcaagatcacctgctctgagcacttgggctgagagtaggggagaggaggtccctcaggggagactgaggactgctctgggtgcatgtcgggaggtgtttaccacaccccagggcctcccttccaccctcagtctccaaaatgtcctttctcttcagtgtcccatctatccattgatgccacaagtgaccccactgtccacagtagagggcacgggcactgtctctgctcccacatccaggtctcctttgttacacagggatggtgcttcccacccaccctgcaaatccctgtttcttcctctatcttggtgactgtgtcctgcatctgaccagccaccagcctaaagacctggctgccagtgcttcccaagcatgccccgcctccctcaccacctcagtgtcgcttccccacaccagcctccacctctgctgcatgagggctgcatccccctgctcacagccctgtgctggctcagcagagcctcctggatggagtgcagtctcctcacccctccctctctactggtcaccacgacctggctcatacaagcccctgggccgcccttacctccctggagcttctggagctctgccttctccaggaatccttccatcctccccatgacctaggctgatctccttccccttttcaggacccagatctgccgggggaaacagtggcatagggaatttgccctctgacctcagactctgccccttgtcgaggcagagcctcctgtctcactttttcaatttcaggcacttgtggcccctcaaggacctcacgctgacgagcaatcaggtgagagcgaggccagagccccaagccagggacccccagaggtcctgcaggctttgaggagccctttgcctcatgattgctgggcggaggctgcagaggagctggggaggggcagggtggcttgggaggagacactgtcattctgacctcccagtgtggtggaggtaagctgttggcctgtaaccaccaggctcaaacacaggttcttacctggctgtgtgaccgtgtgcaagaggctcgtgcaccgtgcctcagctgcctcatcagtaaaagggagccaacactagaacaacctcaaaattcttattttatttatttatttatttactttttgagaaaaagtctcactttatcgcccgggttagagtgcagtggtgcgatctcagctcactgcaacctccgcctcccgggttcaagtgactaacctgcctcagcctcccgagtagctgggattacaggcgcctgccaagtgctcactaccatgcccagctaatttttgtatttttggtagagacaggatttcaccatgttggccaggctggtctcaaactcctgacctcaggtgatctgcttgccttcgcctcctaaagtggtgggattacaggcgtgagccactgcgcttggccagaaccacctcaaaattgttgtgagggtgaagtgggcacatgaggcagctgttctcaaaatgtgcctgccaggctggaagcatcaggatcatctgggaacctgttaggaaagcagattcttggaaccacctcagacctaccgagtcagaaatgcagggagtgggcccgggaacctgtgtttcactaagcccttgggtttgagaaccatcgacataggcactcagaactgggcggcacccagtggccagtgcctgttatgattattatcttcttatccgtttggatcctcccaacctcatggagactattcaccccgttttatggttgcacaaactgaggcccacagtggagctgtgacttgccctgggtcactcagccctcagggtggggctgcactaaagctggcagtgaagggaagggtggcgggggactcaggcccggccctgggaaggaggggatgtcagagctggggggccatggcctcatccagcccactccctccaccatgcagaggtactccctggtcagggacaagtgtttcctgtcagccaccgagtgcctgcagaagatcatgtgagtgtgagccgtagtgggttgggggtccggaggcagagtgtggggtgctcctggttgggactgaaccaagggccttgacctggagccagctaccctgctgcaggaccacggtggacccacgggagaagctggaggtgctggagaggacatacggggaaattgagggcacggtgtcgagggtattgggccgggagtacaagctgcccatggacgacctgctgccacttctcatctacgtggtgtcgcgcgcccggtgaggcagtcaggagctgggggtgcagggcaggggcagggtcccacccccaaccacgatatcttctgatacctctgaaccccagggtttatggatgcagcttctctctgtacagatggggaagccaaggcccagaaaagggagggtcccagccagggtgctggggtgctagaggtagagtgaggaccacaccccaggtgtccagccatccaggccagcgctccttccccagctgcctgtccgcgacaggcctcttctccttgtctccctcgctctcttggtggggcggtgttctccagaattcagcacctgggagccgagatccacctgatccgtgacatgatggaccccaaccacacaggaggcctgtatgacttcctgctcacagccctggaggtaagggacaggggctgtggaccgaggtggaaatgccctggcccctggggcagacccttttcccttcccagacatcataacaccatagtgggagggagctcaaattcacagctcatgtgtgactctgggaagggtcctcacagtgtccctgatcctgctcttattaaaggagccagggaggggtcccacagtgcatcccagccctggggaccctggggccatgattgctccatgctgcattcccaagcacagtgggagaggaagggccccattttcctcgcagactgtggctgagggctgagttggagacacgcctcctctgggttgggaggtgggtgcacacagctattgagccctagatcctgtgcatgtggttgggatcaggcaggtcaactggcctcagccttgcctctctccctccagtcctgttacgagcacatccagaaagaagacatgaggctgcaccgcttacctggccactggcactccagggagctctggtagcctggcctttcctggacagactgaagagctgagcagggcactgccagcctgtcc

SEQ ID NO: 1073 - DNA, 1779 bp, Homo sapiens
ggaggccctgagtccggcacctggccatgtgcaaccctgaggaggcagctctgctgcggctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaaggcagcaaagaggagaagcgagtactggcggggccagcggaaggcgctgcggcagctgctttcaggtgtgagctcagagggctcggtgggcgcatcgctgggccaggccctccaccagccactcgcccatcacgtgcaacagtacgtgctcctcctgctgagcctcggggacaccattggggagcatcacccaacccgggagctggtggtgaacgcagtcaccctctttgggaacctgcagtccttcatgaagcaggagttggaccaggctgtggccacacaggctctctggcacaccctgagaggccggctgagggatgtgctctgcacccctgctcacagactccttcaggacagccaggacgtacccgtgacggtcgcaccgttgcgggctgagcgtgtgctgctctttgatgatgccctcgtcctgctgcagggccacaatgtccacacctttgatctgaagctggtgtgggtggatcctgggcaggacgggtgcacgtttcacctcctcacgcccgaagaagagttctccttttgtgccaaggactcccagggccaggcagtctggcagtggaaggtgacctgggctgttcaccaggccctgcatgggaagaaggacttccccgtgctgggggctggcctggagccctcccagcctcccgactgccgctgcgcagaatataccttccaggcagagggccggctctgccaggccacctacgagggcgagtggtgcaggggccggccccacggcaagggaaccctgaaatggccggatgggcggaatcatgtggggaatttctgccagggcctggagcatggcttcggcatccgcctgctgccccaggcctctgaggacaagttcgactgttacaagtgtcactggcgagaaggcagcatgtgtggctacggcatctgtgagtacagcaccgacgaggtgtacaagggctacttccaggagggcctgcggcacggatttggggtccttgagagtggtccgcaggccccccagcccttcaggtacacgggccactgggagaggggccagaggagcggctatggcattgaggaggatggtgacaggtgagcgccctgcagccaccactcccaggacggaggggtggacagggccctcacagaccagattgttgcaggacacaggctcctgtttgtcccccactgtgtctctcttaagcccctcacttcccctccagtccctcggttgctgcggaggctcaggctgagcgaatcttggtcacgctgactgcagggtcgcccccgcccctcacccctcctcatggtgttggagaggcatttctgaccccctgctctgtcacgtctaaaaactgcagcccttgctggctctctgggctgtgtgataaagccctggatccttggcc

SEQ ID NO: 1074 - protein, 484 aa, Homo sapiens
VRHLAMCNPEEAALLRLEEVFSATLAHVNSLVLQPLLPAAPDPSDPWGRECLRLLQQLHKSSQQLWEVTEESLHSLQERLRYPDSTGLESLLLLRGADRVLQAHIEYIESYTSCMVVQAFQKAAKRRSEYWRGQRKALRQLLSGVSSEGSVGASLGQALHQPLAHHVQQYVLLLLSLGDTIGEHHPTRELVVNAVTLFGNLQSFMKQELDQAVATQALWHTLRGRLRDVLCTPAHRLLQDSQDVPVTVAPLRAERVLLFDDALVLLQGHNVHTFDLKLVWVDPGQDGCTFHLLTPEEEFSFCAKDSQGQAVWQWKVTWAVHQALHGKKDFPVLGAGLEPSQPPDCRCAEYTFQAEGRLCQATYEGEWCRGRPHGKGTLKWPDGRNHVGNFCQGLEHGFGIRLLPQASEDKFDCYKCHWREGSMCGYGICEYSTDEVYKGYFQEGLRHGFGVLESGPQAPQPFRYTGHWERGQRSGYGIEEDGDR

SEQ ID NO: 1075 - DNA, 30852 bp, Mus musculus
  misc_feature (1)...(30852): n = A,T,C or G
acaagagattgggctggaggtgttgttcaatgttagcttgttgtacaagccctaggctccattcctggcactgcagaacgaacaatttgagtaaaaaaaaaaaattctcaaagaatattataccaaaaaaaaaaaactttgatcattgaactcaggattacgtgtgtgtgtgtgtgtgtgtgtgtgtgtgtgtatgaagactgtaattgtaacatttagtcgtgtgaagtcatcggcatttaaaagtgacttgctgacggagcctctttgatttatgttaggcagatgtgtagggtgtcatagagtgaggaccacgtcatagactgtcttggaggaaagagttactggaagcttgaaaagcctttcacagtcaaagcaggtgccagccatatcaagttggaaattaacggttgttgatggtaaaggaagagatcgactctcagaggagaattcttgaacagtgcggtggctcagcctaaaaccctcatgggcaaaagtctcagaatgagtggccagagccaacactacgtagggagggtttcatctgcccagacagaaactgtctccagcagccactcagttgtctggctctgaaaccagccactgtcctggcccagttctaaaactgccattgtctttattggggagcggggctaggatgactgtaggtaggagtgcttgctcttgcccttgactcgtggaagatcactggtagtcagctcatggtctctctgtagttgggaacatcctcagaagacaagaagacaccatactgccagttgtgttaaactaaaaaaaaaaaaacaaaacaaaaaacaaaaaaaaaagaagggctcgggtgggacagagggagacgggatgccagggaccatcttttacctttgccttttcccaggactgtgatgagacgcttggttgtgggattttaaagttatagcgctcaaccacacagcaattcaagaatctcctccttaaaaggtctattccatatcatcagcctaggttttacttgagctgttcagctggtggggtgcatataggtcagaagtccagactctggttgtggctgttacaagttctttccctggagctgaaatctggctccctgtgacttctagcggagctgtgtgtccttcagcagcagcgtccccccctctcttctgggggagctctcactctctgcccttggctctcacagatctgcagccctctctctttcaggtttgtttacctgggtcttttcagtgttcctcatttcatattttcccatcatcctctagtgaaccgtgctgcctttcacttgataagctccacttctgtcactgtcactcaagtccaaccctcaccttgctgtacaagaggtcacagtgatgtggtctgatcatcacagatgacggcgggacagatgctagttaagacagaattaatgtggcttggggtgtggctcagtggtgggatacttgactagtgtgcctcaggccctgagtgctatctccatcgtcctctgcctccaaagagaaggaccaaattaatgttgatggctattatgtcacactaatacggcatagtttgttatgcataaggtatttctctagttctgttactccacttacacagtcgttatcttaaaacccaagctaacccttacagggctggtcgtattcctatctctccttaggtttcatgaatatttgcttgactagctttaggttaattattaagtcatttgcatatttgaaatgaatggtgttttctattgctttcatttacagttttaataaatgtgtgaaaataaaacaacaacaacaataaaaaaaatggagagtcccatagtacccagagctcttgttaggttttggtcaacttgacacgaactgggtcatctgagtgagaaactgggtcccttaaattggcctgtatgcaagtgtgtgggagcactttctagactagtgattgatgtgggagggtccatccaattgtgggaggtggtgctggggagtaagaaatgagagcctgaggagtaagccatgaagcagtgtcctcccatgcccctgcctcacgtttgccttgctcggggttcctgtttgtccttacttccctctatgacagcctgtgattgtgacatgtaaaccaaacgaacccttccctccctacattgctttttcttgtgccttttatcacagcagtaaaagacaaactaggacacccagacagatatgctaagaatgattcaactgctcaatgaatgaatgaataaatgaatgaatgaactaacccttggtcatgatattaatccatcagcatagcccattggttgtagtcttatctcttgattaatccacttctactttttttttttttaaaccaccacagatcaactagccatcactttcactcaaacactcactgtgagacaggcttctcgaatctttctggcttctctgatactcaaatgttataacaaaaacaaatcttttttgatgtagaattttgattatgtcactctgctattattactttagtcataataaagaacaaaatctttaactaacccacaaggcaagtgtgttctggcccatgctgagctcttctgccttgtctctcactcacctgcatgtcaaccacagatactctcaaatcttccccctgccccagtgcctttgtatgtgatattactttggctcagaacctttctaccttgtcacccctcccagcccttcgcctggttagtgcctctggctctgtttcctttagatgtacattacaaacgttcctagaggcaaggctggaccatttcactcatacagttctggggttcagaatttggcctcagggggattctcccattctctgtggtaacaagggcctgatttgactgccatgagtggatggcatttgtctggtagcttagcagatgctggtagcttagcaggctacgctgagctaggacttttgacctaaacttacacatgggagctctggcactgtgatggcaggacagaggaatatcttacacggtgggctcaatccttagaaaaatacatttttagaaggtcatgtagggtgggaaggctttttgtgtctcagaagtttcagaacatttttaatgcttcatcctaagttagttaagggccaaccttggagtcaggagaagtgattagactccacctctttgtgggagggtatcaggacacaggtggcaatactgaagctgccactttatccttcaaatagcactttagacgagtcacatgaaaactttcttcagcaccacgcagacctcttggtagcactcttcattgtaaaaattttatatttgtttatgtttaattgacagttattttgctccttggccaaactaagcagctgtactaagcaaagccatctctgactttgctcatctctctgtccccagcactgagcagagtgtctggctcaatgaatgtctgttgaagcgtgaatgaacacagcaccacccgaaccttgacggcagtgattgcgcactgttctcaagcgcgtcattgtgccggagccttgttaacagtcgaaagcacaggatcccaagcgatgcctatccttcacagttcagaaacttcagatgaaaggaaacagccccacccttttcctctcagcgtctcaacgataacactagctgctgttagcatgcgcctttagcttttgggactctgtgaagaaccccagtactttatggcgcagtagaggccaacagaggctccagcaaggagtgttcttgggatctatgtccctctgccagcagatggatccacccacagtaggcttgttgagccgtaagtatgtacagacatagaggagcgaccaggccctagtgcgcttgcgcgaccggattgggtccttcctctagtggccatgccatctgctgatttgctcctagcaagaacaccgtacacctcgggaggagctaagtgctgcggctctccacggtgttttccagcttgacttattcctggacaccctgcctttctttttagtgctatttgaaggatccaggcctatgtatctttacatctccctagacctctagaagaactttaatgctgaaaatactcagtaaatatttgcctttaagacagtgaatgagcaacctagctgagacaatgctcctcttagtagcattttcctactacctggttaccgctaagttcagggcaaagtcttttccattgatggcctcctgattgctcccagggaaccattctcccactttctctttcagaacagcgtggtcctttgtgccacctcatctcccctcttctgcctcagctagatcccagtgcctacgctaaagcctgttgcctgtgaggtgtggaacagggtagtgttctacctggcacatagtaggtgctcaagcagcatctgtggaatgatttgcctactagaacaaaacctcccatgatgcaaatggaggctttgaccccattctaccccacctcagggtctcccaagggtcctgtaatgattttagggtatgttctggtagtgccctgtctcctcttatcctgccagtgggcagatttggaatctctttgcttgctgcccatgcactactgaatctggttggcattgtgttaaagaaaaatcagtaaagttggatcagtttgaatctcagttctgctattaccagtttcatggccttgaacatatcttcaccctttgaaactggttcttcatctgtattatgggggttaacaatctcacccagacatcagaaaccagggtgcttggtcattcaccccaccactcttacttgtgtaagagtgtatataaagtcagcgaagatggtattaccgggcactttgctttctagactgtaaactcctcccccccatccccctccccctcctcctcctcttcgtttttggatgctgaagacaaacatctttattaaagatactaccaaaattttggcaaacaactcttcttgtgtgaacagtcttcctttttaggcttttcgctagctcacccacccctcagacccgattctgcttctagtgacagaaatctgtcagagaatccccccataaattcttaggttctttcctctcccattgcgtctgctgaacacccgctctgatagtaagaatttccatttcttgggccatctggtaaaagccttgctggtgtttggagtttgggggacggttcattcctggggaagtgacagctctgttctgagccaacaagagtggagaagctagcttcctcacacacacacacacacacacacacacacacacacacacacacaatttctaaaggaaggttgtgtccgtgttttaggaacgggcaatggagtgtctgccaggctggtatgcagtctccttgtgagcattcgtgatgctcctctagggaactgggactgtctggcaaggccaaagtgtgaggtgtagaactttgccatcctcaagctcctaaatggcttttgctgaagcctggcttactgtgggtagtttcagggatcatgcatttgagacaaacctgagctatagagcaagaccctctctcaaatccttaccctgcaaacacacacacacacacacacacacacacacacacacacacacacgcacacacaaacaaaaaacaaacaaacaaaacaaagcaaaatactcacaaagctggtatcagtcaactcagaagtagtgaaggaggctgatgtttctaatcagggaaagacaagtttccaaacagagaagtttgcaacagtatggacttcctgggcagggccagagtttgccccacccagtgagtttcagggactatttgttcgagattttggaaggctattatgcaggggctctcaaccttcctaatgctgagaccccttaatacaagctgtggtgacccccaaccatacaattgttttcattgctgtttcataactgtaatgttggcactgcaatgaatcgtaagtaaacatctgatatttctgatgctcttcagcagccctgtgaaagggtcattagtcccacaaaggggtcacaacccacagattgagaacgctgccgtaatggttccatgtgattacctgagttaaactaatcaattaagtttatagcatagggtcatttgatttggagacctcgtgtgtttgacatgtcaggtggggaaaagttctctgattagatccagtgtgttgacttttcaggtattatacagactcctatatttagggaggaattcagacctaacaaggccccagccttcagatccatgataaataggatactgtgagtgacttactgtgacaaaataggcaagggtccccaggctctgcccacgtgccatgtctgctatagctcaactgacaatgctaaaccctaacatccattacagttactgggagagagggagaaagctactgggagctagacatttggttctcacaccaaacatctaatattttggcagctgaacttacttgtaacattatcacaaactgctaaatttctatatgggaaaaaaaaaaagagcttctacagtttaacaagagaaagtcagactcaagacaggatgcggggaggtggggcggagagggctgtgtgacgaatacgtggcgtaagaatacaaacgtattaatcatgtggcaggatactcagattcataagagaaatttgttttgaaataacagtggaaaccacctaccagatgtggcttagactttgaaaagcaaatcagaaaaaaaaaaaatgtcgcccaggatatggagaaatccgttattggttgcctttgatgggaatgtgaagttctggtggacagtggttcctcagagggtttaaaatagaatctccatatgacctactcttccacttcttggtttgtatctaaaagaagtgaaagcagaaaactggggagaaattcgtacacctcatgttcacagcagcagtcttcacggcactaaaaagatgtacataattcaagcagccctctgcagatgggcacagacgctgaacccggtgtgagcatcttcagaagagcagggatcccagcaggtcctacaatgaggatgggcccctaaggcagcgctaagtgaagcaaacccaccacagaaagctaaatactgtaagattccacttccatctaaagaactcaggtccatggagacagaaggtggtttctgagaccggggtggggagtggggggcaggaaggaaaaatgaggaacgatcgctgttgactgagtccagagtttccatcttgcaatgtgagaagacttggggatactgtgatgttgatggttgcacaatgcaaatctttcatgtgctgctgcatgtttggaaatgatcagtctagtaaacattgtatgtattttaccatatttaaaaaaactacgatgagagggttgaggaattcagtcagtggggcacttgcctggctagcgcaaggccctgggctcaattccaagcactgtcaaaaatgtataatgaagcgtcattttaatctttaaatggtacagatcaaaaattcacaaatttgaaaacattccccccccaaaacatgtgaaagtaagtagtctcctgtcggtggaagttttaacgtataattgtggaggaaaatctttctgtatctgtgaaaactaaaattccattactcgtcagctcttggtcaagagattctccttctgagaagtggccagctcctgcaggtatgaggcagaatataatttgggtttttctttacaacagaaaattaggagcaactaatcaggctatttgcatcaagtagattacagcagaatagtatgcaactgctaatatgatagtgctaattattatggatataaaataatccctaagctggtagcatctatgtaaaagtatgtattgaatgcttctatttgtgttttaaaatcaaacgctaatacatgtggatctgagttattactttgttgtattttgtctaaaataagtgaaggcaagaaactgaaataggtaactggtcattccaggcacactttggaagaaagttagatggccagggaccagagtccatagggatcctggctttcaactatttgtcactctgatagctaataatggctgccaacttgaatcaccaatctagaattctgggatgttgtaagtgactgggttatttcaagccatcttcaatgcagcctgcatcattgcgtgggttggggtctcaggctgaataaaaatgggaaggcaagatgagtaccagcatcttcctctgctttctgaactgagggtacaatgaggctgggtgcctcccacccctgcccccaccccatgatgtccctgaaattatgggctgcacccaaacctgtaagccaaaacaagccttccctcccttccttatgttgttttatcagatattttgttgcaacaacagaagaattaactgatacctcaccattactttaaacaatcaaacaatcaaacaaacaaacaaacaaaaaaccaaggtcttactatgtacccttgttggcttaaagctcactagcctggcctaggattcactgagatagatgaacatttacctctgcctcccaagtgctgggattaaaatgcatctgctaccatgtccaagactcagctttactttagcattttcatgttatgttcagatataatctctaaaaattcttaattaaaaaaaattaccgtctcgaaggattaaagcacacacacaaatacacacacacacacacacacacacacacacacacacactgttttagcccactgccctgtgccaagcactataagaaaagaaggaagtatacagacacgacctgaaggatggagaatggctgtagacagtccaccctccaagggagaaatttctgctattgaatgaataatacttgtgtgtcttcccaaagcaccactttccttttatatacaaagctgagtagtaatccacctgctaggtttccccttttatattagccattaaaacgctgcaagccaaatttgagtgtcacctaatactaggtggttcattcctagggtaagcagttagcgtcggccttgtattgggatctgctccaaactttggtaatcgatttgtttccccaccagtctaatgttggtctttatcctgtgcttctagtaagctctaacatctttttggtctatatcgagcggttgagtcgagaagcagagagaaagcgagaggaagaagaaactagacattataaagtcttgcctgacgttttttctttagcatgccttacagatgaagtgagtatgtcaggtagttagacataggcttcatttcaacttatggccagatgctctgtgcacgaggcccaggaaagtgtttggcacgctctcccggtgactttccatgcacgcgaaactttgaaaaccacgggaaaatcaaaggaagttcgattttactcaagggtctcggtattctctcatattccctgcattggttgagacaaaagtaatgccttgctctaccatagaagtcccacagctttgtcatctaacatcaagtacttctggctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatggagctaggtggggagaaatgacttcagtgaatgtgggaacctacacgaattttaaatactctttctagttcatgtttcagtgaacaattgttttcagtctcactttctaactaagttttatcttgtctttttaaactccagcaccatgggcttggcaatccttatctttgtgacagtcttgctgatctcaggtaagaacccttttctgtgtaaagtcctggagtccttctgctgtcattcagtgagtcagagcactgaaagcccaggcctgagagttgttggtatggtttgctcacgtttgacttgagttgccgaagactccatagcaaatagctttcctagagagtacggaaggatcaggaccatggccagctgtctgggcatcttcctcctctacaaccaaacccccaggacctcaacacacagcacaaggtggagtgtcctgtccaggactcttagaggggtaaagagagccatgacagtaaagcctctaacttgactccacacacacacacacacacacacacacacacacacacacacacacacacacatctggtcttttcagtccccattttcagtattctcaagcccttagaaaattgctgacagctttcaaaggcttcttcttgtaatactggctcaccaccacatccttcttccttagcctgtgccctaactcatactggtcatgctttgtgactctggacctccagttaatcatgccagccactgtaccaagctaaagttaactaagctaatgcttcagggctccccctcacacaggctccccctttctaacccctaaggaccccaggaggacctcagcactatatcacatatcttacaacttggtaagatttggataagatagccacaattaattacgattgcctcccccccacccccgacatcactgtctcctgctgggtgacatcttgcatttgaattatgtgttattttttctaaaaagctcactaaagtttagaactgtgaggcctccctgaattcagcccttcctggctctctgctctctgggatgcacccataaacagctggctggaggccttgccatgcatcctgcaactgaatgccattttgtttctgctggcccactctttcctgtactcactttctctacctcagtgctgacagagaagccatctcagtcttggtgatcagcagacaggataggtgagcttccggtgtgcctgcagcagctgcaggccacccctgaccacctggcctctgactaaccagctcagccacaaaatcacctcctctataattgtcacacaacagtcccttggccactgcccctagccctggcagggtaaagaggaggagttgagtattatgaagagatatccctttagacctcagcagatacagtccttttgtgatttgtgctttctgcttagcactcaaggcttgcagaggccaccagatgatgtctacaggtgttcacctagctattcatcaacgtagatgagaatggcagctttcacctgccagggccagtgacccagagtctcagctcctggggagatgtgtacacacacaaatatcagaggtgaggaacataaagatagtttgtatgtgtgtatgcatttgtgtgttctctctctctctctctgtctgtctatgtatctggacgtgactcaatatgtgtgcatgcatgcatgcatgtctctgtgcgtgtctgtgtgtgtgtggtgtttgtgtgtcatgtatatatgtatctgcatgcatgtttgcctgtgtgtgcatgtgtgtgcctttgtgtatacatctgtgtgtgtatgtgtgtggtgtatacatgtgtgcgcatctacacttgtgtgtgtgtacgttgtgtgtacgtgtgtgtgtttagttcaggtacttataaagttctgagcactttataaatagcaattcatttaaaaaccacaataacttgctgcattagatttcatcattattcctcattttaagacaaggtccctaaagtgctgagacagctaagtaattgactaagatcaacacagctcctaaacagagaggccagattcatgcctagcagtgcaggctgaaggtcatggatgcgcgttaccaggctattcctcctagctcttcctcctgaggcaatgacaagtggctctgcttctgaatgactcagctttgcttcagcttggcccctccttgtgtggcctccttccacttcctgcttttatcttaagccacaccccagctgtccttaaaccttaggccttagcactacaggttagaatggcaagtttagcttttatgatctgggagagaaatgtcctggaaacaaataattcagtaacagcttgactgagacacctttcctgtccccaaactttcaggctcagccctttgaaagtgagtagatagagctgagaaacccatcaaaaccaaggacaggtgccacttctcttttgacctgctctgaaaccatgtggaaactcctagctccggaaaagggggtcgatgatattgaaaccataagaaaaaaatatcttgagtgaaaactgagtaggtttcattgtagcaaggggatgtatgggaagaggatatagcttgggacgaacagatataaagatggcaggcaatctgcttcaaccgccagaaaatgaagctgccaatacttcactcatcaataaacgcaatgataaaacagtcagcatctatttctaacctttcatttttttttttactcttaatcatgtataatcattgataaatatgcttctttagcttattttttagtttcaaacatgcatacaaatatatcttggttatatccatcccatttttccccctccaacctctcattcccacacaaaaaaaacccaccccccatctgcctctcaactttgaacacacatacatggaactgctatgtccacaaccctaatcccagaggctcagcaaacattactggagacaagaggggaagaaagaatttaagagccagaggatggggaggagttctgtgaccactggccactgggcaggacatagctgtttcacatgcaaattctcagaagctgtggttatctgcacaagataaccacagggagaaattcttttcttggggtggggacattggtacctatgcctagtagatgacccacacaggtgcgcttatgaacaacactaaatggccttagagtgtattattaaattaaaagccaccttttttttaacatggaaaatatatctaatttgaatctgcctcttcttgagctatggagtagagacctaccccagggcaggcatccaaagagagaaaggagacacagttggcactaataatccacggggggagggggggaattacaaggctgataacttaagataacacataagacatagagcaaaatagttttgccctgccccctacacctcccacatgctttgcctggaaattagataccattgttatgcccctgatcaattgctaccagtgtggctggcaaaggacaaccctgtggggtctgttctcttcttccacctttaagtgggtcctgagggttaaactcggcttatcaggcttgcacaacaaccttctaggccatctcatgggcccttcactctgggaatgctccagactggccttagagtagctatgaccataggtgcatccaccatgcttagtccagttggacatctggcagttgttctcttcttgtctgaatctccaggttttagggttcttatttcgcctgaccaacaccactggtcaacaataaccctggagtgggagagtcttccttcacttaaagacgtacattaaacagcttcagattcttgtgttgtggagaggcggactctcttcccccagattctgtaggttctggcttgggtggtacatgaaaatagcattcatgggtctccttttagctctatctcttgtcattgtctaccaacactaaatcaagtacctggggtaaactaacaattcaaacttaatctactcaaagagccattagttcagctgctgtcttggggccttttcagatttaagaggaaatagagtgtatctcttgctatctacttgaaaacatccaacaagccatcggatatggtgcctgggacttgactaatggctatggactggagatacgcaccttgtagcttatccctgagagttcaatcagtgggcatacagaataaatcccagagtaaacagacacatggaccaggaagtcagactgaggaagttaattccaagtaaactggagtttaaagccatgttacttttggtacaatggccagatggggtgaggtccaaaagagcacagagctttcttgatgaaaactggtaacaccttttgtcagaaaagcttcaggagagacaggagtgagccgtgtagggggagaaagctgtctctgctcactagggaatcgaacagaaaagaaaagcaagggcagaggggacctgttgagacaggatgatgagcctggaggctgtgtttagagaagtagactatcacaaatttcaaatgttacctatctgttcagtgagattatttcctgtaagggtacttacccacccagctgtaagatcagatctgtagattcgaaaaaagtttctttagcataacttctaccagggccaagagatatatttagtggctttttactggtgagaaatggttaaaaagctgtattatggatttattttgtgtgtgtgtgtgtgtgtgtgtgtgtgtgtgctgtccagtataatagccactatccatatgtgactcattaagttttaattaattaagattaaacaagatgaaaaaaaattcaatttccctctccagcactgtaaaaaatgatccagtttcttggtcacagttactacttgttgaggattcacattgtgcaaaaccagagaagaattctctcctctcaaagtattctttcggaggaataatactgtgaaatcaaagactggggtctaagagagctaacatctcaacaaagttgaagaacagctatgaagaaaatgagagtaaacactgggggtcagatctgaggtattaagccctctgggacactgctcaggattgtgccatgggaaatggagggttgctgagcaggtctgtgggtgaaggtctctgtggtagataaagtaaggaactttgacacaaggttgttggcagacttgttattgatgaataaactgttacattatcttggtggttatgttgagtattggttagagagaagagccttgaatataatgccgaaatcctccttgaatgaggacacagtgaccaatagttagtacttcataaccatgagataggagacacctctgagtggagaggtgctcctcaaagcccttgctgaggaagccaggagtgtcttgtgggccacatggagtcctttgggtagaactagattccatggaaaggacatagagggtaatatttattgaagaggatcagctatagtgggatctagtacaatggaacgggactttcagcgggcctagaaaggctttgggcgaagtttacagaaagaacaagaaccttggagtgtaacaagcaaagaaaatgcagaagagatgatgagtttggggtaaccgaccagggaagactgatattctggtgaggtcatagactcacaaagtgggacactccaggggtttctgtctgcagaggtccttcagtattcttgatcactggttcctgagtggggagatatgtggctgaattcttgtgtccttggctcctggctgcatcataacaatcagtcatagctaagtctaaagcatttctttaacccacatgttagaagagggaggatttctcagtgctttccaccaatggaattctagggagttcacttgctttgaggccccaagttctggggaccataacagtggaggcctgaaggcactgggaaagaacagaccttgagtcaaatcttcccgatatggtcacagctaagatatgtctgcttggttcagagtacaatcaagacaatcagggtctgatgacaaaccaagcatgtggaatgtgaaatactttcagttccattcagaatggctacagagtagtttctcgccccgtggggaggagaaggggactggagaggtagaagtgtatgtggctggttatcagctctgatcccctcagcttcccaaatagaagttcatggtaaaatgcaggttctgattcagatcttgtgtggaaccagagagtctgtgtttctgaccagccctcaggtgaggccaaaggctttggtctactttttattggtaggtaaagagggaactgagggaagatgaagtccctgttactttgtgggagagggggactgggtcagagaagttggagagggagtgaatggaaaggagattgggtactctgggtctccacagaagaaaaagagtctgtgtgttgagcggatgtaagaatctcagagtgagttcacttctagacccaggaagtgcaactaaaaactgggcaatataagaacacaccaaccaatagctggccagtgctttgcttcagctgcctgcttggtttctccatcagaaatcatttgcccagaatcacaataagttagagccaaaccagaatatgtcctgccctccgcacagtccaccagtcctcaccaaacttcgaacatttacagtaggtggcactcttgcctctcacttaagagattagcagaggtggaacaaaaagccaaatacaataaatttttcttaggtcaattttttggtattgtgggaactcagtgatctccctcttccctctgatgcagacatgcatgtgtccttcacggatgtctggagtatcctctgagaccccttgattgtaggttctcatggggtgttctgctttgccaagtccatgccatcgtacctgcctatactatttcctgtttaaagggaggctaattggtcaggtcagtttaacttctgactcaccaccactgtgagtgggactcctcatctccctcacccatcactggccctcccttccctcccttcctgaagtcccgaaggacgagctgtttttatgaagactctcctccattcttctccccattgcagcctccagcttcatatgagcctttaaaaggcacacccacctcacctttcacctttcacctttcacctctcgcctctcatctccctctatttattttctttgctgagtctccagcaattctgtggcctagaaaaagtcccataagctggcttatgccagtgcgtcctctctctgaacttttccatcattgctccctttgggttctaaaagtttccagggcactgcagcccaggagtagccattggtttcttcagggtttctgcagtatgacaaggctcatcctcaccttcccacatacagttctctcccagcagcttgctcatcttccttaaatatcctgacctctatcatctcccaagagccattacatttgcccagcttcctttctggtccctgaaagattctagagaggtcactgagaatagagacattgcttgacacttgagtcacttcaaaccccctttttctctggctctgggagtggaggctgtgggggcaggaactagttgaatgtcaaagaagtgactcagtagggctcccaaataatggagactaataaaaggtggtagcaagtgaggaaccatccatcatcaacaatctttaaaaaaacaaaaaacaaaaaacaaaaaaacccaaaaaaaccaaaaacatagcagaccaaagtataaagggattgcatggggcaggcagggtttaggcagatggcatagcagttgtggaggcctgtagcaattatgatgatggtagtcaatgctctggttttgaaattcgcagaagcacagagagaatcctagaacattactacagaccacttccttaatctggtgagaaaacagattcacaaagtttgcagcctgcacatgtgaaccaagtggagcaaaacgaaagcctgagcttcagacgtccagcatggatgcctggttccagatcctagcacccacctctccagtactatcactgcctgacaagctggaagctgggtgctgtttcagagcaagggatcttcctcttcttgtctcctctttcctaattctcagtttttctattttagatgctgtttccgtggagacgcaagcttatttcaatgggactgcatatctgccgtgcccatttacaaaggctcaaaacataagcctgagtgagctggtagtattttggcaggaccagcaaaagttggttctgtacgagcactatttgggcacagagaaacttgatagtgtgaatgccaagtacctgggccgcacgagctttgacaggaacaactggactctacgacttcacaatgttcagatcaaggacatgggctcgtatgattgttttatacaaaaaaagccacccacaggatcaattatcctccaacagacattaacagaactgtcagtgatcggtatgtggtcagtgctgtgtttagattgtcggctgctcagatgagaccatgactgagcaaagaaacattgagggtggatatttgaacagactggaaatgaaggcagaagagagtcacttctagaaagtccatttggagggaatgtggggtctgagagtggggagctgaaagccctttgtactttgacagcttgtttcttggagatcagtgagaattttttgagataagatagggctaggtgaacaaagcaacacagacagattataacaatggacaatgtagccactccttctattttctccttttagtctaagatttttttccacccgtagtaatctgggtctcttgctttatctcttagggttctgtcattctgagaatagcgtataaatggagctgaactttaatctttaagatgaacttcttttattcagcaaaatgccttttgtgtttcatataagttgagtgtatcaaaaatttggaagttttattttttttaattgatgaattccattatactgtcaatcactgaaagatactgggttgtttccagtttgaagctgtgacaaactgagctgctatgcaagtgtcagcctctgtgtggatgtatttgtatttctctagtgtagattcattctgaggcataatgttgctggactcgaatgaattcttcacgaacttggaaaaggcagactgacaccttttgagaaataatcctcctagaatgaaccatttctaaatccacaggataaaccacaggataaaacaggcaaacccagacacagcatggagggttgctctccttgagcgtgacttgattcagtcgtggctacagggcttccatttaacaaggtgctaagtttgggttctcagggtgtggcaggcccctttggagaaacagtgtgttttaggagggggcacagaccagcctttaaaacaggttgtctattcattataatgtgtatcagtactacaacttaactcatgactgcaaaagagattgttgatgaagctgaatggactctagcaattcttaccaaacatcagcagaatgttcagggagcacaatgagattgcaaaaactcaaaagaggatggcatgcaaatgacttccattgttacattgttacatgttacattgttacatggtacaatcattttgcttatgagttccgcctttagtggctgagccatctctccagtttcgtactcaattatcaactaatatgtagaatccacacgtgtcaggtccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttttgaatttgcctccatatgaatcatttttttcagcagagtggtctgcaaccttcctaatgctgtgaccctttaatatacttccttatgttgtggtgacccccaaccatacaattatttagtttctacttcataatggtaattttgctactgttatgaatcataatgtaaacatctgatatgcagaatatctaatacatgaacaccccccacccccgcaaaggggtcacaacccatgggttgagaattaccactgttacagcacataaagttagactatgatagtcatgtcaaaaaccaacaatctaagtttgtaagcagaaagacctcccttattactcttacttgtaggttcttaaagatgagacccagagcatgcaaggaccataaaccctgtgagttcttgatggaaatttacctcatccctgagtgggaaggtgagatgtttccctgtgggaatggaggccagatagttagagttgagaccccagttcttagagtagtggcttcactatagaccttggtaagataattttaggtagcctatgtctcagagagcattctctagaggaacaagtagatgtcttgaaagataactgtacgtttattatgcagccctcactatgggctgaggcccacatggaatataccttgagatggtcaggtctattctgatcagaaaactggctgtcagtcacttgtcattcctttgtatcgacatctacatttaggttgactgattccatctttattctgcttccagccaacttcagtgaacctgaaataaaactggctcagaatgtaacaggaaattctggcataaatttgacctgcacgtctaagcaaggtcacccgaaacctaagaagatgtattttctgataactaattcaactaatgagtatggtgataacatgcagatatcacaagataatgtcacagaactgttcagtatctccaacagcctctctctttcattcccggatggtgtgtggcatatgaccgttgtgtgtgttctggaaacggagtcaatgaagatttcctccaaacctctcaatttcagtaagtctgcttcctaagtatttatttcacaaggtgctataagcaaatcttttatccaaattatccaatgtttactgattgctgaaaaaccttctagcagaccactaggaaggagccaaatagaaggctatttttacattttcatgactcaagatccaagctatacttgaagaaacatggtcttagccctgaaactgacccagtctttggaattatccttggatggaggacaatgagatgctgtggatacaaaatagaggatatttcctagcaagaagctttcaactgactaaaacacacacacacacatacacacaaatatatatatatgacaatcatatatacctgcctctcaatggtacttattatgcatatagactcattgtagtcattgttggctgtaaagctgaaaactcagaagatatcttctagttcttgagactctcccaggaaaataagaaatccacgatgtacatatatgacaaccaagttttttttaaaagatgaaattcaagtctaaattatagctcatggaaacaactgcctaaatttaaaacaagctgatcatcagttctatgagcattcagaggcaggcaagatctttgaaagtcatgtaagtcttcctaaaggcactggggccttatcctactgtaaaacagttactgatactgataacagactattggacttagtaaacatgacaaaaatagaagggagggcgatatagagttctctatgaaagaccctcacatttgcagtgactttctgcatgctcagccagtgagagaaccacagcaaattagctgtacccaaaaggagcaggaaatatgttcaagaaaagactgagtgaaggcatgcttgcagcatcttcttgatgtgcttccacagtgatgaaagaagaggttgaaactcagtgtcagctttgccccatagagagctagcctaacctgtaccccacttgtgacaagccaccattcttcctagaatgaaggcactcggttcccacttgatgctcatcattcattggtgtttattctaaggttcatccccttccacaccccacccccaaacccacagccacctgccttctgcttctacggtcccttttccagccctctaactattatttgctccttctgatggcacccatccatctctttcttcctcccctggctttgcctcgtccttaatcctggtggctccctcaggaacttggcctatgggcatactctgagaaacatccccatggctagcacctacaccctacaactgagcctaccccctctcccagtactgatttccttttgctcagatatcgcagccactcagaatctagtaaaagatgtggtcattcagctgtcctggttgctcccactgaaacattttctagaaatatagaagatactctaagccatacctgaagcttatcgccttcaggtaaccaccagcatcaggcttccccacccttgtctacaagtgagcaggcactggtaagctcatcgtgactcacctctactagttaactatcttagaacttgcccaggtactaccatccgaaatgcttcagccctgggtacctcatccaaagaacttgcatatctgtgtccctaaatccttgccctgaccagagataggttagctattatcttagttatggttttattgttgtgaagaaacaccatgactacagcaattcttataaagggaaacatttaattggggttggtttatagtttcagaggtttagtccattatcatcatggcaagaaatacagtggtatgcaggcagacatggtgctaaaaaaggagctgagagttctacgtcttgatccacaggcatcaaagatcatagcttcagcataggagccttcaaagtctgcctccccactgacatactttcttcaacaaggtgacacttacttcaacaaggctactcttttctaatagtgccactctttatggccaagcattcaaacacataaatctatggtgaccattactattcaaaccaccgcagttactgaatctttttgtgtatcaaaaggcagaagtctccatataagagccataacctcctttattggaaatcccaaatagattcaagtgagacaaacagggacacactcaaaaggtattaaatatggtccacaatgccaataattattttccttactattctaggaagagagcacatgcctaaaaattgtatctaaactatggtatattttgatcctaattttcctataatttaggattaaacagaagggttgttctttaaatgtctattaactgaactacttagttttccattaatttccactactgcagtttaggctttcctattctaggaagtagttgctggccttcagggatctgattctctagggaatgaagaaatagcaaaggtttcctaacagagaaagcatactgaaagtcaggatgaggaagcctggggttagctcagtaaaattaataatcaaatactttgaagtatttgttctgtttgctcaaatgagaggtgatctagagagtaacttcaagatgatggtggatggaggaaccattacaaaagctcctctaagttcctcttgttgatttcagtttcctatggctctaggacccagggggagatctcacacacacacacacacacacacacacacacacacacacacacagagagagacagagagagagagagagacagagacagagacagagacagagacagagacagagagagagagagagagagagagagagagaaacagacagacaaagagagacacagagagagagaaggagggaaggaaggaagaagaatagaagaggggagggatgatgaaggcagggaaggaaggaagggaaggagggagggaaggatggaaagagggaaggaaggaaggcaagttgtaaatttgannnnnnnnnnnnnnnnnnnnnnnnnnnnnnnnnncagcttcagttactgtggccctcctccttgtgatgctgctcatcattgtatgtcacaagaagccgaatcagcctagcaggtgatgagtgtctttgttctgtctaaagatcaccatgtaaaatgtgttttaatgagcatatgagatgaggaggaggaggtagctccgtgttacggtgttagtgttaaggtgttccttagcaatttggtctccaacactgaagaaagtgtttttacatgagaatatgaaacaatgggctttgttgtgacactcacacaagcaaatgctgtacttagctcctcattgtcatctcctgtccctgcccaacacacacatacacacacacacacacacacacacacacacacacacacacataccagttaccctcttcttgataattctcaggagatagatggttgttccatcctcaggctcttacattctttctgccccatcttctgtgaaggtccctgagccttggggtagggatgtgctggtagatatagatgtctcattgatggctaaacaaagtcacttattttcagcactttgaacaacaatgtgtctctgcactaatcactacccacaccaataacaaacctctctggccaacgttgggggcaatataagtctacagatataaatataaatatttagaaggcaatttgataacataaccatttcatagaacaagatcagtagattccctcctagagtctgtgacttcctccatccacttcactgtactaggcatgaatttatccccacaaaacagacctcaaatcccaccaatagagcagttggaaatgtccataaggttacagttgtgcagtgggcatatttggtctagaaagcagatgtggtagcatgcagagaccagtgcttgctaagaccattgatggcttttctctctgagcagcctttcaaacaccttctagcactatgaaagctatctggcagggagagagtttcctgggcagttcaaaattgatttcttcatgacttgaaaccacagtatgttgtgtcttcagcaatagaatctgactatccagttcagatgagcattgttttggatgttcctaggtctctctgacaaattttatttcattcagtttttgctttttttttttctcctaaagtttgttcacatcctctatgacttgtttgaacataatcaatggaattctttgtgtggttcttcaggctgctttcattagaggcatatctattagggggttggggatttgggaataaggtatgttgtcttgggtttggtgtgtgtgtgtgtgtgtgtgtgtgtgtgtgtgtgtgtgtgtgtgtgctgctttcctttttttctgcactgggtgggtcttacatatgcaaagtgacctgctgattgacatgcctgcctcctttcttttatttctttgtcattgttattgttgttgttgttgttgttccggtcacctctttcaatggaggtgtttacaatgttcaggggaagccatgtttccctattcagttcaggtgttcctggatgaaaaaacccaaaaccgggtctttgtgtatcttctatggaactgtcctgtccagttttttccatgcagaagactgtctctccaccctgctggcttcactgttcagcatccctttagctgtgtgcagttgcatttgtcacgtcatgctgttatttcctgagttacaggagttctttctggccctaacttgcctggccctatcttgagtgtttatcctatgcgttcccctaaagtgtccaagaaggcagtttattttcattaagatcttcacccattttaaatagagttttctttacaaggtgcaaagtagagatctagttgtggtcaatacatggatatttaattctctgggcatcatttattctcttcttctctaatatatgttcttggcacatttgttaaaaaaattagcctatagttgcacgggctaatttctgaatctttcattctatcccattgtcctgcctgtctagttttgtgccagtatcatgctagttctgtagctgtgcctatacaatatgatttgagatcagatattgtgatatatttcaattatgtgggttttttctatatcaattttatgaatttcttcctatttatatgataatattgtcaatttattgagatggaatggaatctgtacagtgcttttggtaatatatccattttccaccattttccagcctgcctgtgagcatgggagagtttctccctctagtacctccctttcagttcttttttctcttcagtgctttagtgctctcatttttgaggtccttcaccttctgagttaggcatccaccctaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttacctccttgtctagtctagtggctttccatgggacttttaaaattcaattcattgggttttcatttccagcatttctgtttcttttctttcccaaaatgtgtttgcttgttgggtttttctatgtatgctgttgacttccacattcgtgtcctgaattaatttccttaaataattgggttacttgtttaatgccttcttagaggtcattaatcatttttttttttttttgctagcaggttttttgattatttgccccaaatatctttgtgttcagaagttaaggaattacgatcttttagaggtaccatgctgctaccttgttttaatgtatttcctttgcctctgggtgtggtgtaatatccattgggatggatgtcacttctgcttggcaggcagctttcccctgatggctcagactccaacagcacttaaagtattagccatacaagtagaagcgatttctagatgtgaatgagtagctcgccaagtttcctttctcagtggaatgaacagtttgcaacgagaacaaaggagagatggaataaaggaggaaaaaaaaaactttctttctccataaggcaaccagaaatattcgaaactacataagaaagtcaaggatgatatgtgtacatgcaagaaagaagttggagggggatgcacagaagctaaatatgtgtaagatagtcacattaaactatgttatcagaaggcagagaacaggagagcatagcacatagatggtccccaaaagaatggggtacaattattgatagcaaaaagttatgcggtcagacacttagacatgacagtgagtttggtcaaagaaaggaaccttgacagatccaagaaggagacataccatgaataatcaagccatgtagatataccatgctcatgcatttgagttctataataactttctttgctttgtagattcttcttctgatctccactgcaataagtaaattacttctttttccaagttcaaagccaacaatgatggctgagcttctatttcaaagcttctatttcttatacctaaaactatcatgttaccttttaaatatggatttgtttttattctacatgtgtgtgcattttgcactcatgtatatgtgtactgcatatatatcctggtacccttaaaggccataagaggatgacagaaccactggaactagaattataggtaaccatcagctcttatgtgggggctcagaactgaaccacggtcctctgcaaaagcaccaagtgttcttaaccactaagccacccctccagaccctctggatgttatcttataaggcacaaatttatatgagccgcagaaacatacccaggtaggttagaaagctatgctaaaagaaaggagaggcatatgagatctggagaaagctcagccatcattgttggctttgaacttggaaaaagaaggacataaacaaggaattcgaatcacttcgagaggctagaaatggttctcacttgatagccaagaaacgagcagtccattcagctctacaacctccaagaactgaattctgccaacaggccaatcaggagtgagcatgacctacccacaaagacctaagctcattgacaaccagtaggaatacattcccgaatggaacttcctccaaaaatgacattaaatccacttctcagaagagaaccttcaaaacaactaacctggcattaaaagtcctgtccagggttcatttgtttattctgccttggctgtgtacatttatcctatttaaatactaaaaaggcaataccaagtccatttctaggtaatttctttttttttttttcattttttattaggtatttagctcatttacatttccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcgttccccctgtactgggggcatataaagtttgcaagtccaatgggcctctctttccccagtgatggccgactaggcccatctttttgatacatatacagctaagagtcaagagctcccggggtactggttagttcataatgttgttccacctataagggttgcagatccctttagctccttggctactttcttctagctcctccattgggagccctgtgatccatcccattagctgactgtgagcatccacttctgtgtttgctaggccccggcatagtcttacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaattctaaggaggggtatagtgtccacacttcagtcttcattcttcttgagtttcatgtgtttagcaaattgtatcttatatcttgggtatctctaggtaatttcttaccccagacctggattgataagaaagaaaaaggaggagatgtgtaactatgaattattgccttcgtctaatctgaagttatcctatcagtttgcccatttgggaattggcttgactaaaaaatgtatatactagtgtgtatgaagctaatagtttttacagtttgcttccatacagcaaagttagaagagcctcggctcttgtagttactttttatgttttggagacaaagtctcaccacatagctctagctagctatcgcagactttactatgtaggccaggctgtgcttgggctcacaatcacgtacatcactcattcccagctgtttcatctgcatctcttgcctctgcttcttgagtgctaaggctgaaggtttatgctaccatatcaggctagttaaaatttcttaaagaacaagtgtcctttccaaagtgactcatcttcatcatcatttaaacagaaatctccacagagtttaaaaactgaaagttggggatctcatcgcatttctatttcaaaatactgaagttaacgtccattccaaaagtgtgtgtcacacttttgtgtcttttgtctgctttcatttttaaactgaggcttcttgtaatgatgctgcctttgccatgggtatgaaaagatcatttgattattttctgttctatatttatctgggacaccatacctagctataaagcgccatacttttaaagaggaatctaggcaattgtaaaaatctaatcagatttataaagaatccaggagctcaaataagaaacagctcaaatgcctcagttcctttgtatgactaaaacaagatatcaaagactggataccttaagggaaagtttatcatggtttatggtttggggcagaacaggatcaggcagctatgttgtgctgcattgtgacatacagatggtagagcaagaacagtgtatgtgagtgtgtgtgtgtgtgtgtgtgtgtgtgtgtgtgtgtgtgtgtgtgtgtgtgtaagagataccaaggtgaggaggggggcattataacaacctgcttctacagttccaatacctgagacctaactcatggtgcacattaattctcccaagtgtggccccatggccaaatcccctccaatcagttcccacctttcaaggttatggaacttgttcttgcccccacaatgtgcttcaaagtacatgaagcctctaaagttagaaaacagggcatcaaataaccaaagaatgctcaacccgagaaaaggcctaaggaagagagagtctgctctcaaatatcagaaggagtagctgtctccaattgcaaaggtcatactcaaaactgtactccaaaatgcatctcagaaggagagactatattctatgaggacagcagagcaacctgcctaactactaatgctctcttgaaattgtactctataaaccaacaataaataaacacttaggaaatgaggttttgtttgtttttcaagaaaggctgtcctgaactcacagaggtctgcctgccactgcttcccaagtgctgagactacaggctttccctgccaccaccactaccaggccacaggaaatgtttaaatccagtttctaggatcatcaaatactaataaagttttggctatacatttaacaagacaaatgcaaacattacggtggacagaaatggaagtagacctaattagatggaagcatatactgggttcatggattaggagacaaaatattattaagatcacattttttttccaaattcatgaatggattgaagtaatctaaatccaaagcctggaaggtttattagtaaaaattaaaaggccaaatgtataaagatagagaggagtgcaaataacccacagctggtaaaatgattttgaaaattaagagcaaaattgg

SEQ ID NO: 1076 - DNA, 690 bp, Mus musculus
actccagcaccatgggcttggcaatccttatctttgtgacagtcttgctgatctcagatgctgtttccgtggagacgcaagcttatttcaatgggactgcatatctgccgtgcccatttacaaaggctcaaaacataagcctgagtgagctggtagtattttggcaggaccagcaaaagttggttctgtacgagcactatttgggcacagagaaacttgatagtgtgaatgccaagtacctgggccgcacgagctttgacaggaacaactggactctacgacttcacaatgttcagatcaaggacatgggctcgtatgattgttttatacaaaaaaagccacccacaggatcaattatcctccaacagacattaacagaactgtcagtgatcgccaacttcagtgaacctgaaataaaactggctcagaatgtaacaggaaattctggcataaatttgacctgcacgtctaagcaaggtcacccgaaacctaagaagatgtattttctgataactaattcaactaatgagtatggtgataacatgcagatatcacaagataatgtcacagaactgttcagtatctccaacagcctctctctttcattcccggatggtgtgtggcatatgaccgttgtgtgtgttctggaaacggagtcaatgaagatttcctccaaacctctcaatttca

SEQ ID NO: 1077 - protein, 230 aa, Mus musculus
  VARIANT (1)...(230): Xaa = Any Amino Acid
SSTMGLAILIFVTVLLISDAVSVETQAYFNGTAYLPCPFTKAQNISLSELVVFWQDQQKLVLYEHYLGTEKLDSVNAKYLGRTSFDRNNWTLRLHNVQIKDMGSYDCFIQKKPPTGSIILQQTLTELSVIANFSEPEIKLAQNVTGNSGINLTCTSKQGHPKPKKMYFLITNSTNEYGDNMQISQDNVTELFSISNSLSLSFPDGVWHMTVVCVLETESMKISSKPLNFX

SEQ ID NO: 1078 - DNA, 62118 bp, Homo sapiens
  misc_feature (1)...(62118): n = A,T,C or G
acacagaaaatctcttttaaaaataatctcttttgtttgtatgcaaataggccatccacagtgaaaatgcaactcaaatgcaatattttatctgcagtccaccaaatgcaaagatcaaattggtttacaaatgctgtccttcttaaaaattccaactcctcacattaaaactgtagccagctagtgcaagttaagattgtttgcaatcttaaataagatttgagtaaagctgaaattgagacacttttcaaaagaggccatcccttactcacattgctgaagagtagaaagattgacaccttcttttatcagaaaatttctttcagggagtaatgcctcttgtgtggtggcagacccttcaagtcttccagataaagcatgtgatggaagtagcagggagctgcaaaaattgcaactctatgattctgcatcaccgacttgaaaactacaagcccaggttgacaaatgtacattttaagtgttcagagaagtcttaagtgccttgctttggtcacaaagttgccacagggaagtaagtttttgaatgtgcagtgccccgtccccagctctgttgtgaaatggaaactttaaaaaaaaaatcactgatttaaaaaaccactggttttgttttttaacaagtttagtcatattgcctgtgttctatataccccaatctattttattttactttgtagtgtacatttaatttatactcaaataaatattttacataaggtgctttcacggaccttcatgcttccctaaatattaaatatgctgcccatttgttaaaatgtgttagttttgttatgtattatatcccttcccctgcacacatagaaaaaaaaaatatgaacttaaccttcaagcaagttttacgtttagaatattacctcattttatttcttctaactgaggttataaagaaaatggcaaatgtcatgtgctttgtaaagaaatgacagtttctcagaatacgtaaatgcacacccttagacaaataggccacttaaattcagaatcacagtcttttgaatattggtttaatattctcagataaagattgaaaggataacaagttttggaatcaggtgtttactttgagttctgaaaggtgacatcacaggtgttggtagtttattgatatttaatttttaaatgtgctgctgtatatatttcatttgattagaaatatgttacatagttatgttatttgttaaataatagaccatcttttgtataacctatcagaagaagttctgagattgtaagattagattgtaaatcctattgcataactagaatacagaattattaaattggaaaggaagttaaatcacttagaccgtccttcccccaggaagtcctctctacagtgttatccatgacaaatgtttatgcaggcaccctaaccatttaaaatacgaagagaaggagaagagatatatcgagaaaactattcctgagacaagagaccaggggaaaacttttcttagttgtaacctacacaactagctagaatctacctcatgctcttaagatggtgtttaatcatgaggatatcatacataactgaaattgtataatgttgaacatcttttggtggcaagtaccttgactttattaaatcagtgtaggtctcctgcattcaactatggtctctaggagggcagggaccacacttcttagctcaccttggatctcaagaccagtccaaggccttcattcagtcagagctagttaagcatttgttaattgaatgaaggaaattaaaaaaaaaaaaactagaaattccaaattgtgcaattacatctgtgaattttaaggtgttattggaaaatgggaaaaattactgagattcgaagatggataggaacaaaggtaaagcatgaaaatgtgcatatttgtgtgttgctagagtcaatagtgattgccagttcctatgcagccctggcaccacctctgaaaccttggccaacccctgccattaggtgttgagatacacgacaggcaggtgaggaaggaggggtgctctggatgtagtcttgccgctagactgtggtctttagtgtccatgtccatggggtgagttgtgagcccatcagtttcccacactacagtccttctctggcttagccttccttccctgtcctgtggtccaggttacccctggcccctgtggccttcctccagagatggaccttcctccacacacttctcaggagctcctgattctaggcatgccccagaacacctcaactccactctgccctgtctccatcagaccagagacctcacttagaccctgggtatggggttgttggttctccacttgctgcggttgtcactagcctgagctctatcctgagctctgtccatccttctcatcttcctcattgccctttctgctaaagcaactgcacatctgaaggctatacttatccctagtacaatggtactttttctaaaatgcatacaccctaatgcttacccttttgacaattttttcctgaacctaccttttaatataagcaaattcagtcttcaattcaaataagtgtattttgctgctgaagccaccatgtgattttgagagatagtgaagacagacagtcttctgcattcacttgtagaatcctgaaaatacctcttggtgtcccttgcctttctgacttcttgcttgaagacatctagacaaaaatgtgtccctgggtcctagtttctgggttcagaaattgatcgaatgcaagaaaacaatacacattgcctcttccttagcatgcatgaatggtaggtgtgaatttgcatcatgagaaagtaaataaaagaagattccccagggcagctagggaggcagaaaaagccagcctaggatgggagtggaggacatgttagaggttatgagagtgagggtccatcctaccccacctcggtaactcactggtatggtataaatgcaaaattttggctcacacaaagaaaaatactcaacttctaatgcttaactatgtaaaatttgcttttaaagtacaagttaaaattgtatcgcccctcaaagaaacaagaaactcattacatttctaagaatgttccttcagaaacatggaactgaaagctatttttaaaaattgatctggcccttagaaaactggggccttttctttaatttacctaaggaattgacataaaagtctagggttctgcaccagaaaaatgcagaaagtgtcaaaataaaaggcagaaatacaaaaggagactttttgcagcaacgttctatgtatagcattgattccaagggtgcaacatagggaagtgaacatgtggactgtgaaattgatgctaattttctttcccactagtctagcagccctctaaaatgtcacattattaatttagttactttaccagaaatccgtgtatgtggttagcatgtgtgtttttttttaattaacagactttacttatttttagaacagttttagattttcaaaaaattgagcacatagtacgagaattcccatctactccctttgtggaacacaatttcccctatttttaccatcttgcattagtgtgatgtatttcttacgatcaagccattgttgcttcattattattattatttaaagcccataatttacattaagtttctctctttgggttgtacagttctatggattttgacaaatacacaatgtcatgtatccaccattatagtatcatacagaatagcttcactgccctaagaatcccctgtgctctgcctgttgacccttcccacccctccccaacccctggaaaccactgatctttttactgtctccacagttttgccttttccagaatgttctatctttggaatcatacagtatgtacccttttcagattgacttctttcattaagcaatatgaatttaagttttctccatgtcttttcacatcttgatggctcatttctatttattaccacataatattccattgtctggatataccacagctttaccaactgaggggcatcttagttgctaattatgaataaagtggctatacatattcacgtgtaggttttgtgtggacataagtcttcaattcaattgagtaaatatacctagaagtgtgactgctggatcatatggtaagagtatatttacttttttaagaaactgctaaactatctcccaaagtagttttaccattttgcattcttttctttattttttttttattatactttaagttttagggtatgtgtgcacaatgtgcaggttagttacatatgtatacatgtgccatgttggtgtgctgcacccattaactcatcatttagcattaggaggtaaatctcctattgctatccctcccccctccccccaccccacaacagtccccagagtgtgatgttccccttcctgtgtccatgtgttctcattgttcaactcctatctatgagtgagaacatgcggtgtttggttttttgtccttgcggtagtttactgagaatgatgatttccaatttcatccatgtccctacaaaggacatgaactcatcattttttatggctgcatagtattccatggtgtatatgtgccatattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttgtctgatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcagcatttggtattgtcagatttttggattttagccattctactagatgtgtagtggtatcttactgttttaatttgcaattctctaatgaggtatgatgctgaccaccttttcatatgcttatttgctgtccgtgtaccttctttggtgaggtatatgttcagatcttttgctccttattaaattgggctgtttgttcttttatctttgagttataagagttcattgtgtattttggataccagccctttatcagatatatcttttgcaaatattttttccccaatctttggcgtgtctttttattcatataatggttgatacatgtttctgctttaaggaggaagggttttaaaaatacaatttacagtagcagtaaaaataaaaatttattgcaaatgtcttatgttcactctcaggtgatgtcagggaactatggacccagcagggtttaattaaaggggagtgtcaagtcctgggggctgtggttgacaatcctcctttattggcaattgtgcagcagggctgggagtaagaagacaacccagtcctgagctgcatcacttctaaattaagaataattcaggaactgtgtttacggtgaaatcctggcccttctcacatagattatattatgcataggatatgaatttctgtccatgaatccaagtatatatgaaatcatcactttgaaaatttcctttaactcaacttaatcccactggtgagcctcaatcctgccagttgaaaaagagactgtaactgggtcatgcaggagtctccttcctttcctgcagcccagtcagaattcaagaagttcacctggtaactggaaaatgatggaagggcctcaagtccctagtctgtcctggttgccattggcacccttactatctgagcccatagtggtctgtgaagtccggcagctccctgcccccatgccacagtggggaatgagaatatctactgatgctgggccccatgagcaaagcatgctgcctttctaggcatgagccatcacacctgaggttgctaccccctcgggagcactgatggaggggcagttgggtttctactgctcacaggacccagacaaccatcccctgccctcccttcttcttgcacttcaaaagcactctcttcctctcttttcacctctaagccaccggtatcatctcttccatgggctttcacaaaagtctggatgaacctttgaacttgtatctcttctgctttcccccttgcatcaagaaagcttagaaaacaaacactaattaacgtttcaataaataatgctgctctaattatttgtggaaactattctgtattagaactaccatcagcaccgcctcctagagtgcttttagacttgaccactggccgcaggaggccacttccatataacaacaaacagatggctgaaattggaaaactcagctaaatgttcagatgtttctagactcccacgggtttctggctctggcacatggagtagatcctgactgtgtggtcctcaggggactctctctggtgaagtttggtgaggtcaacttccacacccacacacaccagctactgtgtgtagcctgtcctcctctggttgcttctacttgcagccttggcctcttcagtcctgagagcgttggagaatgaggcagtggaggaagcagccccacacagaaagcagtttctgaagtaacctcagcaacttcctcctcaccaaacacaaggaactgatcttctccactgggctcggcctctggtcagccaaggacaacactgttgaccaccatcacggttggccccactccacccttggctctgatgacatatgtgggagtcagaggaattttgattggctgactgctggcctgtcacacaaacaagatggggcaagggggttgcgatatgacttgacatgtgaaaaaaaaaaaagccgtggtcagcaaccccctgcaactgttgaaaggctaattcaatctctgactctttaacaaaagtgatcttgttcactgcctgttctgccctgagagccttctctgctaggaggtaggttgactgactcagggagaagggtgctggtggcagagctgccaatgggtgagggtcctagagactatcgacatgaggggcagttgagaacactgtagtatttagctgagaggagagactattaataaaatttacaaaatcagctttcagctatttggaagggtttatataaaaggataaaataatatgttctggtagttctagaaaacaggacagagacaagtagctggtacttatggattggaggagtgagtggcagtagtttggggattatttataaaaaagacatttttctgttaactctcttttctaatagtgaatttcccaacctgacaagtaagaaagcacaggctagacacgcatctgtcatgacactgaaggggtccttgcttgagtgagagactggaatgatgagttttgaggtcccttacagtccagcaactctagctaagttggagaataagagaattccatgacaccatatcaccccctcatttctgctgcctgcctcaccattcatctctctttactccttttaatatcattctacgttacagcattggaggaggctgctctaaataggaactgaaataagtagattaaagaagtgctatggaagggaaaacaataaaacaacttgttttttaagagcctactattgccaggatctgtgctaagcaccatatatatgccatgttatttaaccgtcatgacatgcctatgagatatttagtattacttctgtgaggaagccaaagctcagagaggttaaataactgccccaagaacacacaggcattaagtagtggagcagggtttgaacacaggtctctatgactccaaagtgcagtgtgatatgttatttttactgatctgtttatggaaaatgatactgctttctaatttagtattaacacaaagatttttttctaaatagatttacttaaagtatgttataaaaatactatataaataatgaaacagattttacatgagtatgaagtggtactagtagctagaatgatgaaagtttggggaatactactccaaatattttgatagctagcctttcaatttagcctgtcttatatttggactgctgagtacaaggaaaagaaggaaacatgaaaattaagtgaaatatgagttacttcccctgtgctctgataggtgggtaattgatcatatgtcacaataagaaaatcaaatgaaccctttcaaacaacagcaaaatctgtgattgtaaaatccagaggaaaaccccaggtgggatctatctgtatgaaggatgaaatttccaaggtctgaacatagaatggctgagaggaagtgatgaccctgtgagtcaagaccctggaccctgggggagccctgtgggtttgagaagccctgggtgaaaggtgaagggttttacaggcctgtttacagacctctgtagtgacagaagggagatctttgtgcaaaggtcaaagtaagaattgggaaagtctgaaaagaaaacaggaaagtaataatgaagatgaaataactacttggcatactctgccacatgatttacaggcaaggtttcctttgtttttcacaacaatgcagcaaagaagtgattatgagtcacatttcataagtgagaagactgacattcaaacatgttcaataactggcccagggtccagtggtcaagccaggactggacttcggaccaccagttccaaacccacaccccttcccttgcaccacacgcttttgtgtggatgagcctccccaaccctgtcaacaacaaactgtcactttgtcacttttaatgtctcctgcttcacaggacacagctagcctccaagagatcagggaggcatgcccagagggtgctgcttctctcttttgaagctcaagtgccacagacctcagaggcacataaatgtcccccacactgagcagaggactttgcagtgcctgatcagggcagaaaaaggaggcatgcacctgggggaggatcacatacgagtgaaacctgtccccgctgaagcactaggtttggagaaatctactgggcatttacacacctttcccacttctgcttatgacttgtagccaaactcaagagtaccacccacttccaggaatagtgtaccaaggtaacagaaacattctagattcatacaattggggttagattaggatcatctgaaaatgaaggttgtgtatgtcaattgccttctaacaggatgggtggagagatgtacttaatgaatgattttggggaagggctagaagtgaagcacatggcctctctgccctcactcattgaaggctgtcttctgaagccccgtggagctcagtgcctgtcacatggttgcccacatttgttgaactgaactgcattttcatctatgggcttcaaaggctgtgtgtactctgggatctctgggaatctgtcagggaaggtgtctttgtcatgtttgtggatggggctccctttgggggtttcccagggctttacactcatgctccgagggtacgtttgtagtcattctcatcagtggaaatgcccacctgccggcagaagttatttggaaccaagcaagagcactgtccctggctgtggtgttgtttctctagtcagttcccctttctgtatttgagttctaccgtcagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacaggtatgtttgtggaggctcagacgcctagggagtggcatgagataaagctgcaagctgcatctggggcagaaatgctgatgtgctaatggccggccagagaatgagtaaaagggattgcagagagcatgcttaaaacctctgaccatcaggtttgcttctcagattgactacattggaggtgggatattacaaaaatctgtctcttcctgccagatcccttcatctgtttttcgtgagctaagagacaaaataggcaggaaatagaaggtgccacttaccaaataattggcagctgttcttggctttggggtgctggggtctccgagcagcctctgctctagaagaagcagtccaaagatgtcagctcgcctcgcctgagtcccctgtgccagtgggaaatccagagaagggggatttcctcctcttgcagcctctctgcaatggacttacttggctttcctgtttgacctttcccttctctggtccagagacccttccccaatatttcttcccatccaagtgccccatcccaatattagccccacttggcaccagagaccaagatctaatttaaaaagaaatattcttgggtcaaaaaagagcccaagcaagtgattgaacataatgtgtttcacatacggtgaacctatttgcatttgcatttgcaaacgggcttaaaatatcatctctattaatagcaatttaaggttctggagagccaggtgaaaatagtttttgacaaagggaacttcctactccccttaaactgtaataatgaaggaaatgaactgtttatcttacatgtaacctcaatcttgggactaaggccctgtactaaaatgcgtctatttatgtgctcagacttgcagttcgtgttatgtctgctgctgcagataccgttaatattatttatgtgagctatcctgtgtataatggaagcttttataaatctctatttatttattcctaatatagttattaagtgcttgctatgttccaggtactagggacttaacaggtagcataaaagacataaggaaaagctgcactcttgttttctagcctagtggggaaatcacattaatttaatcacactaaacatgactacatagcaatagtgctttaaagggaaggaaattgttctatgtgactatatcagctgattaattaccaagcctttgcatttgatattttggttagtctattcttcttgaatttcatatgcctcttcctgggtgggggtgaggatgggattttatggagttgaggctagggcaggtagggagaaaacatgagaaagatgaagagataagccaagccagattcttcagcagaaaaatcaaggttgaaataccatgtttcaaaaatcagactgaggtgggagttgaggttaggggtccctaggccaggggattgaagcttcaaagagataaaactagagcaaaagcaagcacagagagtggcagagaggtccctgggcatttttccacagtccattctagtgctggcaatccacctttcatggccaggcaggtaagagtatttgtggggtgggagaaaggacagggccataggctgggcacacagccctttactggcccttatctctcctctcttctcctatacagtgctgtttccgaactgtacattggcttacactcgggctgaggtttgggaaataggcgccattttgaatatgtgtggaggaagaaaagtgtgtcttcagcactttccacctccccatcacggccctgagacctcaacaccgggaagcatctcgttccctatcggtcctcctttattcatggacggatatgattcctttctaagttccatgtcctttttagataaattaacttgaacctaatgcctaatggcttaaaaacaaacaaaaaaaaccctcttccttccagctagcatttgcattttaacaggggctttcaaaaaatgccttagcccaaggaatgagtaatgtgggaattccaagcagcagggtaggactggtgcacagtatggggagagaaggcccctcaagttgtggccctgaaatgttggcttcctctctttgaccatgatgctgtttctgagaaaacaagaatcaggctaccttaggggaccaggatgggcatggctcccttttagtgagttctatgagcctcatacctgacagtcagagccctcgagtggatgagcacagactagaagaagcactgtgaaactttgcatgatccttacctttttggcaaaaaggaaaaaaaatcgttctcaaattcatcaatagtttgaaatagggtgtgccttgattcagaaagtttcgattctagatacaactcggagaactaggcgtgtcttgtacacagatttgctcttgggggaccggaaaagctaaatgctatcgccatgctatgctccttcttctaggccagtgaggggaacgcattcttcattttaatatttcagttgcctacaatattggaaggtggataaaagcaccctctgctccttctaaatctgcgaagacatttcttctctgcacctactcatccttgatgcagctctcctcatgtctgtatggaaacactgtgctctcaaatgagtttcagaaagaacaactcacgaaagaaaacaagcattcggtcagaaaaatctccacaaatgggggataagggggatttgctccaaggagagactggaaaccaagtcagacataaaatccagcctaagctagaaggagacatggctggtgggagcttgaggaaaacagagctcaggatggaggacgtctccacctccagtcatgtcctctgtccaccagacaccaagaagtgttcatgttccatcgaggcagccctcacacccatcccttcctcatcatgccgactgcctctttactgcttcaggctcaccatctcaagtcgacgagcctgtaatactggctttcttgatcaccctgataccagccgtcacctcttgacaggcttattttctttaagctgtcattacaccatttttctgctcccaaactattaattccaaacttccaattttctgttaaattaaatatgaattccttatttgactttccatgccctattaggctatcttgctccttgctttacttatagaaactaatctcccattatttatccaaagacaacctctgctgcaggccagtcagcttttcttactgtcctgtaaaaattccatggtcactcctccatttccatgtgtccttaaaaactgttatttgattgtgtctcagaaagtcgtcaaagaatatataccaatgaaaagcatcaaaaaggttatacttgatgttatgtgtgtatcaaaaatatggctgaaatatttatccagtgaaactcaatcaacactaaaaagtggttctttcggaagcatcagttctttgagacccattaaacagatgcctcggatgcagggttatatattatcaggaatctgtctagggaagaattattggaagcttgcaaagcctttcaaggacagaggacgatagctaccacgttgagttctaggaaattaaccattgttattgttaaaggaagacagcgtttctcagaggaagactgttaaacagtgcagtggcccaggctaacagccctcataagtgggagtatcagaatgagtggacttaattacttaaaaccaatacagggtggaacttcatctgctataacagaaatcaactcgtgcaagttctaacatgcagggtacagttctgagaccaagtctgactcacctgtcaaagctcagctcaactattaccacctttacaccacccttccaagctgtaggagtgcttgctgttctccatgtcttctgaagccctggatcacttgtagccagctcagcagactctacccagacagggatcctttaaatgtaccatattgtctactgtgttaaaaatgagaggaactgactcagggtgagagcgatggagtgtccagatgttctcctttatttctccttattcctggaaatgtaatgagaatcttagaggtgaactgaaaagttatgagttcaaccacttactcaattcgagattcgctcctaaaatgtctcttctgtgttatcacccccactttggtttgaatagtacttgtgacagggagcttatcacctcacaagaaaatccagtcattgcttgtagctctctattaaaagttttccatcatctggaactgaaatctggctccctgtaacttttagttattggaactacttgcccttcagcaacagtgtatgtatcctcccatggaagggcccttacatatttgcagacacccagcatatacttgcaatcttttcttcttcaggttcattaccctagtccttttagttgttcttcatttgacataatttcattattcactagtgaaccttgctgcccttccccttgataaaccgaatttgtcagtgtcattcaagtataactgacctcacagaacgtgataccacaagcgatgtggtctgattagcacagagttcagtgaatgaatcctacactaggattggatgaaatttacttagccataccacactaacacttatgtgatttttatgtttactatggatagactatttctcctgtgtccacttcttcctcttacacagttgttatttcaaaactgaagtacagattcttacacttaccctcaggagattcatcatgttagtattagtctctcttttcaggctttatgaatgttaattcagctaactcatttttgagctatctgtctcattttgtgccatctgcacagcataagtttgatttctgttgcttttattagtagttttactaaatacataaaagtgaaatagtgaaacacagagtcttgtagcatccactgtgggatcagtcttttagacaagaatgatgcagttgctgagtcaaatgaataaatgaataaatcaaacaatactttgtcctcatttcccatattgatctatcaccatatcctgttaattataattctaaatatttcttgatctatccacttttcccttacttcacctgctactatcccagaccaaacagccatcttctttcactcaaacaattgcagtagccaactgattggtcttcctgcatctgtcctggcttccctatcatccatttgctacacagaaaccatggtcatcttttcaaaatgcaaatctgatgatatcagtctcagctctaatttctttggtggttcacatataaagactgaaatctttaactgaccaataacacacgtgtgatctggcccctgctcacctcttcagccttgtctttcacctgtctcttcattttggccacagggacctcctcgtaccttctctcacgtgccctcctgcctcagcgcctttgcatatgctgttccctttgccgagaactcttcctgtcaactcccaagcccttcacctacttagcacctacctattcaatctgttctgtttgcctcttggtatgttacaaactgtctccaaacttagcagcttagaacaatgaatcctttaccctctctcacaatgtttggggtcaggaatttgagcgggccttggctgatttttctgttcctcatgccatcaattgatatcacctgatgttattaagctgatggatgggctgatctggagatgcactgtccagtttggtagccactggttacctgaaatgcagccagtcctaattgagatgtgctataactataaaacacccacatgattattgaagatttggtgccaccaaaaaatttaaaatattcgttaataatttgtattctgattacatgttgagattataatatttcacatacatcagataacataaaatgtcattaaaattaatgtcacctatttctttttaatttctttaatgtgactactacaagttttcaaattatatctgtggcttgtaattgtggcttgtattgtattctttttttctgagatggagtcttactctgttgcccaggctggagtgcagtggcgagatctctgctcatcgcaagctctgcctcccaggttcaagtgattctcctgcctcagcctcctgagtagctgaaattacaggtgcccgccactatgcccagctaatttttgtatttttagtagagacggggtttccccataatggccaggctggtctcaaactcctgacctcaggtaatctgcccacctcggcctcccaaagtgctgggattacaagcatgagccaccacacctggcctgttttatattcttactggacagtgctgatctagagcaggagtcaagcagttttttctatgaaaggccacatagaaaatgttttcagctttgcaggccatgcagtctccatcatagctgttcaactcttccattgcactgcaaaagcagccatagataataatttacaatagacatagcagtgttccagtacaactattaataaaaataggtggtagccagatttggcctacaggctgtagtttgctgacccctgatctagaagatccaagattttattcatatgtctggtggcttggcagggataggtggaaggctcagctgggaccattgacccaaacagctatacagtcctctccagcatgatggtctcggggtagtgggacatcttacgtggtggctcagaactccagataaggtactcccagagagacaggtagaagctgtgaggcttcttatgaccaagctctcgaagtcccagaatatcccttgtactgtattctatggtcaaacaggtcactcaggctagcccagattcaaagagaggagatccaactctacctcttcatgggaggaggagtagccaaggatatgtgtttctttttaatctattatatcattcttcagatctcagtttaggctggtcctgttatgggctctcaaagtaccatgaacctctcttttgtagcacttgtcatagctagttttacatttctctgtatgattacttgatcactatcttgcttttctactaaactgtaggcaaccacgtgaagaggaactgtttctggttttgctcattatattcctagcaccaaacacaatgcttggttcaataaatatttgtggaagaaacgaatgaatgaatgaaccaatagcaaatgaatgaatgagtaataactgtatcaatattaatcctacatttctccatattgctgtcacgtatatcataagatactctgtcagaagccttgctaaaattcaaatatatttgattcccagtaaccttcttattttgtagttcagaaactttataaagaaggaaataagcctatcttactcttcccagtatctcaaagagggtttctgccctgagctgctcaagagggtttctgccctgagctgctgttcattctgcaaacactgctcgaatacccactgtgtgccaggtacagagagttcttctctgctgtaatctggacaggcaccagcttcccagcgtgggtttaggcttcaggtgcacactactgtgtaccgtctaagccacacctagaagagctctggggaaatatgactacttgggcagaaaaggaaggaactaagaagaggtatctttgtgtctgaggtctgaaggagcgtgtgggctcttgttcaggcaaagggcaggatgaggggaggtggggtggcagcagccagtaatggggtgggacagcggaatgcagaggatgaaacttcaggtcctggtgctctgagaagtaacgctgtgcagcatgtcacacccagaggcaaaccaaggccccagggagctgatgttgcactggagctctactctcctctcagcgagctggtgacgtgccagtccagcaggcctggcttatccaaccacaagtatgaatcggcagaaggcaatgagctgggccctgagtgctgctgggctgaggccgacctaatccttcctccacagagactgtggtgtcccctgctttgctcagggtaagaactcttgtatacctcacaagaagccaaggactacctaccaccttccacactggccctggagcctgcattgtagttatttgtggacactttttcttctctttagtgccaggtgggggaccaaggcctacatgtctttacaacccctcaatctctagaacaagtctgacactgagtagatgtagcaaatgtttgcctgaaagactacctcaataaataaccttctgaggcaccagcaaacttctcagcatttttcctgatactccggttaccactaacattctacacaaagttgtgaaataagtctttttctttgttgctctccaacatctactgtggacccctcctctcacttcctgtttcatcctctctgcactcccctgtcccaccccattactggctgctgccattccacctccctcatcctgccctttgcctgaatgagagcccacatgctccttcagacctcagatacaaagataccccttcttagttccttccttttctgcccaagtagtcatatttccccagagctcttctagatatggcttagatggtccacagtagtgtgcacctgaagcctaaatccacgctgggaagctggtgcctgtccaggttaaagtggagaagtactctctgtacctggcacacagtgggtattcgagcagtgtttgcagaatgaacagcagctcagggcagaaaccctcttgatgcaaagggatactttggggccccttcttctcccaccccagtctgtctctctgagagtcctctcgattccaggagccaccatcacacctggccctaggctgtgctgctcccgtctgtctcagaggctagataacatcagagtcctttccactggctcctgtggcagagcaaaaactggttggcatttttaaacgtgctacaccagtgtgaaagaaacacaggctgcatgggtttaaatctcagctgtaccatttactagctgggcagcctagggcaagtactgtgacctctctgagactccattccttcatctgtaacatggggacaaataatctcaccctgttgtgagcagtaatagtatgattaatcatttagccaactcttattcatgttctctgatgggccagacatacaaagtaagtgaaagtggattacggcaggtgctcttcttggtttctggagtgaacctccatttacatggaggctcctctttttagatttctgactagttcacccaccttattcatagaccttattctgtgcttagctgacagaaatctcctctcagagaatccccccggtaaattcttaggttctttcctcttccattcccctttttgctctctccctccgaaggcaagagtttccactttacaggcccactggagaaagttatggcttctggttgtggttggaggttcattcctgagggagtggggacatttctacacttcttcacggccaatgacattggagaaactggcttcctaacccagcccacaccctcgcacacacacatcacacatcatggctagaatggagagaaattcttcatatggggcacttgtacttcatgaaagaaaatcatatcaatcttgagtattttaacatcctattacagcagggtcactgataaactaagtgtccagagtgttttctaggatggtgtgtggtctccaaattaacattagtgaagcttactggaaggattgttactcctgggccaggccaggattttgaggagagatgtgtttgctgtcaccaaatccttgacagactttggcagaagtgtgttaggcttactctggatagcttcagaggacaaaactagtattgacggaaggaaggtaaggagaagcagcttctaacccaggggaagagagagtttccaaactgagaaatcaaaaatggtactgattccttgtcagggtcagtgcttctccccactgtgtgaattacaggggccatttgtccaagattccttagagcaatactgatttcatgtaattatttgaatgaaaggtgatttgttaaatttatagtaaaatataatttgatttgtgtccctgtttgtcatgccaccccagaagaaaaattgtctttggttaggtcgaacataatggttttttggtttgcaaaccatgagcgattcccatattaggtgggagttcagattcaaagggccctcttttttttttttttttttttgtagtagccagcctaatgagtaggaagttgttctcactgtcattttatattgaatttcttttattttgagtatgaccatcttttcaaatgtatgagatagttatttccagttccacatactatctgtacatttcttttgcccgcttttagtttgggtctttggcctttttcttattgatttatagaagctcttttatacatagaaaattaatactttgtgactagttgcaaatattttcagttgctgaaatacacagtaggtgttccatgtaagagctgaacagctggttcctgattgctgtctccctcccttccagccaatagatttcagagtttgggcattacctattgagccaaagctgacaccacacaagcgcagagtatgggaacagagttctctgtctgattcctgtgagcttcctcatactaaatcaccaacagcaacctacttatcacagaatatgagaattgaacaagtgttggcaaggatgtggagaaattggagctcttgttccagttgtcgatgggaatgtaaagtgatgtcgctgctatggaaaatagtgtagcagttcctcagaaaattaaaaatagaatgaccacatgatctagcaattccccttctgggtatatacccaaaagaactgaaagcagagtcttaaagagatattcatacagccttgttcataccagcattatgcacaatagccaaaaggtggaagcaactcaaatgtccatcaaaaatgaatggataaacaaaatgtagtatgtacatacagtggaatatcatttagtcttagaaagaaaggaaattcaaacacatgctacaatgtggatggcccttgaatacattatactaagtgaaataagccagtcacaaaaagacaaatactgtatgagtttacttataccctaagcagtcaaattcatggaaacagaaggtggaatggtggttggcaagagctgagaggaggagagaaagaagagttattgtttaataggtatagaggcttagttttgcaagatgaaagagttctgaagatggatgtagtgatgactgtacaacaatgtgaatgtatttcataccactgtacactcaaaaggtgaagatggcaaattttatgtgtattatgccacaactaataaagatttctaaaacttatgagatctaatttcaccgtttcctattgctaaagatcacaaattagaaaacacgttggcaaaaggtacatgaaaataagcactcttgtgttgatcagagcataaacgtataatctcataaactaataaagatttctaaataacaaagatttctaaaacttatgagatgtaatttcaccatttcctattgctaaagatcacaaattagaaaacatgttggcaaaaggtacatgaaaataagcactcttgtgttgatcagagcataaacgtataatctcaggggagaacaatttgcaactattcttcaaccctttggtcaaacgattctgcttctaggaatatagcttactcccacctgtgtgatatggcatataatcaaggttttccattgcaacaaaagattggaaacaacgttaagtatccatcactagtggtctggaaatatatatatattattgtcatccaatagaatacaatagactaatatgcaacttttagcatgaggatactcgttacatgctgatacagaataatctccaaggtagtcatatgtgtgcaaaaccgtacatagtatgctaccatttgtacttaaaaataaaaagaaaacagaatatgggtcaatgtttttgtttagttttgtctaaagtaactttaagtagaggcaagaaactggtaacatgtaacagtgatcacccctgttacctctgtggaagaaaactagacagctaagggacaaggctgggaggcagacttgctttccactatttatcacctttatctttcaaatttagtaccatctacatttagtaccatgatctattcaaaaatatttattaaaaaaagaaaaggtatagtctagaaggaaaaaaaacataacagacacttctagcccaatgtcctgcactgggtgctatgagagcagaggaaagaaacacatatggcttctagacaacaccgtctggggcatacatttctgctattcgatcaagaatagttgtgcatcttttcctggaaagaattgatttgtttttatcaacagacctatgaatttagtggacagacctgtgaattaattcactggttaggttttcctttttacattggctgttaaaaagctataagccaaatttatgtccccctcagtgcaaattgggcagatttctagggcaagcatttagcactggccttgtccttggctctgtatcatattcctgtatttggtttgcttttccacctgtttctcatgttggtcatctttcctgtgtatggccataccatcctgaatgtgcctgatcgcatctaatgttggtcacctctccttattctttgcttccttataagccactaagcagcctttttggtgctagttagggtaagtgcgtgggtagtgaaggagggaggagggagaggaagaaagaagatagaggttataaagcaaagcatatcctttttcttggcttcatcatgtagattaagtgaattgctctcaaagcgtggtccttaggccggcagcattgtcatcaccttatgttgttaaacataaaaattcatgggtttcatcccaacttactaagccagactttctgtggttgaggcccaggaaactctccaggtgatttttactcacattcaagtttgagaaccacaggaaaacaaaaggaaggcagatttctaagcgtaaatgcaatactaaccgattgcccccatcatgcctgttatgttggtcaagataaataatactagctactgcaataatcaatccctcaaattttattttttgccaatatcacaatccattgtagatcagttgtgggagaggtgtaaagagagctgctttattagtttattaagcaaaccagatctcttccattgtgagactttgcgattttctaggcccttggacatttcctctggatcccctgctgctaagaaggcaggagagggaggaaagagaagagactttagcagccagatctggaagaaacatcttttctgcccacaattccattggctagaagccagtctcatggcctgtataactgcaggggaggctgggaaatgtgacctatcgatggagctaagagcaaaaggaaatggctttgatgaagccctggcattgtctctgcacacccgagaacccaagtgaatcccaaactccacgtccaggtcatgttttggtgaacatcggttttcagtttccttttctaatcaagttttaccttttttttctcgactctagcactatgggactgagtaacattctctttgtgatggccttcctgctctctggtaagaacctttcagctttgttaagtcctggaatcctactgtctcctgatgagtctgaccacagcaagcccaggcctgagacttggtgggttttactcactttctactgagcattgtacaagaccacatgcaaaaaagactttcctggagaagaaggaagtgttatgattgagagcagctgatggcaggcagctgggatggagctctcccccccgtgtgcttcttcctcctctgcagtctcacatcagtgagcctagatgctcagagtagggtagcctggcccatcccatggggatgggggaaggctgctgcactgaggcccctgagacttgactcttttgttccacacatattctcttctggtcttctctgaccctgtttctgtctttctcaggctcctaggaaacaactgacagaattccaaaagtctcccttcattcggagcactggctttcacgtccctgacttccctaccctctctcactcccttccctacagcccatgcacatacctcatggttgccacggcttcctgacaactatggatgttcagctaattgtgtcagctgatttatagtggagccaatgaagctgaagcttcagagccctccatttgcacaaccctttctaaatccccctcaagaccctgtgaagggccccctagcagtgtggtcacctgtcttatgctttggtaaaatttgaataagtaagatattgtaaccacaataagttatgaccactgtctccttcctctgcaacttttccctccatgccattctcctgtctggtggtgttagcagtcaggggcattttgtatttgaattctacattctttttcttaactatccaccacctcccctcaaaattttaacagcatccagcctcacaaaactcagatcttccctgtttacagttccactttgagtttcagtttcttcatctataaacaggagttggctgcggtccctgccatgtatcctgtgactcagtgtctcgtagttactcctggcccaccccttcctgctgctccttgtctccacctgcaggcctgagagggaagccaccccactaagacagggaggtgaactgagcctgaagtttggctacagcacccacaggccaccagccatgagttcacctcctccagatggccacacaccaggcccttggccactgtccccatgtctgctgtggatgatgaggagtcagggaactacaaagagatggtccctcagatccatgctggctgggataagccttttcagatttctgtttttctgcttagcaccttgagcttgtggagtccttgagtgcaaggtctgtagatgtgccagctgatcactgacttaggtaacaacagcagcttccaacccccagggcccatgacctgctaccttagctcctggggatgtgggaggtatgtgtgtgtcagagagcaaggcaagaagactctagagaacattatccagtaagattcccttctcatcccacttcttatttatttattttatttattttattttttgagacagcatctttctctgtcacccaggctggagtacagtggcacagtcacagctcactgtggcctcgattacctgggctcaagcaattctcccacctcagcctccccaagtgctagaattatatgcatgagccatcgcacatgacttattttatttatttgataaatgcatatatacacacagtcatgaatcgtttaacaacaggggtacgttctgagaaacacattattaggcgattttgtcattgtataatcatcatagggtgtccttacacaaaactagatagcatagcctgctccatacttaggctacctggcacagcctattgctcctaggctacaagcctgcacagcatgttactgtgctgaatactgtaggtgttgtaacacaatggtatgtatttttgtatctgaacatatctaagcatagaaaagatacagtaaaaatatggtgttataatcttatgggaccaccattgtatatgactgaaatgtggctgtgcaatacatgacagtatatgcatatatatatatatcccttactttgtgcctggtactgttctaagtacctcataaatattaactcatttgagcctcacaataactttctgctttaggtcttgttgttatttcccattttaagatgtggacactaaagcccagagaggtgaagtaatttacccaagatcgacagagctactaagtggcagagcttggattcacacccagcaatgtagatttagcattcgttcacttgactcttctcctaactcttgtggtaaaccatgaataagtggtaagacttcttccatggggcctgaacagctttggtggataatatagcttctgcctcatccgtgttcatccagtgcctcctccccatcacctgcagctgacacctcagttgacccaagagcttgggcccaagcccttctcatcaaagtgaccagcccagctctcaagatctgggagagaaggaagaaaaatgccctggaaacacatttccagaaaacactaaactggaacaccatttcccaccaaattttctgactccgcacactgaaagtgagaaagtaaagccgagacactctatgaaaactgagttcaggtgtcacttttgcccttgatttgccattgacacttcttagaagtttcttagctcctgagaaaagagttaccaatattgaaagcaacaacctcaaatggtaaccgtttaagttttatggtggtgagagaataagtgactatatttttggcagtacaattttaaagtggaatagaaagcccatgacatcagatcagaaaataacattgccagtaattcacacacgatgaaaagcaacaaaaaatcagattctatttgaattctttcttctcagggcacacctctgcttactgggctggtgaacagtgacctagccacagggccggcttccaaagggagaaaggagatgcaattggcccacataatccaccctcaaaatgtagagctgaataattcatttcatggcatagaaatagcaatacagtgaagcaattctgtttaacttttccctcccttatattttgtgtcctctgtcatggaaatttgacacagtagtatttgctgcccctgctcttgaggataaaattggatgggagtttaagactgaaacgggcacctgtggccttgcagaattaggttacagtttgtgccttgtatttacaaagcgaaaggaattcctagtgccacctgcagaggcacttctaactttcaagctctgtttgccactgtcctggcacctccatcacacttttaggctggagccagagaggtttttgaaaaatcagtagctcccacatcaggaggaagtatctttccagtttgagttttggtagctgctctctttttgtctgagggttctctgggtcctagggctttctcatttctcttgaacaacacctctagttaatttcatgtacctggagtggtagttggaatatttcttcactttaagatttttttttttttttttgagatggagtctcactctgttgcccaggctaaagtgcaatggcatgatcttggctcacggcaacccccgcctcccaggttcaagtgattctcttgcctcagcctcccaagtagctgggattacacctaccaccacaaaatacaaaaatacacaaataatttttgtatttttggtagagacggggtttcaccatgttggccatgctagtctcgaactcctgacctcaggtgatctgcccgcctcgacctcccaaagtgctgggattacagacaggcatgagccactgcgcccggcccaccttaagatttatgtaagattggctcaaaagctcattcctgtggaaaggtccactgttttcctcccaagatttttgcagatatctgcgtgggtggttacttttgactcccatttcctgctgttgttgatagccctcattaaaaccatcacctggaggtgaatagacagtcgagacctatcattcccaaagaattgtcatggagcctaatagttctattggattcacccctttatgttaagccaccatttcagtgtttttcaaaatagatatatgttatctagtagggagtatcttacccccaaattagttgattgtttcaggagggcttttagtgggttccagagaaaatgagcaatcagacaagttgatttagtggaagacagtcactgaataggatgtgtatagggttgtttgggagcaagagtgaaattggtatggaacagagaggctcccaaggcaagcagacattttttttggaagaagcaagtgtttgagagactgtggcttatttttcctttgtgagaggggagttttaataccatttccaaaatatgtaacctggtattttgtccccagaagtactgttgagatttatggaagcaaaaaactctgtcacccaggctagaggagtgcagtggtgctatcaaagcttactgcagcctctaattcccaggctcaagagatgtttctgcctcagccacctgaatagctggcactataagtacatgccaccatgcctggctagttttttttgttgttgttttgttttgctttagagacggggtctcgctttgtgcccaggctggtcttgaactccttttaagtgattatctcttctcagcttcttaaagtcctgggattataggcatggcctatctatttttatgttttataatttcttgtactttttgatgttacttcaaatatctttttaagtatcctaaatatacttatttaaattttttttgagtaaatttatctataaattattgattttatgtcgatagacattgttctctatcattaataatgttaaaaataaataaaaaaacaaaaacaagtaaatcaattaatgcttaccacaggccagtatttgatccaacactaactcaaatattcatttctttaatcctcacaacaaacctatgaggtaggtaccattattgttcctgctttttgcaagaggaaactgagacacagggaagttaagtaatttgcctatggtaacacaggcagtgagtagttgagctgagattgaactcacgctgtccagaatccatactattagttataatagtgtactgccctatagctttctgtttcacagctacatggcattactttgtatggatgtatcattatttgttaaaccatttaacttatttccagtgtattgttcttataaacaatgaatacctgtgtacctctaattttgtgcacatgtatctttttgtagaatgaattcttaagaaattgagttgctaagtcaatgcttaagcccataattaattttcttacatattaccaactgtcctccaaaaaggttgtaccaatttagaattttaccagcagtaaattcagcagttaggacccattttcctaacactctcgcggacactgggtattaccagtattttttttaatacgtgccaatcaaatgggcaaaaagaatggtttctcactgaggtttaaattgcatttccctagttattcttgagatttttcctttcctttcttcaacaattacttattgagtgcttcatatttgtaagggacaattgcaggtactggaaatgtcacagtgaggaaaagtgacaaagcccctgctgtcatggagcttattctaatgggagatgtcaggtgctcagctgagctgggagagagagagctgagttgtcaggtgtcagaggagccaattatagcagcaaaacaaaaataaaatagttcagcttttaatctcttactacgacggtataatcaagaggctaaaatgggaggaagggcagactctgcctgttccatttccccacatagagtgagtataccagtcgagggtcaggtaatcagtgcagacttagggggtcgccttaccattgaagaagccccaaatgaaaggctctagcagttttatggacctgggggtggaggaatccaagggtggggagaattcatgaggaaaatgaggtgagagggctaggagtggaaaagtacaaagtactgagttagcgtggggaatagtgtctttagggctaggagtggaaaaaatactaggtactgagtcagagtggaaaacagtgtcttcaaggcagggagtggaaaagtgctaggtactgagtccgagtggagaaaagtgtcttctctatgatgaggaggcttcagcagaggtgcctgaagacctcaccccagagcctcagataaagagacctaagaatgagggtgcctgggctaagattgcaagtatgtgaaaaagcatgactggcgggaggctgagatcttgattgcagcccccttcagagactgccatgcactgactgtgcaccaagtctgctgtagaaagggcaacttcctcagcaaggcttgtcagattaagcctctttaattgcctgtggtcaggtctgaaaaatcacacatagatttttaatcagaacccagacatctcaggagagacagacaataaccaaacataccgtgtcatgtcatgtcatgataagtaccacaataaatataagtcagcatgagggacagaatgcccaggatgctatcttcaatagaatggttagagaaatctccctgggaggtagcatttaatgaaagacctacatgaagtgaaggagaagctatgagactgtctggaggaagaaccttctggacagagggaacaacatgagaagaggacttgagacagagtgtgtgatcttttggaggaatgtcaagggaggcagtgtggctggggagagtaagcaggggaaagaggcctgataggtactggggacccaattacatgaggtcttgtaaggccaggggaaggactttggatgtagttctcagtgtgaggggaagggatctggatatatttttcagtttggtggaaggcatcagaggcttctgaacaggaggattatgtgattggagctgtatttttaagggatcattttggcttgagaaactagacccggggacaaggacggagcaggcagatgagttaggagacaattacattagtctcctctacccttttcttaacatattggagttcagctctggctgtagtagttctagatctcctcagacacacttgtgtagagcctctgttgggtattttgggtacacaaatgattcatcttggttatacagatgatttagatgattgtagacagaagagggttgtctggtcattcccagacaggggagcattccttgagatagagtagaggaaggctgaaggggaggaagacagtacctgttgctatctagatagagacatccagcaggaagttgaatacaggtatctgaaactctagtgaaagttataggctggcaataagcacctgggagttattagcttttacttgacagttgaatccgtggggctagaggagaaaaaccaggaaagtatggagaataagaagaccaagaacatgcactcaaggttaccaaaattaaagagtgatttgagaaaattaacaaggaaatcagagattgggaaagaatagagcatttcaatgaggagagatgccaacacttgcatttgacacagcggtcaaatgagttgagatctgaaaagagctcaagccttggccatggtgtgaagtcaccaacaacctttgtcagggagtttcagtagagaggtgggggtgggaggctgggaataaaggcagcaattgctgcttactctttcagggagtttgactccaagggaaagagaaactaaaagcagtagcacaaggtttgtgtttgaagtaatggaggtgaaccaggtgaatagcctggaggccgagtgaagtgagacaggacactgcagatttggaatgtcaccagtccgcacaactgaataatttcctccagaactgctcaattgcccagttgtaagaacagatatgtagaccaaaagtagagtgtccccagggtaaattttatagagacaaaggggtgtgtttattgaagttgtggaaaggaataattacaaagacatactattgttgcattgtccaatataataaccactagccatatgtgactacttaaatttcaattaattaaaattaaataagattaaaaattcatcttctcagtcatactagctatgtatcaattgctcaatagccacaggggctggtggctatcatattgttcagcacagagacagagcatttccattatcactaagagttcttgtggaaaacactgcactacagggtctggataaagctgaggtcttgattaagttgaacaacagttgtagaaggagtaagcaagagcaaaacctggatgaataggaggttgtggacggagattagtatattgagattaagattctagggactgagctgctccaggtgaaaagtttcagggttatgtcataagaaggtggggggcagctgctgaaatagtctgcgggtgtagacctgtggagttgacaagatcaaagaaatttgaggcaaggttgttagactcattcatgaagaagtcacccaaattgttagcaagaccttgcatctaatgccaaaatcctcatttagcaaggtggtagtgacttagtagctacaagcaatgagaaagtcagacacctcaaaaggggaaggtgttgctcaaagtccccacaaagtgtgataaaacaaacagtagctggggctggagcaagtggcttcctttgggtgaagccagatttcactgaaataataacctcagggaaacagtcaatgaaggggttaaagatgtgggagagtttccttgtagtaagtaatggaatgaggctttcaaagggccaagtaaaactttggaggaagtttagtaaaagaaggaattttttttagtacagataagcataggaacataaagaagagataattcttaaacatataagatatgcatttggggatagcagccagggaacactgaagtcccagtggggtcagagacttcataaggctagcaaattacagtttttgagtggcattccaacagtagagtgtattgctcaggaagtccttaattatcctttgaaacaaattccttcagctgattacgaaggcatctagctggattcttgagcgacttgttcctgacatcatagcaacccattgtaactagacttcgaccattcctcttacccaagtgctggggaagggagagattctcaatgcttacccacctatggaatcccagtaagtccagttgctaggtggcttgaggtctggggtcataaaatggaaggcctgaagtcatttggtgatcacagaccttgagccaaactttccccatttagtcagagaaaggattagcagcatcccccatgcctggctctgtgtgagatcatggaagccagtggttggtgaggtgctatggagtataaattgcaaaatactttcagttccactcagaatggatttcaaagtgatttccaccccatggggaggagagggagtctgaggagggatggatggaaaaaaaattttcatgtcattttctgtgatccactctggagacagaggcagagattctctacaacagctgctcaaactatagctcttgttaaaatggaggttctgaatcagtaagtcttgggtggggccagagattccgtgtttcagaccagcccacatgtgacgtgaatctcattggtccatacatcacactttcagttgctaggtgaagaagggagcactcgatgagtggaagagaaagccgttgtaatctttgggagaaggggcctgggtcagcggagttagactggtctgtgagtggacagaatggatgggaaggaaagaagatactgtgaggctctacagaaaaaaaaaaaaaaaaaaaaatatatatatatatatatatatatatgtaaatcaagaagacagaagcagctaaagacgaagtcatttccaggtccagaaggcacaactgacagctgagtaataacataacattgactgttaattggcagaatttttaactgtgtgtttggtttctccatcaggtcatctgtcctatattacatgacaatttagactaaaaccagtatttcctcagagacaatgctagaagcttttacagtagggggcactcttgcattacattaagagctcagcaaagaagatgcagaagcctcaggtttgccttgtaaggtgattcataaacacactaaatcttccttaggtctccctttcactgtcagggtacgcatatagattttccttcctccctccaataccggtacgcatcctctacaggtggtgcattttatacctcaagtacttcacagggtcctagtgagtgtagtgaaataggcagtgattcatatttgtgcaaactcccactgatgcctgctgtctgcttccctaagagttcaagaccaccaccaaccccttgattatgtgttctcactgggccactctgtacacagtttagtttgacaagtgcatgtcactgttatctgtccttctattccctctttcaagagaaaccacatcaatttaattactcccccacttagaactcttcaaatgaagctcctctcatctctctcatcaacccatctcctccctttcctcctcaatgtcaacatgccttcacataaatcctgaatgatgaaattttatttagaacttacactaacttcctctccaaggtggcatctaacttcatattaagtaagaaacagccttcccactctccacccccgcacttctcacccaccactgcttactttttttttttttttttttttttttttgccaagtctcaagtaattctgtaacctagaaaaggtcctacacaaaccccgtgatcattcacatttaagtagttgggtggcccacatccttcccacaaaccccaaagtgtcctcaaggactaaagcctttctctcaacccttccagcatgatgtctatggttgtaaaattgtccagggtcagtgcatactgggagcagcaagtttgtggtgcctggggtttccccaatactcccaaagcacatcctcacctgcccatctatgattcattttcagcatttcactcatgtgccttaaatggtcattgaccaccacaatccgaaaacagccatcaaatttgcccagttctctttctgatctctgaaagagcttagagaggtcactgaaaataaaggccttggttcactatcgaagtcatttctaaagcatttgacatccttggaagtgctggccatgggagcagcagtcataggggaagttctgtaaagggagctatttgaatttcaaagatgttactcaacgtgattccccaactaatgaagtataataaaggggggctataatttattaccattatcagcaatcttttcaccatagcagaccaaggaatatgtggatgggaggggaggggaaagcttttggtgatggtgtagaagttatggaacctgtaacagctacagtgatgaaaactaaaattaaggttataggaaggtaactggtgggtgaatgggttgtctaactctactggtttttccctgtcttgcaatttaaattcacagaaccacagtactagaaagacccttggaacatttagtcaaccacttcattaatcagatgaggaaactgaggctcataaagattgcagtttgtacaaggccacacatttagtcagcggtgaagcaaggacaaaggtcctaatctccagatgccaagcagatgtgcacagttccagagcttaatatcttattcttcagcatgattactgataagatagtatctgggtattgtataaagagaaatggaggttttttcccctttcctcttgtttctccctccctaatccttaaccttcttttttaggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttggtatgtggtcaatggtgtgtgttcagattcttagccttctcagatgagactgcaaatgagttagaaaaacactggagggggacttgaggggcccaggggaaaaggggggtctatagagagaaggcagaggacagccacttctgggaagtgcatttgaagggagtgtagagtctgggagtagggaactgaaagtcttttgtactttttatagtctgcttctgaaggatcagtaaaaatctgctttggggaaaaaatagagctaattgaacaaagataatatggctaattacctatagtaaaaaccatggataatttggccatcacaaagtttatataaccataaaggcctcagatgtcttacattcattttttccttgggtccaagatttttcacctactaaatctttgcctggagctcctagcaaagcggacagctgacacatttgggttttcccttcagcctcctctaggttgcttatgagttgtttgctgccacaaccatgagcctggtagacagaagggaaaaaaacccaacaaacataacccacaaacttacaaaccagctcctctgcttcacgagaccttggaaggcctaaatgccactacagatttttttaaaactatcacacagtaaaattatttttttttgttttgatatactgttctactgattgtatagatcttgtatagatttaggtaaccgccacaggacatagagcatttctatcaccctaaaaatttccctcaggctgtcccttcatagagtcataccctgtctgcactcataacccttgttgggcatcctatagttttgtctttttgacagtgtcacataagtgaagccacacagtatgtaaccttttaagcctggcttctttcgtttagcgcgccttcgagattcacccaagttgttgcacatatcgagcttgtccctttttattgctgagtagcattttattgtttatccattcaactcagtaaaagacattgggttgtttctggtttggggctcttatgaataaggctgctgtaaacgttcatgtacaggtttttgtgtgaacataagttctcagttctctagaggaaatacccaggtgtggtattactggatccaggttaatttttgatgaaacttgaaaaggcagatcaacacctattctaaaaccatagagtaaaacagaagcaaaagtaaaaatagaatggagagctgctccctttgaaccctgtgtgatttaaactaggctgcagggctttaggaatagttaaccaagtgctaaatccgtgttttcaaaatgtggtcaggtaccattggaaatgttttaggtgggacacagataagcattttgaaaagccatgttgtatttgttttaatgtatattagaaaaactctaacttacgcaacatgtgatttcacagatcttgttaatgaagctaaacacggtctggcaattcaccttctacaggccacatagagtccaagaagagtgctcaaatagtacactgatatagcaaaacttataaagatgacatgcaaatgacagaccttttagtaagaatacactaaattataaattagtttgtagaacctgcaaactacctagtaactataaaagaacaagggattttttctgacagaaggcacatgacacaggtctagggactccatgccagtgatcctgaacagccagaaaagtgagaatggcaaaggcaagagaaacactgtgtttattaagatcatgtatttttccctaaaatagctggatttggccttcttcttagagtatgttatgaagacactttgatgctcatgccaaaaatcagtgttctgaatttcgaattccaaaatatccacccactcacttaccacaatcctgcttgggtttctgaaagatatgacgcagggcatctcagcaccatgaactctgtcagttcctggtgagactccagctcaattccttcctgctctcttagtctggggagctggaatgtgccccatgggacacctgggccctagagtcagaccacttctccttccaaagactctactccctggaaacagtggcttcattgtaaatctttggtgactcaattacagccctcctgtcacttagagagcacccctttgatttggataagcaggaagtaagcatggctgcaaactctattgttgaaaaataaacatgaagtcattatgtggcactcaccttgggctgagggtcacattttagacaccctgaggctcccaggtgtgccccaatgagccccagatcaagtacccagttatttgctattccctcctagatacatctaaacttagattgatttttttttatctctcttctgctttcagctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctataggtaaagctgttttccaagactatttctttcagcaggtattatacacaaatgcttaaggcagatcatccaatgtccccgacttgctaggaaacctccaactgggccattttatgacgctgttaggaaggacccagatggaggtctcctgcttctcctgagtgatgcagggtccaggaggctacgagcctatgttgcacttgaagaaatatgcttttagccctgaaactgactcagtctcttggtttacctttggatggaggattctgaagttttgatttaaaaatacaggattcctccaggctagaattctttctttgattacaacacatacatgcgcttgcacacacacacacacacacacacacacacacacacacacaccatgcatacatgcagacatacaaatgatatttattgtgagtatagaaccatttgggacattattggtcacaggagtgaaaacaaaaagatatgacaccccctctgcccttgaggaccttccaatagaatcagaaccctgtaatgtgcacacatgaaaaactggatttttaaaaggttgaattggaatctaaattttattccatggaaatatctgactaaatttaaaataaaagtgactggtaatgagatttatgggcattcagaggtaggcaagatccctgagggtcagggaatggttcctaaaggaaggggtaccttgtaacatgtaaaataaattattggggttaataaatgtggtgaggaggggagggcattctggatgacaggttcccaaaactgtggtgacttccgtagctgaaaaaatttgagacagtatctgggctaagcaggtgagaggaccacagtggatcagctgtatctgacgtaagtgcaggaggtatgtcaaagaaagccttggaggcagaaatgcttgtgtgttcacaagtattcttcagggacaagttcagtggaggaaaggattgaaactaagcagtagccactaataggagcctgacattttaaagtcctggctttacccaggagggcatgtgtctatatttgactcctcttttaagaagctgtaactgcaagattccctcctggaataaaggtggtctgcatctaccctgtcccatcactgcctgtgctgaccttgacacccacatctgccttcttcttaccttgaccccttctccagcgatgatttcttggcttgccccctccagtgacatccatccaactccttgctccataccctggctttgtcacctcctttctcccagtgtcttgttgttcagatataacttggtctgtgaacagcccacggggccagtccccatgaaccaactttacaactgggccaatctcatctcctgctactgacttcttcctattcagacacttcagcctctgagaatccagtaaatggtggagccaactcgtcctgtcccagttgcttctcctgtatcctctcttggccagatagaagcctctccaagctatgcctgaagttcagtacctccttcaatgtgtaattagtttgattggtggccacaagatggccatatatgacatgccccagggccctctgttacggctcccatagtctacaaattaacaggggcttgccaccactataacctcatcatggctcaccttcctgctgcttctcaactactgttctgccaaacttcaacaggtacccccatcttcagaaatgtttcagctctagctgcctcaggaagatggggcttgcctctctgggtttcccattctatcgcttgatcagagataggttagaccctgagtcaaggggccttttttgcatgttaaaaggtagcagcctccacgttagtaagtataacccctaaccccctttactgggagtgccaaactggctcaagtggaatagactgggacagactcaaaagggattaaatatggcctgcaatgccaacaacttcttaacatcccagaaacagggcatgtgtctacaaattatagctaagctaatagatcagctggtcctaattttcctgaaatttgggattagctaccagaactgttcccaaaaatgtctttaaagtgggcgactccgttctaagttttccccacaaagcctgttttccaactccccagaaacttaggagttctcatgtaaggaagtagttcctgaaggcgtgaaggttcctcaaggcatgaagaaacatcaaaggtttttcagtagatgagatatgctgaaagccatgcagaggaaacctgctgtgacctcagtaggaaaaaactaaacaaacaagcaaatgaaaactagaggtaggggcctgtggaagctgttccatttgtccaagtgagaggtgtctggagattatagtggacagaagaatcatcacgagaggaacttcagggcttgggaactgactgcagaggggggcaggatagcaggcacggcacaaatgactgcacgtgcagagcctcagcacagacacctcacccagattccagaatcacgggccaggctgaccctcttcttcctgatcatggtcggtgttatccccacctccatgaaggcatggcagctcagtccaggcatttggccagaggcatgggctcgattcttaggtcgctgctgaggccctgagcctgggactttctatggcctcctattgtggatttcaggcttctctggccttagagccctggggagaggctggcaggtaaataaagagaagagcagctagcagaaaccttttgtaaatgactctcctggctgattgaaaatttgtggtcatttgtagagcttgaggaccctcagcctcccccagaccacattccttggattacagctgtacttccaacagttattatatgtgtgatggttttctgtctaattctatggaaatggaagaagaagaagcggcctcgcaactcttataaatgtggtgagtgagtccttgtcctccccacagactgtcactttgcacctacttcccaatcggctggctgccttccggagcttgttggctgagcctagactggcaaaaagtcaggaagttgttgggaaaaaaggttttcccttggagttttgagcctatacagactggcagtagcagataatgctgctcttggacttcaaagaaaggcgacatttctaacctctggtttacaaatgtacttctggtttccagggaaaactgattattacttgctttatctacctcacttcatgaggttactgtgacatatacataaagtaaaatggtgaaaccactcctaaatgttaaagattgtggacctggtggtgtttaagcagggatatttgctaaatgaccacaagaatcagcttctcgtctctaaaaaaatctaggtttcttatgaaataagttagatgaattattgcccattgacttataacaaacaatattaactttaactaatttctaagtaatacatatccattatcatatataccaaaaataaaatcatctataactccactaataagaaaaaatgattacacaaacatttttggtgcctatctttaagatttttctgtgtatcaatctatgttgttttccataattaggattatcataagggttatttttcacaatttggataatatatgtactgtgttctaattttgttatactaaatgtagcaagacaattttcaatgtcataaatatcattctacagcatcattttaaatggctgcaagatattcccttttgtggatacaccataatttatttatttaaccaacctcattttttggacacttgagttagtccaatagttttgttattataaacaccctccccactgacttctgttataaaaatgtttcatggggacaaagtggtccctaactttataataatgccatgcctttttgtagtttggtctggttctaagctaagattggactttatctcagtaattgcctccagtagtaattagtttgattggtgctaataattaaggtaaccttctaactcacttatggtagaaagcacaagatgagtattgcctctggccagcatcttgtttttcagtatactgattttaaaatctaactagaaaatagatggatgacattagcagtcattcaatgcatcctgctgtactttaaaaataagaaattggggagcaacgatcgaatttaaataaattaacacaaagcatgtggcagagccattcaaactgccaatgtatggagtgtgctgcgagatttctatgatataaaagtataaaattcctagcacagatgtaaagacatatcatgcttgtccaggctttgacttttcaaggtgagagttttgagcttcactttctttcaacctcattgccatttaaaattagtcaaatatgaagaagtgacttacatcttgggaataagctgtttgctagatttttcttcacattagaatgatcagcttacaaatgaaacaaagaagggttggagaaaaagattaaggatgtttcttcctccatgaggcaatcagaaaaaaatcaggagactagataggggagataaagaggatatgtgtgttcacatgagagaagttagaaggtggttaaataagctctgtaggtacagatgagatggtcagattgggctgagtggcacatacatgacccctaagaatgtaatgaagaatattggtaagaaaaagttatttattcagacagtcatccatgccactgagtttgatcaaagagagaagccttgctatcactgtagggagggaggtgcaacaggtataactatgccattatagatatgatatatttgtaaatttggattctgtaacttcagcaatatctgccattgctttgtgggtactcctggcattggctatgtgataggtaaaataatgccccccacaagacgtccacctcctatactccagaacctgtaatatgttatcttacatggcaaaaggaacttcacataggtgattaaggcaccaagcttgagatggtgagattaacctggattatccaggtgggcccaatgtaatcacatgagtcagagaacctttcctagctgggatggagaaatgaactggaagaaggagagatctgaaacttgagaagctcaacccagcatttctagctttgaagatggaaggaggaagccatgagccaaggaatgtaagtagcttctagaagctggaagtggctctcagttgacagccagccattaaggaaattaggatctcagttctgcaactataaggagctgaattctgccaagagaccaatgtggaaacagcagatccctccacagagacacaagcttactgataactggtaggaatttctccaaaagtggagcttcctcctactccagtgttaatccctttctcagaggagacggtcctcaaactaactaacttggcaccaaaagtcctatccagtgttttctcattatagtttttctatgcctcaactgtatatatttacccagtttaggctgtttaaatgaataaaaaggaaatgccatagttattctagccagtttccaatctctcttctctttttttgttttgtcaaatagggcagataaggcatgagaatttataactatgaattactgtcttttcccaaacagaaatcaccctatcagcttacccattgggagaaaaactaaaatagctccccctgaaattttacttcctcatttgggtcttgtgtgactgaaatctgtatacaatgccctagcaacaacggtttttacagcttgcctccctagaacaaacctaggagtctcagctgtttcaggaatgatttcttaaaggtaaagtgcctttttcaaaagaaattattattatttttttttaattttttttttgtgtgtgtgtgagacagagcctcactctgtcaccaggctggagtgcagtggcacgatctcagcacactgcaacctctgcctcccaggttcaagcgattctcctgcctcagcctcccaagtagctgggactacaggcacgtgccaccaagcccaggtaatttttgtattttcagtagagatgggttttcaccatgttggccaggatggtctcgatctcttgacctcgtgatccgtttttaaccaacatttaaacagaaatattcacaggcttaaagactgaaagttagtgatatcatcacatttccccttcaaaatgctgaatttataagcaaatttaaaagtttagaatctaccttttaattgtctgctttcatttttttgacagtggctttttttgatatggtgactattttgtcatgggtataaaaggataattcattttgtgttaatctgaagacatctgaaatactgtattcaactataagtacctttttttacatttataagattctttttcaaaatttttatttgaatagttttttgggaactactgaactaaactaggtggtttttggttacatggataagttatttagtggtgatttctgagactttggtgccacctgtcactcgagcagtgtacactgcaccagtgtgtagtcttttatctctcacccctcccactctttcctctgagtccccaaagtccattatattattcttatgtctttgcatcctcatagtttagctcccacttatcagtgaaaacatacaatatttgtttctccattcttgagttacttcacttagaataatggtctctggttccatcaaagttgctgcaaatgccattattttgtttctttttatggctgagtaatattccatgagggatatttaccacattttccttatccactcatgggttgatggacatttaggttggttccttatttttggaattgcaaattgtgctgctataaacatgcgtgtgcatgtgtctttttcatataatgaattattttcctttgggtatatacccagtagtaggattgctgaattaaatagtagagttctacttttagttctttaaggaatctccatactgttttccatagtgtttgtactagtttacattcccaccagcagtgtaaacatgttcccttttcaccacatccatgccaacatctattattttttgattttttaataatggccattcttgcaggagtaaggtggtatctcatggtggttttaatttgcatttccctgatagttagtgatattgaactttttttcatgtttgttggccatttgtatattttcttttcagaattgtctattcatgtccttataaacaccattatttttaagaagaaactttacaaaaatagaacataaccagatttataaagcatctgggaactcagtcaattaagaaatagctcaagtaactgatgatgcttcacctgaaagaaggcctggagagaacagagatactgtcttcaaatatctgaagagctaccatgggatgcaaagattgagcttgatggtatgactctgaagggcatctctatgaatgaaggttatgagagggtataaggaattaagagagacttttctaacaattaaaaggtcttttaggccaggggtggtggctcacacctgtaatcccagcacttttggaggctgaggcaggcagatcaccttagatcaggagttcgagacccgcctggccaacatggtgaaaccccatttctactaaacatacaaaaattagctgggtgtggtggcaggcacctgtaatcccagctacttgggaggctgagagaggagaatcgcttgaacctgggaggcagaggttgcagtgagccaagatcacaccactgcactccagcctgggtgacagaagatcaagattccgtcttaaaaaatataaataaataaataaataaataaatagtctttaaaattgtatagaagaagtagacttctgcttcctccaacaaaggattaactgctataggaattgccctctttccataaacaactagaaagcagacaaaatatatgaaacaactgttttcagagatcggatgacagacagcagaaaactgtagtccctgagtgaaggaaagaaaaaatgagataagccctatgattgctctagtttgctgcctggagccagtgtccaggcccctctgaaggcaggggagccctgatactgaactaggaaaagacattgcaagaaaagaaaactacaaacatctctcgtgaaatgcttaacaaaattagcaactaaaatctagcaatatgttaaaagtataatacatcatgatcaagtggggtttattcaagaaacacaggtaagctcaacattcaaaaatcaggcaataacctttactacataaataaactaaaaagaaaaaaacatatgatcatgtcaatggatacaggaaaaacttttgacaaaattaatacccattcatagttttaaatggaaagaaaagctctcataaaaataggaatacaagatgacttcctcaacctgacaaaggacatctaccaaaaattcttctgttagcataatatttcatgatagaagactgattgcttttaccttaagatggcgaatgtggggaggatgtctactctctctacttttgttccacattgtactggaggtcatagccagagaaacaagactagaaaaagaaataaaagacatacagattggaaaggaagtaaaactgtcttttttcacagataatgatcatgcttgtagaaaatcctgaggaatctatcaaaaacctattaaaactgataagtgagtgtagcaaagacacaggatacaaagtcaatacacaaaatcaattatttctatatactaacaaaagcaattgtacattgaaaaaaattaatagcatttataatagcatcaaataatattaaaaacttggaaataaatttaacaaaacaagtacaaggtctatatactgaaaactatacaatattactactggagaaattaaagtaaaccaaaataaatggagacataggccatgtttatgaatcagaagactagatgttaagataaccattctctccaagttgatctatggattaaatgtaatcacaatcaaaatcctggtaagctctctaatagatactaaaaatcttactcgaaaagttatagggaaatgcaaagaatctacaattgccaaaacaattctgaaaaataagaacaaaggttaaaaatacaaaattagccaggcatggtggcgcatgcctgtaatcccagctactctggaggctgaggcaggagaattgcttgaacccgggaggcagaggttgctgtgagctgagatcgtgccattgcactccagcctgggcaacaagagtgaaactccctctcaaaaaaaaaaaaaaaaaaaaaaaaaaagaccaaaggtggacttaacctacctaatttcaatatttactatatatagtaattaatacagtgtgatattggtaaaaggacagacatatcagtcaatggaacaaaatagagagtcaaaaatagattcacactgttgacaaagctaccaaggtaattccatgcagaaaggatagtattttcaacaaatagtgttgggacaattagatatccacatggaaaaagtatgaacctagacacacacaaagtaacttatatattaagaattaaaatgaaaggacttccaaaagaaaacagaggagaaaatctttgtaaccttaagttaggcaagtcttcttagataggacacagaaagcaaaaaccatatcataaaaagataaaatggatgtcatcaatatggaaaacttttgttctttgactttgtttaaaaaacgaaaagtcaaaccacagacagggagaaaacgtttgcaaaatatatatctgataaaggacttgtatccagtatataattacatattgctactcattagtaagaagacaatccatttaataaaaggcaagaagaagagacttgaacagatacataacagaagaagatatacagatggccgatgagcacagtcacaacatcattagtcatcagggaagtacaaattaaaacgataatgagataccactgcacaccctctagaatggctaaaattaaaaggtctgataaacatcaagtgttggagaggatatgaagcaactgaaactctcatatactgctatacaacccagaaatcctagacatttaccaaacagaaattttaaaaaatttaaaaatatataaagactcatacacaaatgttcatagcagcttgcttcataataccaaacctggcattctaaattttcatcagttggcggtggtatatttatacaatgaaatactgcaaagctatagaaaggaatggactactaataatacacaagaacatagataaatttcaaaagcattatgctaagtgaaacaatccaggcacaagaagaatacacattatacaatttcatgtatatgaaatttgagaaaaagcaaaactattttaagtagattcatggttatccatgggatgggggaaaggaatcagctgaaaagcgaactattttggcttataaaaatgttctcgatcttgattgtggtggtggttacgtgactatatatattcgttaaaatcaccaaactctaaactgaaaatgattgggttttattatttattaattatacctccataaagctgattgtttttatcttttatttttattttatttcaatagtttttggggaacagatggttttcggttacatggatgagttctttagtggtgatttctgagattttgatgcacctgtcacccgagcaatgtccactgtacccaatgtgtagtcttttatccttcatccacctctctctcactcttccccccaagtacccaagtccattatatcattcttatgactttgtggcctcataaaagctgattgtttttaaatacacacatacacacataaaagagaacttccagtgacaggaagtgttcaagaatgctctatttagtaaagacagaatcacaaaaccatcagaggtattgttgagtggattcttgtggtctataaatacctccatggacacccaggttagcaacctgttggagtttacgtgggacaatagcatcatcacaacagtcagcctagagaaatttacatcccaagttgtgtcagtagcaagtccctatcaatagcaactcaggctttgtgaggtctagctggctagaaatttcccacttggccttgcccatgcaacattgtgtaatattcttagcaccatctggctagccgatttaggcatcaacatcttcaagacttcttctcctcctccttataaaccttgctttcagaaaaggattagaaactcttccaatcacaaaatgattgctaaaactaaatatattacccctcccaatggtattttttggttagccaggatagagatataagtgaaaaatctatttccagtgttagaatttaaggcacagtgagaaagggaaggcatatactttttgaatgcaagaaacttcttcccaatccccctgaaattgcatcatttgagtaactatctcttccatatataaagtcacaacaatttctctctcagtcccagaactttgaagccttttcaaactttccttcttttggtatctaggaggaatacatttttgaagattgttcttggtgtctttcaggaaccaacacaatggagagggaagagagtgaacagaccaagaaaaggtaaatcctgaccctgagacattgatgagagaggtataatccccagagtgcctgttacttgaataggcttatgcctaacatatgttgagacctcagcaaacctgaactaatggagagggagaggaaaataaaactagttaagaactggaagaaaataacctgataatggatgacagggtatccaatgcacaatgcccagaaagcatgacaagctctgtcatggtcaagtaaaagtcaataccaaagacttcagaggtggtgaacatgggcttcatcttatctgccacagtaaccccagtacctggcacagtgcctagattagtgggcatcctacatgtgtggaatgaataaatgaagaagtggggaatgataacatgtttgcttcagcctgagcatcttagtatttgctatggccctgtttagatgttcttctgccacttctttacctcattcttcagatcttgcctcaagcagcactttcttaaaaaccctttcccaaactagaaaatgtcaacttgttacagtgtcatgtggatcccttggctttttcttaataacaccagattatgcttacatatttgtgtaattatcttattaaactctataaactagacttaactaaatcctatgaagagcagagaccataccagttaagctcatcattgtgctgctagcacttagcatggtgcctggcatatagcaggttctcaataaatgttgaaagaatgattgatgcatgatgaatacataaaagttcgtggtgatcagtcctttcacaacgtgaagctatcagatagtctgtacctctatccctcctgagaaattaagctctcaggaatatcaaggctctgactgcatacccataggatcaaagcaaccctcagtcacaagcctggtttcagagatagggtcataacccccagggtgcagagacaaccgagagtacccagcactaatccagatataccagccactgtgattctagcaacaaaactaataattccgggcacccttggacaatgagaaagggtgctgaaatcctgcctaccctgtcacactcagtttcagaaatggtctggaagagcctgcagagggcaggcagcagagaaccggcagagggcatgggaagggccaggcagaaataaagggtagctcttgaagcatagatgacagtgtagaccgtggttcttttctcttgctttctccacctttctcttcaatagtttgtttctcctcattgctgttccaatggcaacctctattctgccctatcattgaaatctagaaaaagaaagtagctcaaatgtgaaatatcacctaatcttttcttctatttctccagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtacctgtgactaaacaactacctcctcagtctgggtgggacttatgtatttatgaccttatagtgttaatatcttgaaacatagagatctatgtactgtaatagtgtgattactatgctctagagaaaagtctacccctgctaaggagttctcatccctctgtcagggtcagtaaggaaaacggtggcctagggtacaggcaacaatgagcagaccaacctaaatttggggaaattaggagaggcagagatagaacctggagccacttctatctgggctgttgctaatattgaggaggcttgccccacccaacaagccatagtggagagaactgaataaacaggaaaatgccagagcttgtgaaccctgtttctcttgaagaactgactagtgagatggcctggggaagctgtgaaagaaccaaaagagatcacaatactcaaaagagagagagagagaaaaaagagagatcttgatccacagaaatacatgaaatgtctggtctgtccaccccatcaacaagtcttgaaacaagcaacagatggatagtctgtccaaatggacataagacagacagcagtttccctggtggtcagggaggggttttggtgatacccaagttattgggatgtcatcttcctggaagcagagctggggagggagagccatcaccttgataatgggatgaatggaaggaggcttaggactttccactcctggctgagagaggaagagctgcaacggaattaggaagaccaagacacagatcacccggggcttacttagcctacagatgtcctacgggaacgtgggctggcccagcatagggctagcaaatttgagttggatgattgtttttgctcaaggcaaccagaggaaacttgcatacagagacagatatactgggagaaatgactttgaaaacctggctctaaggtgggatcactaagggatggggcagtctctgcccaaacataaagagaactctggggagcctgagccacaaaaatgttcctttattttatgtaaaccctcaagggttatagactgccatgctagacaagcttgtccatgtaatattcccatgtttttaccctgcccctgccttgattagactcctagcacctggctagtttctaacatgttttgtgcagcacagtttttaataaatgcttgttacattcatttaaaagtctacattttctgctttggcttcaagagtactactcaacccttgtggtctgatgttccctgctctgtcctctgaatgtacttcctttctctttacatctctatggctagaagcctctcacgcatcctgtatcttctcctcctcccttttccctaccattatttgagaaaggaggcttgtatacttctatatgtttatctcagtaataagtcataaaaaatcaagtaagaatggttgtttttgaggacaactaagaaatctggaataaggaagggaagcttacttttgagtttgtaacctgtagtgtgtaattttttaattatgtacttacatgtacattaaacaaaagcttaatgtaaaaatattccttgaaaacaccatgattataaaataaatgcatatatacatacagcatgtgagaggagccaggaaaactctggaaaaaagaaaattacctagactctgtgagggcaggaatgtgtttaatttctctccaatggatcctcagacaactaagatagttgtctattctattgtccatctttttgtcttttgttgtatttcttaaagattccctcaactttatcttctaacttctgttgtatttttatttctgctatcatgtattcttttcagaattcttttttgttctctcaaaacatatctgtttaaagattgaatgaaatattaacatgccctttggtgagaacatccctcctttgtatattaaattctctgaactgctgtattctaagactaggggaaagaaaaagaaggttgaaagaggtcattaggcagaatagtactagctaacattatttcacatttaccatatacccgtcactcatctaaacctttaaactcattatcctatttaatcctcacaatgaccctgtgacgtaggtaatggaatattatgcccattatgctgatgagaaaatataaacacagagataagtcagagtaatttacccaacattgttaactttgtaagtggcagagctttgtaacaggcagaggttggaacagtttggagggctcagaagaagacaggaagatgtaggaaagtttggaacttcccagagccttgttgaatggctttgaccaaaatgctgatagtaatatggacaatgaaatacaggctgaggtggtctcagatagagaagaggaacttgttgggaactggaataaaggtgactcttgctatgttttagcaaagacactggtggcattttgcccctgccctagagatttgtgggactttgaacttgagagagatgatttagggtatctggtggaagaaatttctaagcagcaaagcattcaagatgtaactttcgtgctgttaaaagcattcagttttatgtattcccaaaaatatggtttggaattggaacttatgtttaaaagtttggaaaatttgcagcctgacaatgtgatagaaaagaaaacccattttctgaggagaaattcaagccagctgcagaaatttgcataagtaacaaggagccaaatgttaattgccaagataatgggaaaatgtctccaggccatgtcagaactctttacagcagcccttctcatcacaggccaagaggcctaggagggaaaaacggtttcctggccaggcccgaggccttgctgctttgtgcagttttgggacttggtgccctgcatcccagccatggctaaaagaggccaagatacagttcaggtcatggcttcagagggtgcaagccccaaggcttggcagcttcagcacagtgaacctgcaggtgcacacaagtcaagaattgaggtttgggaacatccccgtagatttcagaggatgtatgggaacacctggatgtccaggcagaagtttgctgcaggggtagagctctcatggagaacctctgcaagggcagtgcagcagggaaatgtggggttggagcccccacacagagtccccactggggcactgcctagtggagctatgagaagagggccaccatcatccagaccccagaattgtaggtccaccaaccatgcgcctggaaaagtcaccgacactcaatgccaacccatgaaggaagtcaggagggggctgtaccctgcaaagccaaagaggccaagctgcccaaggccatgggagcccacctcttgcatcagcatgacctggatgtgagagatggagacaaaagagatcattttggagctttaagatttcactgccccactggattttggacttgcatggggcctgtagcccctttgttttggcaaatttctcccatttggaatgggtatatttacccaatgcctgtacccccattgtatctaggaagttactaactttcttttgattttacaggctcataggcggaaggtgcttgccttgtctcagatgagactttggacttgggacttttgggttaatgctggaatgagttaagactttgggggactgttggaaaggcatgattgtattttgaaatgtaaggacatgagatttgggaggagccaggggtgaaattatatggtttggctgtgtccccatccaaatctcatcttgaattgtagttcccataatctccacgtgttgtgggagggacccagtgggaggtaattgaatcatgtgggcagttacccccatgctgctgttctcatgatagtgagtgagttctcatgagatgtgatggttttataagaggcttttctgccttttgcttggcatttctccttcctatcatcctgtgaaagaggatatgtttgcttccccttccaccatgatttaagtttcctgaggcctcatcagccctgctgaactgtgagtcaattaaacctccttcctttataaattaaccagtcttgggtgtgtctttattagcagtgtgagaaggaacaaatacattaacccaggcttgaaagcaaagagtcatctctgatgactgcattcaacctttccctcagcacccactgctcaccccttcgctcctgcctcattctgttatcagtcatcactaggccaggaaagcattcctcccactttcacacccacctcttattttctcattcaggaccttttttattcataccaaaaacatgtcagtcacctcccaactgatcccagtctcctatctctcttacccttcattctgtccaacacaccaagagaaacaagaaggtaaatagtgaaaaggtctccctcacattccctttccctagccacacaactctgatctccagcttcctgggtatccattcgtagtcacagtatgcctatttttaagtgtgtgtacacacacatacacatattccccttactcaggcagatttggttttactttacactacagtctaaagaaatcagaatactcttgctaggatgattgacatcagtcttcagtgtaatccttcatattaaaaacatacatctgtatgtataagttttcattctcaccaatattctagcatcattgtggatcttataataaaagtgagattccattggattttattatgtctacctgttcacttcagaagaaaagatacttacagatatagaatccttcactgtccttagtcacaaagtttaaaacctgctccaatctgaacaagttacaccctaggtctggtgagcaacagttaccctgaagggatctcccaattcctatgtccatatagttgtctttcttgatttaccccctcactttggtggtgcatatccttcagtagcttgatccagcagctttctgagaaaggatctgtgggaaatatatttaatgaaattttatgtatctgaaaatgtctttatcttactttcctgcttaactattaataattttgcttggtataaaaatttgggttggaaattattttcattgtccatagtttccagtgttgctcttgagaaatctacaaatattctgactccttatctttttacatgaaagcttttagaatctgctcagtgttctaagattttgtcatgaaatgcctgtttgtccattgtgattaacactcagatggacttttcttctggaaactcatgtcctttcctccagggaaattttcctgaattatttcattgattatttttcccctctatttcactagtctctcattttagaatgtcagattcctgaatgttgaatctcctagactgatcctccaattttgttattttctctcctgttgcccatattttgttttttgttccatttcctagagattttctcaagtttatcttccagcctttctgttgtactttttacttctgctatcatgttttattttcagagctcctttttgttttctgaatgtttctttttgcaaggagcctgttcctaatggttgaaatattatctcttaactctcttaggatattaacgattaggttgtttgtttttaaagttttatattccaagttatttcttcctgtttgtttgctttgatctatatcatccatgttaaaggattcccagctgtctgatgatacttgactgtctgttcacaattaagagtgaaaaactaaaagtttggaggatctgagtttatggatgggtttgtcaactttagcttcatggtagagggatctggagcaagacatttttaggaaatcatttttagatcttcttttttgagctggtaatttttcagtatcttgcttggaaggtagaggtatagctgctagtattttgggagccaagtgagagaagaggggtgggtgtgagtagtgatggaacctctgcattccttattcagtatgcataaatgtacttactccatgtgtttttagtacgatagccctatcgtacttgtagcatgtggcaaagtggtttctcttcccgtgacctgattataacattgattcagattaaacattgtgaactcagtttcctaaatataccaagtacaaagtaaaagtcactaaattgtcctaacagtttactagaaatggaagaaattcagaaagcaatgaggagaaccttcccattgtatgtggtacatgagggcagagaagggagtaattcacccaacaccaaaaagagccatgaccagaactcaggttcctgatttttcagtccagggttcttcccaccccactgtgcccctctaaacttcttgttaactggaagagctggaaaatgggtgtcaacagagcataatgaaggaagatcatggactttaggtcagatagacctgacaccactacacttgactgtgtgaccttgggctaattacttaatctctgattttcagttttcttatttgtaaaatagggataataatatctacctaccttacaggatcaagggcaatccaaaagataaggattatactgtttaaaaaaggaaaggaaagaaaaataaaagagccacaacaaacaagcaattgggtagcttgtttcaacagggtgggcttgaggatggtgagtgagaattagtagtgggaggatggcaacttcaagtgaggctgatgtagggaggcagttgtaggttgggctgtacatggcattaacaggcgtgggcttggattctttcatataacactcagcccagaagtcttccaaacaccctgctgaaagccagaaatgctcctacaactcctcctgcatcagcctcacatgaagtcccactctcaggatctcaacttagggactgagatgattcatgctctcaccttatgcacgtggaacttttccaactttaccttctgagaccaaagccaagttcctgggacctttatctttcctttgtcaagattatttccagacaatcaataatatctacttctttgtgaagataacaggaagctcattccttactaaatataacatgaaattctaagcagttaagctgagaataaaaaggaccaaaggctcccagttaatatttcggaaagcccttgtcttgaggagcagccatgtagaggatggtttgtatcagggagggccgtgcaaattggaggcaggtataccaattaggaaacagacatagttagcctcaacaagtttggcatttctaaggagctgaactagcagaagcctcctgaaatttctagattagatcctggtgcccaggcttatcagaccaggagcagggcaaagtagactccataacaaaagtaaactcaaatcagagggaaatggaaactaacaggagctgctttattggagatggaccacaggagctttctgcactcaaatgatatggggaaaaagaaatcctaaaatataatgttggaaaagttggatagcccaggcatagctagcagattggaaatagtattaggaatcacagttttttacttagtcaccatgttgaaaagatccttttctttagcatagacccagcacaggggtgaggtaggggctaatttctggcatgagagaccagaggcacagagtatggagcaagaagcaggagctgattgctttcagatcactaactgccaaataattaaaacattttcttaaattcatattttgcaacccagaacatatacctgaagcttattattagaacatattagggtatagttacaatgctaactggtgacacaaactagttacatgctgtttccaccagtctatctgccactttttaactacacacatcaagtatttgcccccaggtttcaggtctcaacctctgtaagaacagttgagctgtgtccacttgacggaaaaacaagtctattacactttttgtttcaaaaagtcaacccatccaatcaaataagttcctttacacatattttaaaaaacacatttactagctttcctccaattttcaatgtgtttattgaactctcttggagttacagtctgggagtatttttgagactcctgttatcaatttaaaaagaaaagaaaaggaaggaatgcttttttaaaaaacaataaatcttgttcctgtgtctaaaccagccatgcatattaacgtgtgtgacttctcagagtttaaagtgttttagctgggaaaaaatatattgtagaagacttaaagaaacaagatggcggccgggcgcagtggctcacgcctgtaatcccagcactttgggaggccgaggcgggcggatcacgaggtcaggagatcgagaccatcccagctaaaacggtgaaaccccgtctctactaaaaatacaaaaaattagccgggcatagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaagaaacaagatggcatagcaatgagaattttaagagttttcattctccctgagaaattacttatatggagaacttattaggagtggtttatttgcagcaggaaatacagttatgatataagaaaactcttgatcatcagggtcttaggcattagaaacactcagatgctatgatcctatatctagaaaaccccatagtctcttccaaaaggctctggatctgataaacaacttcagcaaagtttcaggactcagaatcaatgtatccagggtacaaagtaacatttttatataccagtaacatcgtacataagtgccaactcaagaatgcaatcccattcacaattgccacaaaaaaaataaaatacagctaaaccagggaagtgaacaatctctacaatgagaattacaaaatactgctgaaagaaatcagagaagatacaaacaaatggaaatatatcacatgctcatagataggaagaatcagtattgttaaaatggccatgctgcccaaagcaatttacagattcaatgctattcttatcaaacaaccaatgacatttttcacagaattagaaatatctattctaaaattcagatggaattcatgcaaggcagatgagcctcaaattggggcttatcctgggagagtccttggctttgctcagtaaagaattcaaaagtgagttggtggctcatgcctgtaatcccagcactttgggagtccgaggcgggcagatcacgaggtcaggagatagaaaccatcctggctatggtgaaacccggtctctactaaaaatacaaaaaattagccaggtgtggtggctggtgcctgtagtcccagctacttgggaggctgaggcaggagaatggcgtgaacctgggaggcagagcttgcagtgagctgagatcacgccactgcactccagcctgggtgacagagctagactccgtctcaaaaaaaaaaaaaaaaagtgagttggtggtggaagaaaacagctttactgaggtggcagtgttacagctctgtgactgcccctgcagagcagggctaccccatgtgcagtgtgctgagagcagtagctcaaaggcagtgctgcagtcatatctacttttaattacatgcaaattaaggggtggattatgcagaaatttctagaaagagtggtaacttctgggttgtcaggtcactgccatgaaaaggggcagtaacttgcaggtgttgccatggaaattgtaagctgacacagcacactggtgggtatgtcttatggaaagctgcttgtgccccatccctagggcatgtctcaattgagctagtcctcaatttggcctgatgtctgagcccagagtccagtcctgcctcccacttcagaatcaaaaaggagccgaaatagccaaagtgatcctaagcaaaaagaacaaagccagaggcatcacattacctgacttcaaactatcctacaaggctatcataacccaaacagcatggtactgttacaaaaacagatagaccaatggaacaggttagagaacccagaaataaagccacacacctacaaccatctgat

SEQ ID NO: 1079 - DNA, 1600 bp, Homo sapiens
aggagccttaggaggtacggggagctcgcaaatactccttttggtttattcttaccaccttgcttctgtgttccttgggaatgctgctgtgcttatgcatctggtctctttttggagctacagtggacaggcatttgtgacagcactatgggactgagtaacattctctttgtgatggccttcctgctctctggtgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgacctgctcatctatacacggttacccagaacctaagaagatgagtgttttgctaagaaccaagaattcaactatcgagtatgatggtattatgcagaaatctcaagataatgtcacagaactgtacgacgtttccatcagcttgtctgtttcattccctgatgttacgagcaatatgaccatcttctgtattctggaaactgacaagacgcggcttttatcttcacctttctctatagagcttgaggaccctcagcctcccccagaccacattccttggattacagctgtacttccaacagttattatatgtgtgatggttttctgtctaattctatggaaatggaagaagaagaagcggcctcgcaactcttataaatgtggaaccaacacaatggagagggaagagagtgaacagaccaagaaaagagaaaaaatccatatacctgaaagatctgatgaagcccagcgtgtttttaaaagttcgaagacatcttcatgcgacaaaagtgatacatgtttttaattaaagagtaaagcccatacaagtattcattttttctaccctttcctttgtaagttcctgggcaacctttttgatttcttccagaaggcaaaaagacattaccatgagtaataagggggctccaggactccctctaagtggaatagcctccctgtaactccagctctgctccgtatgccaagaggagactttaattctcttactgcttcttttcacttcagagcacacttatgggccaagcccagcttaatggctcatgacctggaaataaaatttaggaccaatacctcctccagatcagattcttctcttaatttcatagattgtgttttttttttaaatagacctctcaatttctggaaaactgccttttatctgcccagaattctaagctggtgccccactgaattttgtgtacctgtgactaaacaactacctcctcagtctgggtgggacttatgtatttatgaccttatagtgt

SEQ ID NO: 1080 - protein, 323 aa, Homo sapiens
MGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 1081 - DNA, 43799 bp, Mus musculus
  misc_feature (1)...(43799): n = A,T,C or G
aagtatctgaaagacacagacagggcggagggctggaagggacatgtgaaggaccgaggcctggtaccccttttctgaagacagtgaagccccaattccagtctctgcaaggtagaaatttcaactgcagtccctgagaaagagattccagttgccacaagcctccaagagaagtgattccaatatccacacgtctctaggaaaccacgactcaattcccactagtcccatgtggcattgattcccaaggaaactcttggttgtttttggagataatgcaaccccattggcacctgaggtcagaaaccataatccccagtgaactctgggaaataaagaccctacttccattagcacattcccccacccatagcccaagcctctaatctgttcagtagcctgtgaacaaatccaagttcgcattcacttttgggcagtgacaattacagtatacaccaaagataaatgaaaactcccatcaatgtaaagaagtttaaaacaaaacaaaacaaaaccaaacccctcccaactcccataagcctctgggacacagatggtcccaattcccatcagccacctggattctagagaccaccaaatcccatcaggctctgaaagattaaacctccagttccaatcaattcccaggaaagaaaaagtcgatttttgagctgttggacagctagattcccatgtgaagcacaaactctcatgagctctgtcagctttgatggtggagtaggaatggtaaccatcaattgtgaagacagtggcttctccttgcctccacacctgggaagcctaaggactacaactcccatgaggacccggggctgcacattgcttccagcttggggaaacctattcccccagtctgatgaatattggagtagtggctttatcttacaccctgggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcacaaagagtcattctctgaacccagacagctgatcccacccccatcttaactggatggtaatggacttcgtgatactgacacaggactccaggaggcctactgttggggtggccagccttggcatgggaagtgatgttgggataggagagacctcaggtgtcctagagtgagaatttggaaggatcctttaggcttctaagctaatgtaaccttaattgctttaggaagaaagaggcaggaagttgaatttggtggtacaggctggtaacctcagttactcgggaggctgaggtagagagatagcagcaagaggcacagcttctgctctgcactcaggaccactctactctgttgtagtatcaggcagagtgtagactggggggatgttcctatacccaagggaaggactaagcattcagtgatccaacctaaaagttaaaaacagtgtagctgaggatgaccttgacctcttgaggatgaccttgacctttggacagtgcggcctcagcttaacagagctgggatgatccttgagggctgccacaggcttatgcagtgctgggggctggactcagggcctcctgcattccacaggagcactctagcaaccgagttacatcgctagcccggaagcttgtgtcctgtttctggagcggtgtctacaccatggagagggaggacggaggggccgggtgtctataaatacctacaaatatttcttgttctcgtagacgtcgtggagcttgagcacgtgcgggtgttcaatgagcttcaggatggcgatttccctctccacctgaggggccagggatacaagagaaagggtcagcatcacctcccgcctttccttctgcgccaaaggacactctcgctacacacacacacacacacacacacacacacacacacacacaaacacccaccttcatcagcaccgattccgacagcttctccctgttcacgatcttgacagcgaccttctgacccgtgatgcagtggactccaagtttaactagacctggagatcggatttaaaatatggggtgttctggagttcaccctagctctcaagttgtcaacacacccccatcctcactcccagcttggttacccatttcttctatcccgaatttctgcatttgaactggtagccaacagctgccatgcctacaaaacacaactctttcctatgcacgttgcccacttttagtccttctgactgtctgccctttgccgatcccctccaccagcctctcctggccttttattctgactctctggccttctggtatgtctgcccaacttcatctttcttttcagatttcagaagccctataatcttacaaaacacactctcaatttttcttctttcccaagcctccccatacaaagtgagttccaagacagccaaggctacacagagaaaccctgtctcgaaaaaccaaaaaaaaaaaaaaaaaaaaaaaagctgtcatggtcagaaagcatgcgtattccctgaccactcctcagatccagagctcagctatggaaggtgcctcttctcagtcccaggaacccagatcttacccctccgtccttagacccagtagtcttggccccagccctcgtccctcaggcccagcagtgcaggtacatggccccttctccttccaaagttcaagaattgaggtcaacagcacgtcacactcttactaccaggatataaaggtctgacctccctttcctatctcaggcctggaactcaacttcatagggacccagaacccacagcccagaacactggaggtcatccctcagttcacctcgatcccctgcctagaagaagatggttgtggccacactcagcctttagcatcaatcaaagataactctgctttccagggccacttctggctgggagcttagctttctacagtccacctctccattctatttccacactgcagaatggagagaatgtagtcgacctcacaccctagggctccagcttgctgcacggagcgcaagtgaccgcttttgagcataagagggacaggatagcagcctctctcgggatggatgcacctccacccagcctgcacctccaccctgcctgcggctgtactgcagcacccgcctgcctcagcttgcagaatcagcccaggtcccacacccgtaatgggcctacttccccacagcttcctgaagcccctccaatatctgccccaatagggttatttgagccacagtagtccagacccctacttctccctggaacccacaagtctcagacccctgccatctcaaggccccaacgtcagactctactccgtacaccgtgggcacttggaactcaggacccaagccccttttctacgagggacccaggggtctgccctttaaatatccatggtcccgccctctgccccttccagcaccccgcccccgccccaggtgtccgcttaggttctcacctgtctgtcctttgcccagcgtcttctccaggcgataggggcccacatattgggcgtgctggggtgggtgtgggtgtgggtgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccagcccgtccctggccggccccccccttcctgtgcctccccctgcagggggggtctgaagtgtggggccggcggatgctgcaggccgagatcccccccgcccccccacgcgccctctctcctccgcctcctcctcctctccgcctccccccgccacctcgtcctttctctccggcacgctgacatcaccatccggggactcccggcccttccccacagttaaccctttcggagggggagggggagtggcagggggcgggcctggaagctggacggacggggaggaggtgggaagatgctgggatgtatggatgggtggagggatgctggaggagaaggatgctgcaggagagagggatgcctgaaaggatggagggaaggatggagagagatacagaaccagtattagacaagcagagatgaagacacaaagagaagtctgacatacattagtagatgggaagatgcagaatatcagagacagggtggaggagtgaaggaggtaataacggagcggggagaattaagagttcaaggccattatagctataaagtgtgtttgaggacagcctagactacgtgagaacgccccctcaacccaccccctcaaaaaagagctgaaaggggcagacagggataggagacaaacaacagacagggatgaggagatagaaatgcaaaggaagatgtagagcgagggggacaaagagaaataaggactgtcaagggtccatatattcacaggagggaatgatgctgggcttagatgggaacagactgtggagtgtgtgtgtgggtggtggtggtggcagaggataaaagagacaaagatagaaaagggaaggactttggggagttggagacctaagtgtgatctatttctctatgtcctctaaggtcaacactgtgtactccttgggctaattctatgttcccaccgttatcagggctccacgttctgctcttgtttttttttttttttaagacaaagtccagctgacctcaaactatgtggctgaagatgaccttgaacttctgatcctcctgcttctgtctctcaagtgtgaaattacagtcctggagagatgattcagcagttaggaagagtaggctgcttcccagggactggggatttgcattctcagcatctatacagtagttcatggctgtatgtaactccatctggtttccggggatcaaagtacacatgtggtacacatatgcacagacagttatccatatgcatatttcttccaactcctttaaaattgtttaaaaacagtccgataccaccatgctttaatgtctcctataccttgataggtaggcagatagatcccagtgcaggctggatgtgtaatgtttgcttgttaagtcctgtaaacttcaggtaggcctcagtataatccatgtgcctccgtgggaggaccataggtctgcactcagccatgaggaatctggttcctattaagcttccatataagccatagccttctttatggcaggcaccctaagttgttaggcatccattccatccccaagtttctcacagggtgcaccaatgcaaattggtgctcctctgaagtggtaagcctatcaagccatcttcatttcagtatcaaatctgagccatacactgttctgaatggtaaggatatggcagggtgctaaatctacaaaattcctccccgggacagccatggctacacaataaaaccctgtctcaaaaaacgaacaaaacaaagcaaaacaaaaaaatacatagttttgaaaaaatttcacacatgtctataatgtagtctggttactctccccacatctgtaatttattatttgtatgtgtgtgtgcagatgtgagttcacacgagcgcataatgtttgtagaggacaaaggctagcctctagtgtccttcctcatgagctctccaccttgggtgtttgtttttggaaacagggtttttctgtgtagccatggctgtcctggaactcactatatagactaggctggaatcaagatacaccaggatgttgtagatctgtaactgagagcagagtacatactttaaactcagcactcatcatgcagatatggtcaaacttctgtgagtttagcaagtcccaggccaaccaaagctatatagtaagaccctgttgtgccccctccacaaaaaaaaaaaaaaaaaaaaatccttaactgaatctcatcttcaaaatttcttctggcatataaggtcatatatttataggttctgagaattagagctagaatgtatgtgtgtgtgtatgtatgtacatatacatacatatatatacattatatacaacacatatatgtatatgtatgtacatgtgtctatgtatgatgtatatatgtctaatgatatatgataccacatagtataaatgtacatagtatatttatatgtatatataaatattaaacacatacacaccatgatgatagcctagatgcaagctccttgcatattatgaaagttacagtatgatacatagatacatatatagagataaatacatttgtaataacctatacggaatgtgatcatatagcttttccatctctactgagattctttagagtaagaggactcctattaataatagcatatacctgtaatcacagtattcgagaggaagaggaattcaagatcagaccagatatatagcaagttcaagaccagcctgggctacagagatcctttttaaaaacctagagaggccgggcgtggtggcgcacgcctttaatcccagcactcgggaggcagagacaggcagatttctgagttcgaggccagcctggtctacagagtgagttccaggacagccagggctgtagagagaaaccctgtctcgaaaaacaaaaacaaaacaaaacaagaaaacctagagaatagggttagggaaatgacttagttagtaaaatatttgttgcacatgataagggacctgagtttgagtctcagcacccacagggtaggtgtagtagtacatggttatagagaagtggaaacaggaagattctctgggattcaatagccagctggcataatctaacgggcaagctccagggtcagtgacagaccctatctataaaaaatagataaaaataaaaggtaaggctggagagatggcttagcaattgagttctattctttcagaggacccaagttctgttgccagaacccatgtcaggaagttctcaattactggtaactccagctccaaggaatacaaaaccctcttctggcctacacatatacacatacataaagagtctggatcaggtgagattgctcagcagtgaagagcatcgcctgcagccagacagtggtggtgcacgcttttaatcccagcacttgggaggcagaggcaggcggatttctgagttcaaggccagcctggtctagaggacagccagggttacacagagaaaccctgtgtcgaacaaacaaacaaaccccccaaacaacaaaacaaacaaacaaacaaacaaaccgcactgactgctcttcgagaggtccagagttcaattcccagcaaccacatggtggctcacaactactatctataacaagatctgatgccctcttctgtcatgcagatgtatatgcagacagagtactaataaaaataaataatttctttttaaatacaaaaatcaagccaggcaatggtggcaaatacctttaatcctagcacttgggaggcagacacaggtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggtgagtgtgcatacttttaaaaaatatttatttattattatacacatgtacactgtagctgtcttcagacgcaccagaataaggtgtcaaatctcattacgggtggttgtgagccaccatgtggttgctgggatttgaactcaggacctctggaagagcagtcagtgctcttacccgctgagccatctcgccatccctgagtgtacctacttttaaggcgtgtgaatatttatgagttgtagggcaacctgctcacatcgttctgcaggcctgcccaggctacatactgagagcctccccaaaacaaaacaccaaaataaggaaccatctccaaaacaaaaaacaaaagaggggtggggtgggacggagagagagttcaatgagagatatttcaatgattaggaactcttgttgctttattgctcttgctgaagactcaggttcaactcctagcacccaattatgatggctcacaaccatctgtaactccagttcctggcaatccatcaagcaagcatacagtgcacgcacatacatgcaggcaaaatgttcagggtcagtggtggcacacgcctttaatcccagcactcaggtggcagaggaaagtggatctctgtgagtttgaggacagcatggtctacagagtaacttccaggacagccaaggctataccgtaaaacactgtctcaaaaaacaaaacaaaaactaaccaaccacaaactatttgtacacaagtaaataggtaagtctacaaaaaaattaaaagaacaacaataatttaagaggctgaagagatagcttgtcattaagagtacttactgttcttgcaaagagcctgagcttggttcctagcacccatatatatatatatattggttgtctcataactgcctgtaactacagctttagtttgtcctttgtctctggccccatagaaacctgcatttacaggcatctgcctcctcccctactacataattaaaaacaatctttaaaaataaaatctagccgggcagtggtggcccacacctttaatcccagcactcgggagacagaggcaggcagatttctgagttcgaggccagcctggtctacaaagtgagtttcaggacagccaggactacacagagaaaccctgtctcgaaaaacccaataaataaataaataaataaataaataaataaataaataagtaactctaaaaatatttttaaaatgattggaagatcgaaggtggaagacagctgatgttgacatgggacttcccacacaccatgcatagtcacatgaagacacacaactcacacagagtattccacactgaaaccggtaataaatggggaaactgaggcctagaaaaaagtgagcccgagtctcaggttacaaaggtgggatattaggggagatatcccgagactctaggagcaaatgcagttaaaatcagttgagtgaggaacaaaaccgtctgagcagcagcagcagcagcagcagcagcagcagcagcagcagcagcagcagcagcagcagagaaggggcgtggcctacgcaggggcgtggccgaacaggacaagctgaagttccaggtactaagaggcgggacttgactgggacaggccgaaaggcctagaaaagaggcggggaatatgggcataggcggggcctatgcctgggaggggaggagttcgccatgaaagtcccttgtttgctaagataaacagaggagctagggggcggggcttataacaaaagcgcgaaatgtaggggcgtgacaaagagaaagtggtgggggcctagtcgacagaggcggagctaagtgccgcatccgctaagaggtgctgcttagaactgggcaaacagcttggggtgaggcacttccgtgtgagaactgcgtatttccggtaaagatggcggcgcccagtagagtcaggtgcagcctagtctatctttaggcgtggtggcagctctagacccggcaaggtgagatcagccccattggggcgcccctcttcaaagacacgggaggagaattgttgctaaggagactgagcgaaggcttgttgccatggaggcggggcagtggggttgctaagagacgaggacgcaagctggggagcttgggggggctcgttgccagggagtaggtggggcctgttgctagggagcaaggagggacatctggatttgggcaagggtcctgttagtatgaaggaaggaaagggggctatggttaaggtggttgcaggcagaatggtttgggatcatgagaagactcctaacaccttcaaaactccaccttctcagcagaccttcaagagtcgacccatccggacaccattgctgcctcagcggtgaccatcaatttcctttaaacacattcttccttcacagaaagtccatggcagacaaaggctcagggggcagtcgcctccctcttgcgttgcctccggcctctcagggttgctcgtcagggggcagtggttcctcggcggggggctcaggcaacccccggcctccacggaacctccaaggcctgctgcagatggctattactgcgggttctcaggagccagacccccctccagaacccatgagcgaggaggtaaagtatgaggacctaagaaggttgggtgagggtcctgaggatctaagtgtcttggggagagtggcttagtgagctacaagctgttgtcttcctgggtggtgagctagagtctaaatgtggcatcatgatagggtgaaggtcagctgtaaagtgtccgatcgcagccttgtattgggaagtctcatgatgagtgaaaagtctaaaagcaagctgggttctctagacccaggcagaactagattcagctttgtctccacaagtgtgaccttgggtatattatttaatctttcgaatcctcaagtgttcgttcatttttgaattgatggtgataatagtaatgatagtgtcttatcaggcaattctgatgttccagtctatactgactcgtacacaacgtagttgggttttgccagttgccagccatgaccttggttgggcaattcacatcctttctttgcctctgattttttttttttaatcaatgaatttggaatagctataataaaaccttacagaattgtcttaaaggttgataggaatttttcatgtaactttttttaattgacatttacgatacatagaatattgtagtaattcagttaagttacagaataatttatacatgttgtgtcatgttgtgccaaggtggaaataggcatagagcaatgagatagtttgcccaaatttgtccaggagcgtgatttcaaagccttacagcttcttccccttttctttcctgttttgagattgcggtctcaaacagaccacgctagccttaatgaccttaccctcctgaccttcctgccccacctccaaagtcttggacttacagatatatggtagccatttcagtcctcctgaagcgcccttttggggacagtgtagtttctggtcttcctctggactcctttcttttgttatctcttgttctcctcattctctatcttttctggctttttttttttttttttttaatttctccagacgacagttggcatggctggagagcccttcttgttccaacttggtagcaagtgcagaccagggatactattcaaacctcatgtagttctcaggacttttgtcacaatacagaaccatccagctcaccacagcctccggttgtatagctgatcctcaaacctgacatcttttgggaaatgggcgggacttgttgctgaggacagaacccctgtatcagcctgactcctctttctcccctcctcccttagctcaacagttggttctctcttcagagtccaggatctggccatatttcacactgatacacagatgaggttgttcttgaacttgcttctgcctccatcccaccccgtgctgggattataagcatgtgccaccgaaacctgctccataaacttttctcttgcatggactacttagaatcctagtaagcgctctttccctgctcctatgcttctcagtccacctctctgcctctcctcgggagaactcccttcccagctccacccacttcattcagagcagaatctaggcctttgcatctgtttgtaagatccaacttgctcctttcctggggtgtttctctctcctcaacttttttcttccctcacttaaccttgcttcagccaccttggcttgctggtgattgcctctgtcttgaatattcttcctagtatatgcttggctattccctggcctatttcattgctgacatctgaccctccaagatgaccccgtttaagttctacaggccaacctccactcccatgatcctccattgtgcttaatcttacttaccctatagcacttgtcatattgccatctcctgtcacactacatgttttgttttgtttgttttttccctctagcttctctctgtgtttgtcttgcacacaccctgaacaacacttttttttctctaatcagtctgtctcaggactgactccctagaacctagaaaagaagttatgagtaaaaactgtgtaaacatctgagtgtggtggctcttgcttgttaatcccagcacttgggagtctgaggcaggaaggctgctgtgagcgggaagccagactgcactatagaatgagagactcctgtgcttcccccaagatgtctcctagatacttgttgatggaaagagccatcagtccttgcatttggctgtcctattagtgtcactccctgggcagtcactgagagacatcttctacccccatccttctcccttcttccctagagacgccaatggctgcaggaagccatgtcggccgccttccggggccagcgagaggaggtggagcagatgaagaactgcctccgggtcctgtcccaggccacacccgcaatggctggcgaagctgagctggccactgaccagcaggagcgtgaaggcgcactagagctgctggcagacctgtgcgagaacatggacaatgcagcaggtaccctcctccctcagtactccccaggctgtcccacatgctgtctggctctgccctttcccaattctcctgtattgaaccagcagctcctcccaggaacaaagccctcctcataccccaccaagtccctgtggtgacagatttgttctgctacttcccgaggagtcctgggactgatgttgactccctaatttgcttgctactctctcaagggaagggaggtggtttgggatggagtggtaatctgaggccgcctggaagtagagtgtttgatcagagacctgagtgagggtatttcatggggtatatcacctgagtgagggtatatcatggggtatatcacctgagtgagggtatgtcatggggtatatcacctgagtgcgggtatatcatggggtatatcacctgagtgagggtatgtcatggggtatatcacctgagtgagggtatatcatggggtatatcacctgagtgagggtatgtcatggggtatatcacctgagtgagggtatatcatggggtatatcacctgagtgagggtatgtcatggggtatatcacctgagtgcgggtatatcatggggtatatcacctgagtgagggtatgtcatggggtatatcacctgagtgagggtatatcatggggtatatcacctgagtgagggtatgtcatggggtatatcacctgagtgagggtatatcatggggtatatcacctgagtgatggtatgtcatggggtatatcacctgagtgagggtatgtcatggggtatatcacccgagtgagggtatgtcatggggtactcctgctttacaaaaggcattcgaggcagtaggaatagctagtgcaaaggttgaggtaggatggtgctactgtgatcagaacagacagacatcctcctgtcaaaggagtgggacggacacgtgtaggtctagggtaagcaatgacattgaagtatccatggtcaaggtgcattctgtaggtcacattcatatgtatgtatgcatgtatgtatatataatttatttatttttaaatgagacaagatctcactatgtagacctagctggcttggaactctgtggtccaggatggtctcaaactcacaggtattttacctgcctctgtgtctcatgtactaggattaaagggggatcaaagacatttgctaccacaaccagctttttttccttcttttttaaagatttatttatatgagtacactgttgctgtcttaaagaagagagcattggatcccataacagatgattgcgagtcaccgtgtggttgttggaaattgaacttaggacctctggaagagcagttggtgctcttaaccacagaaccatctttctataaccaccccccctttttcccccttttttatgtatgtatgtatttatttaatgtatatgagtgtactgtagctgtcttcagacacacgagaagagggcatcggatcccattacagatggttgtgagccaccatgtggttgttgggaattgaactcaggtcctctggaagagtagccagtgctcttaaccactgagccatctctccagccctttttttcccccttttttgagacagggtctcactgtgttacccttgctggcctagaactcactatgtatacatattaggctggtcttaaacccacagcgatccccctcctctgcctcctgagagctaggattaaagacgttttatgtttatgtgtgagtgcctgcatgtatgtatttgtgtgtaccaccacatgcatatctggtaacctcaaaggctagagaagaactttgaatcccctggaactggagttacaggcagttgcagtctgcccatgtgggagttggtaaccgaatatgggtcctctacaagaacagcaagtgttgttaatctctgagccattcctcaagccccacattttttttgttattgttgttgagacaaattctcaggcagcccaggctaccctcatgcttgctgtgtacctggggttggctttgaactcctaatcttcttttctcctctcccccggtgctggaatttcaggtgtgtgtcaccaggccgagtttctttttttttttttttttttttaatttatttattatttattatatgtaagtacactgtagctgtcctcagatactccagaagagggcgtcagatctcattacaggtggttgtgagccaccatgtggttgctgggatttgaactcagagccttcggaagagcagtcagtgctcttaacccctgagccatctcgccaacccccaggccgagtttctaaactttacttttatttatcaaggtaaaaaaaaaaaaaaaatcacaaaatgggccagtgagagggttcagtgggaaaaagtgttgccacccagtgacctgagtttgttagaaactcacatgatgggaagagagaaacacctcccagaaccttgacctttaaaatcgtacataacatgtgtatgcctacacacacacacacacgcacacacacacacaccactaataaatataaataaatatgtaaatgttaaaaagtcacaacagaagtaaccattttgagtatataattctgtagcatccatctcttttatttatttaattttcttgttttgttttactatttttgggagggaggttttatgagacagggtttctctgtgtagctctggctgtcctggaattcagagatcctgcctgcctcctctgagtgccaggagtaaagtcgtgcaccactactgcccagacagtctataacatcctagctgacgctgaatttgtgactgtccttctgtttataccttctaagaggtggaattacaggctgtgccagcactgggcagcattcaggacattacagtattttgcagtattacctccaggtttcagaacttgttgagtatggcaagcctactcgactgagctagattgctagccctctttgcatttcgtgctttgaggcagggtctcagaaagatgctgagtctaaccttgaactcctgaagtccacgcagaacttttaatcctcctgtctcagcgttttgtttttttgtttttttttttgtttttctaggcagaatctcactatgcaggtctgtctgtgctggaatttaagtatatatataatatataatataataaatcagtcagtaagtatatatatatataatataataaatcagtcagtatgtatatatatatatatatatatatatatatatataatataataaatcagtctggtggagtcaaacacacagagatccactggcctcttcttcccaagtgctaggagtgcactagtataccctgctctgtcttggctttctaggtagctggggtaataggcatgtacccccagttcctcccaatctcttgttttgtgacagtgtcttgttttgttttgcttttgtttttcgagacagggtttctctgtatagccctggctgtcctggaactcactttgtagaccaggctgctggccttgaactcagaaatccgcctgcctctgcctcccaagtgctgggattaaaggcgtgcaccaccaccaccgcccggctgtgacagtgtcttatgtaaaccaggaaggcataatacttctacgtagctgaggatgaccttgaatttaggatcttactgcctccttcttagtgctgagtgtaccactatgcctattgtatgtggtgctaagacccaaacccaggactttatgaaggctatgcaggcactctaccaactgagccttagctacagacctgactcacttccaaatcttttcatcagcctttcttctcataccctgtctctaaatgaataccctgtttcaaaccttgtctctaaattctaaggagtaagcggtcagcctgtgaattgggggctttgacagttttctctcctctcctgtccatagatttctgccagctgtcaggcatgcatctgctggtgggtcgatacctggaggcaggggctgcagggctgcgctggagggcagcacaactcatcggcacatgcagtcagaacgttgcagccatccaggagcaggtgttgggcttgggtgccctgcgcaagctacttcggctgctcgaccgggactcctgcgacacggtacgagtcaaggctctcttcgccatctcctgtgagtgttcccggatttcagggggagggcctggggccagtgctgaccgcaagggtggggtttgctgatctacaggggaggaaaggttggggtgcttcctttacttttgatttgtattcctgttggggctctgtgtggtgcaggagccagagtagtgacgtcagagccagatactaattaggccctgatggtgctgatagatgaccttgtgttccagctagagcttctcatacctatcagagtccttgtccacgtttggggtcagttcattttctgccttggggatcatcctatatactgtaggatactgagctgtgtttgtggtctccaccaactgaagacataggagcattgaccagttataacttagccaagcagtggtgacgcaagcctttaatcccagcactcaggaggcagaggcaggcagatttttgagttcgaggccagcctggtctacagagtgagttccaggacagccagggctacacagagaaaccctgtctccaaaaaaccaaaaacaacaacaacaacaacaacaaaccaaaaacaaaaaaaccaaacccccaaaccctcaaaacaaccaagcagcacttctccagacagggtagtccctcggagaggactgcggtggctctatgtgaatgctgtctgccctcacagctgtgaagcaagggaaccaaggcgtgggcagaggtagtgaagatttaggtgccagctcggggacagaaagaaaatcattgtgttaaagcacttgctggttttggtttatttttataatttatatattttgtgtatgtagttccttctaccattcaggtcctcagtgtgtgtgtgtgtgtgtgtacatattaatataagaaatatatacaattatatattacataaaatattatatgtaatattacataatataaattatatatgttgctgtttttgtttttaagaggcaatgtgtcatgtagaccaggctggaactctttttgtagctgcaaatgaccataaaattctctttctttcttttttttttaatttttttttttttttaggtttttcaagacaaggtttctctgtgtagccctggctgtcctggaactcactttgtagaccaggctggcctcgaactcagaaatccacctgcctctgcctcccgagtgctgggattaaaggcgtgcaccaccaacgcccggcttctttctttctttctttctttctttctttctttctttctttcgacaggctatcactgtgtagctctggctggcctgtaactagctatagaccaggcttgcattaaactcacggagattttctgtcaacaagtttccctcctactttcattcatgtctcttttgttgttttgtttatttgatccactgcatttagttagggatggtttcatgaggtgagagcttatttgccaaagcaagagcaacttactaataagcacaacactgaggaatatggtttctcctactccctcccccagcagaagttgggcgaatacctaagggaagggtggagtcctgtagtatctctcctacagtcaaatgctttagattctcctgctgccatttttgaagtgttgggattacaaacatgtatcaccaaaattagtttatggggttttgctgatcaaacccagggctttgtatatggtatattgaagcacaccaccaactctctttacctttttgtttgagggcaggatcttgttaagttttcctcggttggccttaaacttactgtacagtctaagcaaaacttgaacttgtcatcctcctgcctccatattccaagtaggttgaattatagcctatgtcctgaggcccagctaaatccatccttgtagagtgcactgtgtagtatttttttagtgtattcacaaggttgtgtaccccctctcaacttaataacattcatcatatccagctggactctgtaggcccgtagcagtccctccccgtgtccccctaagcccagctctttttttttggttttttttcaagacagggtttctctgtgtagccctggctgtcctggaactcactttgtagaccaggctggcctcgaactcagaaatccacctgcctgtgcctcccaagtgctgggattaaaggcgtgcgccaccacgcccggctaagcccagctcttgcaggcatttgcttaatgtgtctcaggacttgcctgttcatgacatttcttgtaaactgaatggtgtgtgcctcataaggcctttagcttctggattgtttcaacgagtgcagtgttcatccttggtctggcatgcgtcagtacttcattcctttttatggctgaatgacatttcttcacattgacacagcacattttgtttatctgttcatctgccagtgggagtctgggttgtctcagcctcttggctgttcggctgctgtgagcaggggttgggagtcttgggggtatgtacctgggagtaggcttgcaaggacatacagggactccttgttcatctctgcaaggttgactgtttcctattcctttcctttctttgtttctttctttctttcttttctttttctttatttatttttaagacaggttttcttggtgtagccctggctgtcctggaactacctagcactgagcttagagcctctgcctctgcttccaggtgttggaagtaaaggtgtgcaccgccactcctggctcctttccatttttgagacaggatctcatacagaccacgttgaactcttgaactctctctgttccacaagacgacctttaacgtctcgtcttcctgcctgtatctttccagagccccgggaatataggcatgcaccacatgcgtggtttgtgagctgctgagagttgaacctagggttttgtgaatgccaggaaaacatcctattactaccaactgacatacaccctaagtctgaccggtctttgctctagcagctgcacattgtgattgaagtgggatatgtaaaaccaggcctggctgcctatacttataattccaggactcaggaggattgccatgaaattgagatccaaatgcgttacaaagctagattttggaaagaaggagagaaggagaggggagaaaggcagaggcagaaaaagagaaatgcggtgtgtaggccgggcctctaacccacatcctttttcctttgccttcctctacatcttgagctctgctctccatgtgcttgttcaccgcggatggcagatgctactggggcatagaagctggcgggaaaaacacggaaggctcgggtaggagaggcctttaaacggggaaaggatttgactctgaggcaggaaggaggtctggagcagggcagcctctgggaagtaacacccacattagggacatgaagagacagacacaggataacctagccctagggtagggaagtggactttgtgccctaaatccgctacacccagacctggagccacatagggaagagcctgcaatgctttccgtctaagcgtttaagatttattacttgtatctttttttttttttttttttaatgtgcatgagttttttgcctgcatgtatgtgtgtgtataccagccagaaagggcattgtatgtccttgaacttgagttacaggtattgtgagctgaacccaggtcctctcagtaagagcaatcagtgttcctaactgctgagccagcttttcagactctattaatttttttaaagagtatttaaaactatttttagttctgtgtatatgtgtttgtttctgtgtgtaggcatatgcacatgagtgcccttagatgctagaagcactggattccctgggtctggaggtataggtggctggaaccacttgatgtgggtgctgggaactgaatttgggtcttctggaagtagcaagtgctcgtaactactgacctgtctctccagcctattcagtcccagttgctttttagaaagacattaaataaggtggacatggtaactcacctataattctggtaaatgggaggctgaagcaggagggtttctgtgagttctaggacagcctggggtctagagggagaatgtgtcttaaataccccgtgcctcccaatgaagacattctatagtattgaaaatatagggtactgagagttgatacacatctgtgattcaacctttgggagctaatctagaggatgcctggaaacttgaggtcacctgacccaggcctttaattccagtactcaggacacagaggcagatgaatctctgagtttgaggttagcctagtctaccttgtctctaaaacaaacaaacaaacaaacaaacaccgccatttttttttttttttttttgaggtcagcttgtgctacactttgaaggatcaaggctaatgagaaacagagctctgttggtagagtgcttgcctggcatacaggaagctctgggtttgatcccaagtaccacataaagcaggtgtggttgcacatgcctgtaacttcatcagcttttggcaggtgaagaggtggagtcaggaggatcagaagaagttcagggtcatccttgggtatatagtgagttcaaagctagcctggcctatagaagatctagggagcaaggaggcagaggaggtggagaagggagagcggaaaagaaaatgaagacaaaacagaaatctataaaaagttacattgttcagagtctgacaggtacaaagattatgtagtaaaagctcctgtcccagaccacctggtccccttcttgtacatggtacatgtctttttgagtgtgtgtgtgtgtgtgtgagtgtgtgtgtgtgtgtgtgtgtaggtgtgtgtgtgagtgtgtgtgtgtgtgtgtaggtgtgtgtgtgtgtgagtgtgtgtgtgtgtgtgagtgtgtgtaggtgtgtgtgtgtgtgtaggtgtgtgtgtgtgtaggtgtgtgtgtgagtgtgtgtgtgtgtgtaggtgtgtgtgtgtgtgtaggtgtgtgtgtaggtgtgtgtgtgtgtgtgtgtgtgtgtgtgtgtgtagtatacagacatgcacaaagcctctcttcctctgctcatttgtatgtgcctggtaacagatcatctggatggttctgcccagctgatcttggaccacttccgtcctctttcttctttacatagtagtgactgtcatctttcaccattcctgggggtcagggctcaagagcagcctacttatatagttcttgattttgccctttctgaggccttggtcatcaggcagtggactgtagtagtgatactgtctttgagcccacatagatcctctgctgttggctatctgtcttttaggttgcctgctgctgaaggaagctttttgaggactgaggcaagaagcctgaggttgcttgagtggcccagccccctggcgtggtgggtcttctagatgcagtgggggtgctacaaaacaacactgccattttactctgaagtagagtttgcataatcactttagagtgcacattcaagtggtgtctgcccttccatgggtagatttatagcatggtgttatgtggctgctttccagggctctgtgctaggaaccggtagggcttggtcacgtgggctcctactgcctgaggcagggacattactacattcctagccctctctgtgagggctcagacttggttgccctgtcacttcacttttgtaagtggttctttgtttgcacagagaaagggtttcagaaagactcagagatgggtcacttggagtcattcgtgtgcaggcctggggtgggggaagggacagggagggagacacacatgcacctcctgttgacatgatccctgcttctgctgcttctccgctcacctccgcccccctccgcccctagatggggtttctctgtgtgactcttgctctctaagccaggctgaccttgaactcagagattctcttgcctctgactgcagagtgctgtggtcaaaggtgtgtgccatcactgcctttggagagagggggcagtgaatgccattgccatataattgtggtggccagaggacaactgtaatgtcagctctctttatttacctttatgagggacctaaggatctccaggtcagccttgcacttcagagactgcttttaccctctgagctgactcactagtcttgcctcttctttttcatacagggtcctgtgtattccaggctgacctcagacttgctatctagccaaggccttgtgatccccctgcctcccaaataccaagattacaagtgtgtgctaccatatctggttttgcttttagatttttacggtgtttgtttgtttacattttgcatgggcatgtgtgctcatagtacaagtgtggttgtctaaaggcaacttgtgagagttggttctcaccttccaacattgggttcctgggattaagctcaggttatcaggtttgatggcaggtgcctatgcctttacctgctgagccatcttggtggcccattgttttttgagacaaagtctcactgtaagcctgtgtaacctggtttgtaacctccaatatagtccaggcaagcatcaaacttgcaatgatctccgtgttttgtttttaattatgtgtataaatgttttcctgtacttgggaaagcaggtactgtagtgtacaaaagattatatcggctcccctggagctgtagttacaggtggctgtgttgcctgctgtaggttctggaaactgaacttaagtcctttggaagaacaataaatgctcttacactaagccatctttgtttgtaagacacagtttcacaaggcctcgcctagccttgaactggccctggagccagggatgaccttgacatctggtcctcctgcctgaggttctctagcttcacggcaaagcagagtgggaggtatagagggatatactcttacccactgtctcttgcctccctccttatcagcaccccagcagagttacatttgctccaactgataaaccatattgctgtctcgtctacaatcgtagcatattgtgtactctcttttggacaggcgtctaatgacacgcatccatcacaatggaaccatacagagatgtttcactgcctagaacctctcagtcctgcctggatggcacaccccctcacccatggtttgacttctccagaatgccattgtcccagagtttttattgctgtgaagaaatactgtgaccatagccactcttataaaggaaagaatttaattagggctggcttacagtttcagaggtttagttcattgtcatcatggtgggaagcatggtggcatgcaggcacacatggtgctggagaagtagctgagagttccacatctggatcggcagacagcaggaagaaagagtggcactgggcctggctcaagtatttgaaaccttaaaggccagccacagttcctccaagaggaccatgccttctaatagtgccactctctttgagcctgtgggggccattttcattcagacctctgcagccatatagttggaacctagcacgtgtggtgggttggtctcttatgttgtaatgttcacttaaccttcctctgccttgacagctcattgcttttcgtttttgttttttgagacagggtttctctgtgtagccctggctgtcctggaactcgctctgtagaccaggctggcctggaactcagaaattcgcctgcctctgcctcctaagtgctgggattgaaggcttgtgccaccatgctcggctgctcattgcttttcagcacagagtaagtgtagctttttaacgggagaagtgtgagtgcgttgatgacacgtggctgtcagttgagagcagtagcattcattctgcattcccctgtttcagagaagacatgggggctcaggcagggttcatggaaagcggggtgagtgagagacatgggggctcaggcagggttcatggaaagcggggtgagtgagagacatgggggctcaggcagggttcatggaaagcggggtgagtgagagacatgggggctcaggcagggttcatggaaagcggggtgagtgagagacatgggggctcaggcagggttcatggaaagcggggtgagggtcgtggtaatgacctagatgagaatgaagggtgacgtaagtaagcaatggtccttgaggaatggtgactggtaccctccagggacactggtaatgaccagagcattttcagttttagagttgttggggtcagggctctcgttctcatgtagctgtgctcgtgatccctcccacagcatgggctggcctgtccctaaatgcataccatgttcaggtggacaagccctggggtcaaggaccgtccttctcctggttatgctttcgaggtagagccttcgggctgtttgccagttgaatttgtgctgcctcatgtctcctacctatggactattttgttatttatttatcttatctagttttattttgaggtattttttgaaatagggtctcagatagcgatggctggccacagactcactgtcattgaagatgatcttgaattctgagttctgggattacagacatgttttaccatgacctgctattattattttcctttttatcttttattttatttatttatttttgagacagggtttctctgtgtaacagccttggctattctggaactcactgtgtagatcaggctagcctcaaactcagagatctgtttgccccccttcctccccccggagtgctgagattaaagaatgtgctgtcacagctgccgccaccaccgtcaccactaggactcagctttttgagacagagtctcagtacataagcttggctggtttggtacttgctgtggatttggactgactgaagtccgctcatttgcaaacactgagatggcaggtgcacaccactacaaccagttttctattgaaaacaaacagtggagcagtgccggcgcacacctttaattccagcactcgggaggcagaggcaggcggatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatccgcctgcctctgcctcccaagtgctaggattaaaggcgtgcgccacccacgccggtgcagctagtgctcttaactgctgaatcagccccaagtcttttcctttctttgtttaaaatgatgttgtattaagttcaggcatggtgacacatgcctgcaaccccagcatgtagaagattggtgaaggagaatcccgagtctaaggccagcccgacagcacacagtagtaagtcactatcttgagaaagaaaataagctagagagatggctcagcaggtttttatttatttatttatttattaaaaaagaagcatactgcttttgcagaggatgagcagcgtttctggtatccacatcgggcaattgtcactgcctatgaccccagctccagagcacatagtgggtacagacctatttttaaagttttctaaggtatttatttatttatttatttattataaataagtacactgcagctgtcttcagatgtgccagaagagggcgtcagatctcattacggatggttgtgagccagtatgtggttgctaggatttgaactcaggacctttggaagaacagtcgatgctcttaccctctgagccatctctccagcccctttcagttttaaacttttttaaatttattttttatgagtttatgggtattttatgtggatgtgtgcctgtacaactaagttgtatgcctggtgcgcagctcttcagaaggagaagtccactggatcccttgggactgaaattactggtgattgagccaccacgtgagttctgagaaatgaacctgagtcttctgggagagcggccccagagttaagagcttaaccactgagccatccctcttgcccctgcatatggactgttaatgatcttttgtgtctttatgtcttgctaagtctcagaagtctgtggtatgcattttacactcagcacatctcagtttaggtgtagagcttccaaaggttggtgtatagttttactaaaacaacagagttgtgtttagaggaaaaatgtactgcctttctggttgttgactttctatttcaatgaacttgaaaggggacagacagcccagctccttagtcacacttggcacatgtgaggtacctagtggccttgaacttgcagtggcttctgtctgagcagtgaaggcttggagcttgaccttcctgcagacgcatccctggttggctgttaccctgcttgacggcttctcagaatccttgttgccttcggaagaaagatcatacatgctctgaagcctggctgtcgtgtctgttaaatgggaatttaagacacgtgtggtgcattcctttaacccctgcattttgaaggtggaaacagtaaggctaagaagaactcgggtcatctttggttgtgtgagcaagctggaggccagactgagacctatgaaacctcatcttaaagctgataaataaggctggggaaatgattcagttggtaaaatgcttgcaagcatgagaacctgggttcagatgcccagtaccgtgtaacaggacaaacaaggaggcttggggctgtaatcccagagctggggagcagagatttggtagtccttggaactcctagtaattcagcctgctataaccagggagttacaggttcagtgagaaaccccgcctcaatgaacacggtgggcagtgattctggacaacaccgggcttgacctctgggtttcacgtgcacgatacacatatgtatcatgtacacaaacagaaaaagaccaaaataagtaaatgactgaatgaatgagaaaatagataaatttggaacccaagaacacctatctactgggtatatgtgaaaagtaaaaggtgataatgcacaaacatgtgctgttgtctctacaaaggcaattttggaaatttggcttctctaaaaaccacaaaaatatccattcataggaggtatccaaaatattatacacaaaaatattataagaatatgtttttgttttaatcccaggtgtgggatatggggctgcttcagattgtccatagcagctgactgtgatttgcctcatgctttagcaggggcatgattttgccaggtgcagatagtttctgtaattgtgtgatggttataattcgggaacttttcagaggatttataaataaataaatgcaagggttccaagaggcaggggtggttgttgattgctgttgatcatagtgtgttaagtagtcagtgcacagaaagaagaaactacaagaagagattagatacttacactaaagatcagtcttgccccaatcagcaatgccttaatcagcaggaagtagtctaacaaaaacgttgccttcccccttcggacccctgactttattcaggggtctctttccttttctctctatccttttttcctcttatccagtgctaggagattgaaagggtgaaagaaaagggatggagaagggtggaagaaagaacaacccacaaagtagcaaaagacaagttacatgcctctaagatagaatattgctctagtgtaagaagaaatgaagtagttacagaattcttgaaaacatttaattgagtgactaaaactagatacaaaggtttgtgttgtgtgagtccattcagaggaggtatccaagataggcaaatcaatagggaaagaaactagacctgtggtggcagaggcaggagggacacttgagaatgggaatgtcatccactgggtaccagcatgatataaatgttctggagttgtgatagccatggctgcatagcttgtgaacatgctaaaaaacactgagttacatgcattaagagggtgaactctgggttatgatgatgaactatatgatggtgatggtggtggcggtcatgatgctgctgctgctgctgacagtgggatggtggcagtaccactgatggttgaagtgatggcggtggtggtgattgtgatgatagtgctggtaaatggaagtagtgactacgtagtaatgataatgctggttgtgatgctaatagtgatttggtggtgagggtgttcatggctgtagcaatggtgatagtacaggggatgatggctattaatggaaatggtggtggtggtcaaggtgatgatggtgatattgacgggtttagtaatggttatggtattgtggtgctgctgatggtgatggtggtgctagaattgatgctgattgtgatggcaatgatgataagagtgaatgggtggagttagttgtagtaactgagatggtggtgagaggggtatagtgctgatggtcacaacgctagtggcgttggtgcctgtggtggtggtgatgctgaaggccatagtgactgggacctcagagctctgcttctccctccaggtctcgtccgagagcaggaggctgggttgctgcagttcctccgcctggatggattctcagtgctgatgcgggccatgcagcagcaagtgcagaagctcaaggtcaagtcagcattcctgctgcagaacttgctggtgggccaccctgagcacaaaggtgagcagatggcctgacaaaggcatctggggcgcatgggagtggtatgggaacgtccttgctgactcccacagctcttcccccaggaaccctttgctccatggggatggtccagcagctggtggcccttgtgaggacagaacacagtcctttccatgagcatgtgcttggagccctgtgcaggtaggtgtgccggggtcctaggaggagggggccttgtatgggttcccacagaaagagcagctcaggcactagcccgctcctacactgggaccctgcactggaactatccctgtgggagacaaaaagattgtaggccagagaggtgcaaggatcacacaatgcattcttcacagtgcttgggagggagaagcccctcttacagttgacagggtgaacaaattagtcttcttggcttttttaaccttagtccacatgctccccggaatgctgcccgatacagaattggaaacctactttaaaggcattgtaagattttatatatatatatataaaatcactttattctatgttcattggtgttttacttgaatgtatgtttgtgtgtgagtgtcagaaactctagaactgaagccacaggcaggtgtgacccaccatgtgggtgctagaaattgaacctgggtcttctggaagagcagccaatgctcttaaccactgagccagctctccagctcccacattgtaagattttctttctttctctctttctttcttttttttttttttcggtttcagtttctgtttcgttttttgtttttttgtttttttcaagacaagatttctctttatagccctgtctttcctggaactcactttgtagaccaggcaggccttaaactcaaatgtctgcctgcctttgactcctgagtgctggaattaaaggagggtgccaccaccactcaaccaagatttcttaatataacccaagtgtaccattctctagcatgatcttttagatgacaactgacaacagtgtgtctcagtgtcaaaagttggacgcacctggaccatggcagagccagcattgactttattgcaggcaccatccagactttatattcactgctgggatgggggaaccaaagactcactctagggctccatagaagcagtggtgaggggcttggtgctgggctgtggtcttcattacagatgaggtcctaaggtctgctgctgtgtcctcccatagccttgtgacagatttccctcagggtgttcgtgaatgccgggagcctgagctgggcctggaggaactgctccgccaccgctgccagctgctgcagcagcgtgaggagtaccaggtaggtgggtgggtgtggcccgtgcctagggctcagtctgcctctgcctcccttctctccctgttgtgttttctcctgttatctgacactgtgcgccacatgctgtgccagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctttctttttctctttctttctttctttctttctatctttctttctctctctctttctttctttctttttttctttctttcttccttaaatattcatttaaatgggtgaataaatttcgtagctaagaatgggtaactcaacagataagtaatatgtgatcacagttaacttagcattcatacttacttcctggacctaggtggttattgtaaatcttttccatagttaaaaagatgtatataagtgtctttgtttgtatgtgctcttggggtgggggtgggggtgccttttgaagctagtgaaaggctttggagcctctggagctgaagttacaggtaattgtgagctgcctcgtgtgggtgatgggagctgagtcaagattcccagcaagaacaattgctcttaatcaccgagctatctctccaggctctagtatttgcttttttacatttgtaagggtgtatgtgggtatgtgtatttatgtgtgggagcgttcctggtgtaagtaccacggtgcttgtgtggaggtcacaggacgtcaaagtcaggtcatcaggcttggcagaaggctcgttacctgctgagccatctcgtcagctctgctcatcggttttgtgaagcaccccctgcttcaacgctgagggttttagcaaagctatgcatagcaaatgtgcgtcagcgatgctctgttgcatctgtgtctctgtggacacacctgatgtttacagagggacagcagtaactaggagaggcaggacacctgctagcagctgtcgatcctgacctcatcatcccaggaacttgtgaccttaatatctgtccccatagagcactggatgctgcagaccagcctggcctggtttcaggcagacaatgtgggggcctccatgctgcatttgtatttatctcccaggagaccctgagcagaattggaaattccaagtccagccttgctccacccttagaggtgcccaccatctacaggcaaacaaaccaagctttatattaaaaatttttttttctcaaaaataaagacaaggttgggtatttttttttctctcaaaaataaagacaaggtagcagggaggcaaaggcaggcagatatctgttgttggaggccagcctggtccctgtgtgtagcattgcaggcctggtgctggggttaaagctggccacccctgtgcccagcaggacagttttctctttactcactcctagtgacaacttttttcttccatcacagctctactgtgtagagtagggatggcctttttgacctcattgacttaactacctcttcttaatgttttagttacattttcactgtgttagcttaaagtggtctcagacttgaaatcctgttgtaggaagtatagtttgtctccagtctctcacgactacagacactgctataggaacaagtgtttgaggcaggggacacgggtcagttggcaaagtgcttgcagtgcaagcagaaggagctgagttcacagcgcaggaagcagggacagaggatcccttggggctcatgtgtagccagtccagtagagtcagtgaattccatgttgagtgagaaagaaagtgtgactgggaaaatgagatggaggctcgcacacagcgtcagtcctagcactggggaagaagcaggtggagctctgtgagttggaggccagcttgatctacagagtgagttccaggacagccaggctgcatcgtgaggaaagggaaagagatggaaaacagttgaggaagataatcgttaaactctggtgtccacacccatgtgcacacggatgcactcatacccaaacacatatgcgtgcacgtgcacacacacacacacacacacacacacacaaggtggatggcttctggggccctcttgtcttcacacacacacgcacacacacacgcacacacacccttctccatacccataaaaatggaacttaaaaaaaaaaatctaattactgggggtgggggctcatgtgtgccatggtgcccaggtggaggtcacaggaaaatgtgtaggagtcagttcttcccttcaatcagtgggttgtggggattgaacttagggggctgatgtgaagactgaccagtctgggaggccgcaagactctatgtgtggagttcagaaacccatgagcagggcaagtgatcatgattggcgcagtggtccttgggaaaggctgggcgtccggagtgggaaggtggcaggtagtttagaaatacaggagagtgttctgcctgctgaatgtatggcaggcaggtctgcccgcgctcaggactcctctcaccctgatccaggaggagctggagttctgtgaaaagctgttacagacctgtttctctagccctaccgacgacagcatggatcgctgagaccaggtggctccttgctttctctccgtgggaaccccaggcctcctgcctccctccttcccaggcactctctcttaagggattgccaggccttgtttgggcctgggcctgggcctgccagcccatctctgggtagccccctggaggggttgctgagaaaggtgctggccccttgatcccctcccttgctttctgtcatcctttcttctcatgtccacactgctcttcaaataaaaacatttctcctgctcccttatgctgtcttgcattgttttttggaaggttcttatggaaggaaggaggggctgagcttagaggatttggggagatggtcactaaaggtataataagtgttgctcttacctcagagctgctgtcttttcttgctgtgttgtgctgggaccatctgttctttaacacacacacacacacacacacacacacgtacttttaaaaacatatttgagtgtataaagaggggcatggcctgtgaatggaggttagaggacagtgtggggcattgattctccctttctcccatgtgggtattgggatcgaattttaagttgagccaggttatgggcttgcacagcagccacctttgcccatgaagccagctcgacatccttgaagttttgtgtgaaagttaatcttcattgccaagttggcaggatttagaatcaccatggaaacacatctccagtgtgtgtatgagtttccagaaaggtctaactggggagagaagacccatcctggaattgggggtggggtggggggggggcaggctgaacttaaaggagacagggagcagagctagtgttcacttttaatatgaaggtgctctcttacacagaactcagttgatacaagatcgaacaaaaattaaaagcagcacagcccaggagagacaagacgaaaaaaattactgacaggtgttaatctgtgcaagtccattaaagccatttgagaaggggtggagaaaaatatctacatcccttgaaagtcaaaataatgactgacgtgaaatgtccccgaaatataaagtcctaatctgctgttttaaaaaaggaaaactaatgtttcttacatgcatttatctagtccttacagctgacctctaaaacgggcacgaaggagcaggggatgaaagttggggtaaaccgaggctcagcgctagaaaaggccctttagtgactgaatcccggcgttaaggggttcctcccggttgttacaagaggaggctttgtgcagcaactggcaacagtagacgcggcttgggcaaatgcctgagtaggaggtcagccagaaaacctcggcagacgcttaggcatccgggacgaacccgactgaacaaaagcaaccagcttcgcgtgaggacgaaaagttggnnnnnnnnnnnnnnnnnnnnctcggtggtgaggcaggggattccctgtgactggagggcgcttgcgcgggttcgcgagctccggcccgggcgcctgcgcgagcccaccggcgccgcccccgcccctcttagccggcccctcgacagggccggagccgccggcggcggggcggcaggggcgccccgatgagccccgagtgcgaggagccgccgcccccccgcgcaggtgagccccgcagctgccttcccgggcgtgcgccttctaatccggagtcttttcctcaaatctccctgagcgcccctgagtctcttagtatcctccctttcactccctaagtcttttagccacttgccagtatcatcaagtctatttcctgtcgccgggcctgtgtctacttcgctgtcattcccagcccgtcttcctcgtctattggggaccctctctaagtctcttagactcttctccccgcagcccccagcccccatctcttcccactgggatctacatcacctccacctatcattctgactcagctctcttgggatttgggcccactcccctgtcccccctgtcgtagtcttcctcctctagggtgcctttctctttccttcctcttgcctgctcttttgtgctcacctctgtgtctacctactcttttcactctcaccagccttcgtggactcttgacctttttgtttctcaccctctgctcaggaaggcaaggttaaacaggtcttttccttcgccttggctgtggctgtcctgtccctgtttgtccctagtttcctgtggtgaggaggcactttggaaccactgtttggtgcgctactgggtattctgtgagatgaggcccattgagggcagaacttggttgctgggtccaggagggagtggtcagtggaagtccctggtacttttatctactcagggagccaaaggcagagctggacagtcacaattactgtgtgttgtgatggtggtaacccagggtgctgtggcagcaggccgcagagtgggagagactggtgagaccggccggatgggtgacttttctgtcgaggaaggctgagtgggagttaacagatggagagtgggaagaagagctttccaggtggaagaaacaccgcgtgcaaatatgtgaaggtgggaacactgagggagccaggatggagtgggttgaagtgttaagagggcaagggtggaatggcttggctggagctgctgtccagggccttaagtgacctggttggtagtccttttcccccctcccttcggtggtggtactagggctcaactcccagttttcctgccacggagcaagcattctaccaccgactgagctacacatagcctgagcctctcctattgcttttaaactatgaggcagtatcttgcaaatttttttaggcttgctttgaactctgaagagctggtgggctattgacgcacaatcgtctaatctcagttttctaagtacctgggattaatgtttatgttgccagtccaagggagttatggtcttgaccactccttatatactgaggcaattgtactgaggatgtattacctggaggcaagatgtttctggaaaggaagctgcactgtatgacaaatgtggtactgggttgagggttgtaaaactgccacagagttgcttccatcttaaaggagaagttctgtcagactcaaggccagtgttgcagggactggattgcttcaacaacacagtatgagttgtttctatgtgcattctgcacagctaatgtggacagttcacacgagagcacttgctgtgttctgccacatgcacttggagttatcttgtgctctttgaaatgtttctcctgtgggttttttgttatttattttcctggtaacctttgcctaatgcaaatcattttgcccaaattcagtgactctactctagttttagggttggtataatgaggaattacctagagcaagagtttttgtgagttagacttagtttgagtcctggtgcttgcctttcctagtggtgagtccttggaaaagttaggcaagtgttcagtacctgtttctcctctataagtgggctaataggagggctgtctgtgtaaagtggttcaggatattgagtgcaatgtttgtagatgcctatcagaatgcaaggcacacagcaagtatatcgaatcagtatctcttaggattatcatctgatttttgataatatatcccagtagttctcattgggtatgatatgtcctctcggagacatttggcaatgcttggagaccctatggttgtcaaaactgtaggagtagagaaagtaagcttcccacgtttagtgtatatatcccacccagggatgctattgattgtcttctaatgcacagagcagccactcaccacaaatagctatgtagtctcagcttctattgatgccagtagagaaacactgctactctgctattttgcttaagtatcttatgtgctttgagcttctgtgtggtgtaggagctgttgtgttttttcctttacatgcatcctctttggttgtttgcttttgttgggtcatgtggcatcttttttttttttttttttccattgaaggaaaacagtcttgtctccccgcccctcttttctactttgggatctctggccaagtgaccttcagagatcactttctcttctctggcttctgtttccattaatccaacaagtacttttacttttattttgaactggagtctcatctgtttcaaaccatctggcctcaaactcactttgtagccaaggatgactttaacttctgatcctcctgcctctacttcccaagtgttaggatggcagtgctggttcactgttgggatttgagctgaggggttttgtgcattccagacaaacacctgacaaataaactacatcccaagccccccaaaacacttggttttggatctggcagtatgttagatcttaggtggcatctctagaaagttgcagatgcctgcacgggcctaccttttcctcacagctgaggcttgtgtgttctcatagagctttggaaggaggcttgccagagaacgcttctggaaggaagtggtgtcagagtagaggtctgacagtctcaggaggaggtagtcagactcagagcttgtagggcaggtagaaggcacagcccccatcctgagcgtagtcagttgaggttcaactgttgaattcttctgccattaaacttgctgcaaaagacaggtaagcggtctagctgctatggtaagagttattgcccagtactggcttagtggggatacatccataccagaccatggttttccctttgcacatcagttttatgaattctccagaagggctgcattacagagatttctcagatgaggacactgaggctcaatgcaattagagagatttggagagagaaaattccaaccctggtcaggaacagtggtatatgcctataataaataggcagaaggaatacttgagctctggagtttgaggctgtctggacacacacatagagatttaaacttaggtctttggacatttagtttactttagtcttaagataggatcttgctttatagccccgactagatcaactatctaagttctggcccattaatccaggtttcctttctgttcttctaggggctatttcacatttgttcagtaagctgttcctttttccttttaaatttgtggccactccaggagatgatgagtactgagtataaaccgtcatgttttcacgtttcatgttcatggccaagtgtccttaggctgttttctgattattcttcctttggggttgggccagagtttctatttcccttagaatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccctggtattaagtgtcccaaaccccttttccagttttggccaggagttggctgtggcattaaaaaacagaggcatgatccacccagccttttaaggagctagcctgcctgctgctggtctgtttcctttccttcctagagcagccagccagcctgaggggctgtcctgatgctagagcctttgagcagtcaggtcttggagccatctcaccctccaaaggtctctttgcctttgtctccaatttctaggtggttagggtcagagggtggttagggcaagtatggaaggattggcagttaaagagcctgtccgtggcttcctagcacgcagaatgtttggagttacagctggggctgtagcaacagtgggaaaagaatggggaccacagtgaagtcttatctgggccaaggaaggagacagtatagagactggcaggttcctgagaggaacagctggtgtcagagaccttagaacaatacagcaaaacaagaagccagagctactgatgttaaagctggcaggagaggtagagcgactttcgtttctaatggcttcctttttcatttataattccccttccttccgttagcagccagtcttggttttcaaaccgtctcaaaaccagtggttgtcacttccgttttcttgaagctgctcaaagctatacagagtgggggtggcggggtgtatagtgctaagtatctgaatgatctgagcaaagtgcttaagtcacttgggcaaatgctgagagtttctgcttttctgtttttagtgctgccacccttagtgtaatggctgtctcctgttcctgcttgaaagtgtctgagcgtggtctcaagacagcctgtacaaggagttttgccccactacatctgtacctgcctttggtcagcattcctcctggttttccggactcaagtagaggctatcacacatcatatgaacctcattaactcaagccttgttccagcggcctccagctaggtcccctggaagccagtttggggagagaaggccagcataatcactgagaaaggtggtcaggttggagtcgggaggagggttttaagacgctgtggcctgtgctttgtaaccaggtgtcttagaaggaagtgagagggtgtcagaaggccgggcatatcacatggattctgattctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagctctattttatcacatttatttagtggtggtgtgtgtgtacatgtgtatacttgtaagagtcagttttctccttccacattctgggtccccagggcttgaatcccagttgtcaggctttgcagcaaagtgccttttcctgtttagctgtctcaccaaccctaagccccactttattgaaatgggaagtgtgttactagcacatactagtgaaactgtccacctgcctcagcatggtattctgctggcaaccttgaaaaggcctttataactacactcagtgaaactcttccttccatgcttcctggttggatgtcttcttgagtccacctggtcctctcgcatctgggcttccctatcaactctgaaactgcatacatggccactactgtgctttctcagttcttcgagcctgctggctggtctttttggtcctttctgcaaccatgcgtggctcaggagttgaccctcagctgtaagataggcagcccgtagtgagggttgtgttgcaggcctacgtgggcgcagagtgctcttgtggaaggcccctgcctcgtgcccagattgtaggtaggactatttacaggatgtagatggacacaatggcactttcagtgactatgcattgttaaggcacctcaaatcatataccctgcctctgtcatcttctcaccatgcagacttgacaaggtgggctttcttatctcaagaatgttggtaatgaggaatggggaaaggggaagctgcttaagttgtcagaggagagctaactgcactcaggccagcaggctcgctggtctggcctccatatgctggtcctggcaggttttgtttcttcattagtgattttgctgagatttatttgacctccagtttatccatttaaagaacgcaagtcagtgggtctgggtgcatccacagctttgtgtagcatcaccacagtcaattttatttcatagtattctcttttctctcacagtttttgaactttgttttgagacagggtcttaggtaacagaggttagtgttgagctcagtatgtagtcgaaattgactttaagcatctagatccttctgcctcaacctctcaagtgctctgattataggtatacaccactgtgcctggcttagttttaaaacaacaacaaacattacctcaaaaggaaactgtccccttaagcattgactacaaattcttctacatccttgaaacttgtaatcaatctcctttctgtcgctgtggatatttgtctgttctagaaacttggtattatcagaatttttagtcctggtttccttcccttgccttcggcagcttctcagcctgtcttcttaccgccatgcgaacagcctcctgtgtagagaaggctccatgttcaccaaattgaaccttttgttacttcacaccacgtggccttcagcaggaagtgagtgagtcaatgattgatgtggcggttgtcccttgagattattctcatcccaggtatacccagatcaggaaacctgtctgcctcacccctcccttcccttagtgttcttccgggctggtcccctttgtcatgtatgtttttgtgacaggtcttggttgacttgtgagattgccattaagtgaggtaggaagtagaaaaggggtctgcacagcagggttcttacgaagctcgggtttcttcacccacactccacatctgtgatagtaccctcagcaactgcattgaccctggaattagcctgtccccagccagcctgccctgagtgacctggtgcctcctcctcactggactttctccctttggtcttgattgaaagatgccaaggtgtgggagtgatttttccttatcttgtatcaattctcaactggcagtccctgcctcagagactggagccttgtgacagcatggtttggcagtgtgagtgtctttggtaatatttgtgatcatttacagctgcagtgtgagactctgttaggtgctgtcctgtgtactacagtgtgagactgtgtgttaggtgctgtcctgtgtactacagtgtgagactgtgttaggtgctgtcctgtgtactacagtgtgagactgtgtgttaggtgctgtcctgtgtactacagtgtgagactgtgtgttaggtgctgtcctgtgtactacagtgtgagactgtgtgttaggtgctgtcctgtgtactacagtgtgagactgtgttaggtgctgtcctgtgtactacagtgtgagactgtgttaggtgctgtcctgtgtactacagtgtgagactgtgttaggtgctgtcctgtgtactacagtgtgaaactgtgtgttaggtgctgtcctgtgtactacagtgtgaaactgtgtgttaggtgctgtcctgtgtactacagtgtgagactgtgttaggtgctgtcctgtgtactacagtgtgagactgtgtgttaggtgctgtcctgtgtactacagtgtgagactgtgttaggtgctgtcctgggtactacagtgtgagact

SEQ ID NO: 1082 - DNA, 1425 bp, Mus musculus
ccttctcagcagaccttcaagagtcgacccatccggacaccattgctgcctcagcggtgaccatcaatttcctttaaacacattcttccttcacagaaagtccatggcagacaaaggctcagggggcagtcgcctccctcttgcgttgcctccggcctctcagggttgctcgtcagggggcagtggttcctcggcggggggctcaggcaacccccggcctccacggaacctccaaggcctgctgcagatggctattactgcgggttctcaggagccagacccccctccagaacccatgagcgaggagagacgccaatggctgcaggaagccatgtcggccgccttccggggccagcgagaggaggtggagcagatgaagaactgcctccgggtcctgtcccaggccacacccgcaatggctggcgaagctgagctggccactgaccagcaggagcgtgaaggcgcactagagctgctggcagacctgtgcgagaacatggacaatgcagcagatttctgccagctgtcaggcatgcatctgctggtgggtcgatacctggaggcaggggctgcagggctgcgctggagggcagcacaactcatcggcacatgcagtcagaacgttgcagccatccaggagcaggtgttgggcttgggtgccctgcgcaagctacttcggctgctcgaccgggactcctgcgacacggtacgagtcaaggctctcttcgccatctcctgtctcgtccgagagcaggaggctgggttgctgcagttcctccgcctggatggattctcagtgctgatgcgggccatgcagcagcaagtgcagaagctcaaggtcaagtcagcattcctgctgcagaacttgctggtgggccaccctgagcacaaaggaaccctttgctccatggggatggtccagcagctggtggcccttgtgaggacagaacacagtcctttccatgagcatgtgcttggagccctgtgcagccttgtgacagatttccctcagggtgttcgtgaatgccgggagcctgagctgggcctggaggaactgctccgccaccgctgccagctgctgcagcagcgtgaggagtaccaggaggagctggagttctgtgaaaagctgttacagacctgtttctctagccctaccgacgacagcatggatcgctgagaccaggtggctccttgctttctctccgtgggaaccccaggcctcctgcctccctccttcccaggcactctctcttaagggattgccaggccttgtttgggcctgggcctgggcctgccagcccatctctgggtagccccctggaggggttgctgagaaaggtgctggccccttgatcccctcccttgctttctgtcatcctttcttctcatgtccacactgctcttcaaataaaaacatttctcctg

SEQ ID NO: 1083 - protein, 391 aa, Mus musculus
LLSRPSRVDPSGHHCCLSGDHQFPLNTFFLHRKSMADKGSGGSRLPLALPPASQGCSSGGSGSSAGGSGNPRPPRNLQGLLQMAITAGSQEPDPPPEPMSEERRQWLQEAMSAAFRGQREEVEQMKNCLRVLSQATPAMAGEAELATDQQEREGALELLADLCENMDNAADFCQLSGMHLLVGRYLEAGAAGLRWRAAQLIGTCSQNVAAIQEQVLGLGALRKLLRLLDRDSCDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQREEYQEELEFCEKLLQTCFSSPTDDSMDR

SEQ ID NO: 1084 - DNA, 19640 bp, Homo sapiens
  misc_feature (1)...(19640): n = A,T,C or G
aggtttgggggccgaccacatggcttttgctcagccctccacatgcccccaagggcctgtctgctgggcagccctcagcccctcctccccctcaagctgcccactcaccagatggagtagctgtggcagaagtccagcgcagacacaatctggcggaagaactttcgggcctccttgggcgtcagtctccccttctttaccaggtagtcgaatagctcaccccccgagacgtgctccagaaccaggtacctaaaggatatagagggggcagagggctggaaggggcatgtggaggaccaaagggcctggtctcccacttccactggctcctggtggcagagaactccaattcccatgatccttgggagaaagagactccaattcccatgggtccctgggaggaagagactccagtttccattaattcctgggaggaagagattccagttcccatcactccctgggaggaagtgactccagtttccaccagcctctaggaaaccaaactcaagtcccattagccctgggcagtagagcctcccatgtcagcttcagaggggaaccaacactttgactcataatggtttcaggagataaggcgactctattagcacctgaaggtcaaagaccccaattcttataggaccctgggaagtgaagatacccctactcctattagcccctagaaagccaagcctctaattccctctggagtgaggaaactcaaatttgaattcattttcgagtattaacgattgcaaggttgcaccagtccaagccagcttctgtgaggcaatagacgacaactcccatcagcgcctagaagttaaaaacccccacttctggccagacacggtggcttatgcctgtaatcccagcactttgggaggccgaagtgggtggatcacttgagatcaggagttcaagaccagcctgaccaacatggtgaaaccccgtctctactaaaaatacaaaattagctgggcgtggtggtgcgtgcctgtaatcccagccactcgggaggctgacgcaggagaatcacttgaacccaggaggtggaggttgtggtgagccgagatcgagccattgcactccagcctgggcaacaagagcaaaactctgtctcaaaaaaacaaaacaacaaaaaaacccccaaactcccttcccataagcctctgggacacggggttccagtttccatcaaccatttttttttgttgttgttgttgtttggagtttttttttttttttttttgagacagagtcttgctctgtcgcccacgctggaatgcagtggcacgatcttggctcactgcagcctctgcctcccaggttcaagcaattctcccacctcagcctcccaagtaggtaggactacaggtgtaccaccacactcagctaatttttgtattttttgtagagacggggttttgccatgttgctcaggctggtctcgagctcttcaagaaatccgcccatcttggcctcccaaagtgttgagattacaggcatgagccaccgcgcctggccccaaaagctcaatttctatgagctcttagatggctgggattcctgcccgaagcataaactcccatggccctgcctccctacgccaagagtggagtgggagcgaccatgcaccggtccggacaatagcccctccctaccaccacacctgggaaagcctgagagcaggtcccatgagcgccgggcagacagcttcccgtgtggtgaaacctgcgccagcatcgacggacctgatgtcagttcatccgggggactgggtgccgggggggaacacgagggctgtcccctctccggcttcccagcccagctgtcctttgggtcaccagagtttggacaaagaggcccattctctggagtctggacagctggacccccacccccatccttcctggcgggtgattgactttgagatagtgactcagacctcctaaggcggcccattgttggggtgtccagccacggcacccgaagttatgccgggggaggaggggggctctccagtgctccagagttggggtttgggaagatcctttgggctttgctaggccccttgccttacaaacaggaggcatctgcccatagcagattgggtctggtcgagggcaccctgcttgtctagcagagcgcattccatgcagtgccacagggcgaggagctggagctggggacacggtaggaggatggttgcccttggcctcaggcccaacacagcgtgacaacagtggggttccctgtgtgtcaggggcttccctgtgcaacaggcaaggaactgggccttcagcggtccagcctggagagctgcaggtcccccaggtccccctaggccctgtttctggagaagtcccaccctggtaacctggagagggaggatggggtagggctgggtgtctataaatacctacaaatatttcttgttctcgtagacgtcgtggagcttgaggacatgtgggtgttcgatgagcttcaggatggcgatctcccgctccacctgagggtcaagaggggtggggacacgggaaaagaggtcagcacggccccgcccctgccctcagccccggaggcccccccacccgcaggcacactgcagcaggcgcacacaccttcatcagcaccgactccgacagcttctcccggttcacgatcttgatggcgaccttctgacccgtgatgcagtggaccccgagtttaaccagccctgcaggagcagggtgaaaatgtggggtgttccgccgggtccccttcgtccccagcgcctatgtccccccttggccaccctgtttgctccttcctcctgggctggctgtttaacaatggcctgaacacatcagacctgaactcctggggctgagagcccacactcccacaaaaccacccttcccctccctcctgccagtccgttcctcctgactgtccatccagccaggtgcccctctcctctgccagccaccccctggccctcaccctctccgtcctggggagcccgcctgccacgcattctttcctcaccgtgtctccccgagtctgtctcctccaagcccccgcccccccactttctctgtctctctccatcaattccttgtattctctgcttttcaatcttttggagaccctatgactcccaacgaatatagtctcacatttgccccctccccagaccaccctccacctcctcctgaatcccctcccagtgaatataatctcacatttgcccctccccagatcaccctccaccttctcctgaacccccagcctcaactgccttcctgggtcttctcttcatggcagccctaacagacagcacacagacaccaagggtatgtccggtctcctagcccacacctctcctcaggaccctcgactccaggacctgagcccccaaagccacagacctagccctgactagcccctaaagctgcaggcccaggcgtccagacccccagcccctcctccctcagacccaggagtccaggcccccattccatcctccctcagacccaggagtccagaccccagcccctcctccctcagacccaggaatccagcccccccagccccttcctccctcagacccagcactccaggcccccagcccctcctccctcagacccagcactccaggcccccagcccctcctccctcagacccagcactccagacccccagcccctcctcccttagactcagcactccagacccccagttcctcctccctcagacccagcactccaggcccagcccctcctccctcagacccagtccaggtcatgaccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttttatctccacgcattatttctgctgagggtgtgtttaccctagagggtttatagtccgggaggtggtgttcgcacggttgatcttattcccaaggattgtttatcggggcctcccttccccagcccgtttctggccggccccccgcttcctgcgcctccccccgccgggggggtctgaggtgcgggccggcggatgctgcaggccgaggtcccccccgcccccccacgcgccctctctcctccgcctcctcctcctctccgcctccccccgccacctcgtcctttctctccggcacgctgacatcaccatccggggactccgggcccttccccaaagttaaccctttcggaggggggagggggagcgagggggggcagggggcgggcctccagctggagggatggagaggaggtgggaggatgcaggagagaggatggagggaaggatggagagagagagagaggacccaacagatggggcagagatggagatacacaaagagagatgctggctgacacagagacgggagacaggcagagacgccagagggatggagaccaccagagacaggctgaggcagagagggaggaagggcagagatggacagggacagaagagaaggaaggaatggcaagccgggaaaacagacagggagagggagagaaagctgctggaagccgacagagggatggagagagtcagagattcagagagacagagagaggaagaccaaccagagaggtgggggagagggggcgcagatggagctgtagagagggccgggggtacacacaggtggagggacacgtgctggggagaggtggggacatatggagggagacagagacagagaggggaaagaattcttggagttgctgacccaaaattcatgtctgtttccccagccccctaaggccacccattcagggtaagggtaagtctgtgtccccaccaatgtcaaggccccatatctacccacagcccagagtgattttggattctctttacagagaagcttccagaaccccctcagtttccctgtgttatgtttttagacccccatatattctctgtgctcgtcatagggtcctttatatcttcatgtggaccccagtacagcccatacatccccactgtagcaggtccacaagcatgtgctctgcctgtgagtaacccgcctgcccccattagctttccgcataaaccatagatccctctatgtcatgtacccgcaagtgttagacacccatttaattctcaagtcccctgtaaagcacacccagggctgggcaaggtggctcatgcctgtaatcccaatactttgggagacagaggtgggaagatcagcctgggcaacacagtgagaccccatccctacaaaaatttttttaaaaattagccgggcatggtggcatgtgcctgtagtcccagctacttgggaggctgaggcttgagtcagtgagttctaggctgcagtgagctacgtttgcaccactgcactccagcctgagcaacagagtgaggccctgtctctaacaaaaataaaataaaataaagtgcacacaggagcctattggctcctgtgagatttcccagtcccccattcaacaccttgagtccacacatctttaatgagtgccaaatctcagccaggcactgttcctgttggtaagaacgtggcagtgacctaaatcagcaaaaaggcctgtcctgtggagcttccatgctggtggatgaaacagatgatcagcaaggtcaataggcaaaatgtatggtgtgttagataatcatgtccgtgctgaggaggtgactacagcagggaagggggttaagaggggcctgttgagcagggtacaattttaggcgtccggctttttttgtatttttagtagagatggagtttcaccctgttagccaggctggttctgtagcctttttttttttttttttttttttttttttttttttttgagacggaatcttgctctgtctcccaggctggagtgcagtggcacaatctcagctcactacaacctccacatcctgggttcaagcgattctcctgcctcagcctcccgagtagctgggattataggcacccgccaccatgcctggctaatttttgtatttttagtagagatggggtttcaccatgttggtcaggctggtctcaaactcctgaccttgtgatttgcccacctcagcttcccaaagtgctgggattacaggcgtgagctaccacacctggcctggttctgtaactattgagtccctttttgctctcaaatgtcttgctatagatgaaaaattatatgatcaccctcttttttttgttttgttttgttttttgagacagggtcttccccctgttgcctaggctggggtgcagtagggcagtcatagttccctgcagcctcgacctcctgggctcaagtgatcctcctgcctcagcctcctgcctagctgtgatataagcagatgccatcacacatggctaattcttgtatttttttgtagggctggggacacactatgttgcccaggctggtctcgagctcttgggttcaagtgatcctcccaccttggcctcccaaagtactgagattatagacctgagccactgcccccggccatgtattataaactgatagacttgtacatagatgtccgtgtcctaattcccaggatctgtgcataagttaccttgcatggctgaagggactttgcccatgtgactgagatagggagattatcccagttatttgggtgagctcgatggaatcacaagagtatttgtgagaaggaggcaggaggagcagtcagtgatggagatgggaaggtggaagcagaacttggggtgatggggccacctgtcaaagaaagagtgtggcctctagaagctggaaaaggcaagaaaaacattctccccgagagcctccagaagtgatgcaatcctgctgacagtttgatttcagccccgtgaaacccattttggatttctgccctccataactgcaagataataaatgtgtgctgttttaagccaccacattcttagtaatttgttaacagcagcaataggaaactaatataatagcacatccacaggcccagatgcatctcacagcacagtgctagaaacaccacacacacacacacacacacacacacacacacatacacacacaacctatctgtttggtcttcctgtttctgcccaaaatatccccctgcacaaccacgcccagcaggtgattgatacgtttgtgactgtgtgcccgttttgcgttgagcacaaccttttcctggaggaaaacgcctcctatccaggatcaacacgggagtttctttaagcccagcccagggccaacacctctgcagatcggcccgcaccagcacgtgcccaggcctaaaccccacttctggagcacagaggcctcgggcctccccaccaagctggctcctctggcgctctgaatcttgctgggctctggggcactttgctttccggctctaggcctcaagaatcctctcctctccacctggcaggacatggggaagagtccatgagggagaggctgggtgatgagagggatccacgccgcagctccacttgacagatggagaaactgaggccgagagaggggttgcggggggcataaggctcacaggccagccattacggttgcgaccccagggctcctgtagatggggttggtggccccggtggaggcgaaagtcagattagttggggcgaggtcccaaaccttctaaggatgactgacagcaatgagtgggaggggcctgtaaaggggccggggcccaactgggagagtctgaaaggcctagagcaggggcgggaatcgtagggtgggcggggtcagacctgggggcggggcacacgttagaagaggggtggagcttgcaaaagtatcgggggcgggactcgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggaggtgagatccgccttattccggcgcccctcttcggagaggagggagaagacttgttgctaaggagaccaaagggcgggcttgttgctacggaggcggagcagtgaggttgctaagagacgggacgcacgcagtggagatggggaaggggggttgttgccagggagagtgggtggggcctgttgctagggagaaaggagaggcttatgactttggggaagggtcctgtgggtatgaaggaaggaaaaggggctgtggttaagtgggctgggggcagagtggtttggggtcatggggggtcgccgagctcccctgaaacgccgccttctcagcagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggcggcggcggctcctcggctgggggctcgggcaattcccggcccccacgcaacctccaaggcttgctgcagatggccatcaccgcgggctctgaagagccagaccctcctccagaaccgatgagtgaggaggtaaaggatggggacccaagaagctggggtgaggggcctggggacagatagagttgccttgggaagtgtgacttggggagccacaagaagactagggtcttcttgggtgggaggcagaaaaccaggtgtggaggcattgtgggctataaattgtgctagatggggttatcgttgactgaaggtcagatctcaagagagtctgaggggacatatcctctccagagccagactaacctggattcagcatttccagctgtgtgaccttgggtatattacttcatctttctgaatctcaagttcttcatttacaaattgataataataataactaccgtatagggtagttctgaggttctactttaagtagggctgcacacagtgcccagcatacagacagtgcttctgaaggcagcagtgtgttttcatgaagagcacaggctctgtagtcagactgctgttttttttttttttttttggtgggggcagggttgggggtggaggacacagtctcggctggagtgcagaggcgcagtcttggctcactgcaacctctgacttcccggttcaagcaattctcatgcctcagcgtccccagtagctgggattagaggcatgggccaccatgcctggctaattttcgtatttttagtagagaaggggtttcactacattggccaggctggtctcgaactcctggcgtcaagtgatccacctgcctcggcctcccaaagtgctgagattacagatgtgagccagcacgcccagcctagactgcttgggtttgatttcaggctttgccaattgctgactgtgtgaccttgggtaagtctcaacctttctgtgactcaactttctcatctgcgaagtggggataacaatgatatatacctcatagagttgttttgcagattcatagcgatagctattatatataatgtttaatcgacaattactgtatacagagcattatgctaacccacttacatatatgatatcattgaacctttacaacagtgaggcatgaaacaggcacagaaacattaaatagctcactcaaatttacttagaactgtgactaaggagacctctgctcccctccctcacccccaaaaattccagcagtcacgtattagctctcatctcctttttctttgagatagtctcactgtgttgcccaggctggagtgcagtggcctgatcttggctcactgcaacctctgtctctcaggttcaagcgattccctttgctgcagcctcccgagtagctgggattacaggctcacgccaccaggcctggctaatttttgtatttttagtagagacggggtttcaccatgttgcccaggctggtctcaaactcctgagctcaggcagtctacccacctcggcctcccaaagtgctgggattacagggatgagccacagctcccagccgatatttgttgactgaaggaacatcagccctcagttgttggctgtctttattaatggctgttcctttgtaatgaatgactgatggatctccttctttcctcctcgccttggtctccagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcaggtaccccgcttcccccgccaggacgttctgcccctctgtacatgtcctgctgcctctcagctcttgcccctactcttggggctcacaccgtcagcctccctgctgccttctcaccatcagcctgttcgcctccattgccataaggagcaaggctctgcctcaccctcatggcaggtggagtcccccacttccctgatcagctctgagatggctgtttctctcctagtcctctgggtgtccactgccactccccagagtacaagagggaaagtggcatgggtggggtggcagagaaggcctccccggggtgacgtttgatcagagacctgaagtgaggtgagagttgtgggatgatctctgggaaaagcattccagacagtaggaacagccagtgcaaaggccctgaggccagagtgtgcctggtgtgttcaggaacagcagccaggcccttgaggcagagtagagtgagtgaggggccaggcgcaggaaacagcgctggggtgggcctcgcagatggggaggtaaatgctgttttactccaagcagcagagctcacagaaggtttgaggagagctcacttccatttggaggggttgggtggtgtagcaattgagggtgtggatttggggtgtcacttccttggttcatagttcaggctgtgctgctacatggcagtctggtttgggcaggtcctgattacttcctcttgtacgcaggctgggccgagagaaacccccaggcccgcacaacaccaggcacagagtaaacgtaacgtgtcaggcctgggagtcaggtgtcttcattttggacaggggctggacggagtttgggaagccctcctctgtgagcgcatgcagcaccccgagaagacctgcagtgcagccgccaccctctagcttacctttccccagtgtctccccgtcttatccgggcagagaactcctgctccaatccgcaggatggcttttaacgactttgctctttcattcattttttgcttgttcaggaaatatctgttgagcagctgctgtgtgctaagcactgtgctgagtgtccaatcatcacagcagcagcaattttacaccttattagtaatcaaatgagaacgaaagccaaagataccacttcctccctggcctcgtgcgctctctgtgtatataaatataaatatatatgtgtatcttctctgtcttaatgaagatgcacagtgctgatgaaggtgggctgaggggaacatcctcccatatgactgtttataccacttacagtcaattcagaatgttgtgcaacaccacctctatttccagaacttttccattgcctgcaaaggagacccagcacccattaggccggccctcccccggtcccctggcaaccactaatcagcgttttggctgtatgaatttgcctgttctggacatttcatatagatgattataacgtgaccttttgtgtctggctgattgtgctaaaggcggcgtgcccatgttgtggcgtgtgtcagagctttattccttttttttttttttttttttttgagtcagtctcccaggctggagtgcagtggtgcaatctcagctcactgcaacttccacctgctgggtttcagtgattctcataccttagcctcccaaacagctgggattacaggtgcatgtcatcaggcctggcaaattttttttttttttttttctgagacagagtctcaccctgttgcccaggctagagtgcaatggcgcgatctcagctcactgcaacctgtgcctcccgggttcaaacgattctcctgccttgcccttctgagtagctgggcttataggcgcccaccaccatgcccagctaatttttgtatttttagtagagatgaggtttcaccatgttggccaggctggtcttgaattcctgacctcgtgatccacccaccttggcctcccaaagtgttgggattacagtcatgagccaccgcacctggccaggcctggcatttttgtatttttagtatataacatagcaaaaaccctgttttgctatgttacctgggctggtctcgaactcctggcctcaagtgatctgcccaccctggcctcccaaagtgctgggattataggcttgagccaccacgcccagctgcttcattcctttttatggctgagtaatactccgttgtatggctagagcagtttatatttatccctttatcctttaaggacatttgggtcatttatgaatgatgctgccatgaacttgagtatataagtatctgagtccctacttctggttcttttgggtctgtgccttggtgcggaattgctgggtcacggggaatctgtatttcatttttttaggaactgccacgctctccaataccactttatttacaaaaacaggaggtgggctgtggtttgctgaccctggggacattcagattgtcacaaagaccaggatcagtcctggcatttagtagtctggagcctggggccctaatgccccaaatgctgatggaatcgagttgtactagccttggggggacctctggttgggtgtttggagagagctgcgtccctgtgggagccggcctggctctcccggcctcagcagctgtagtggtcagcttagggccaccttagccaagcaccacagactactggctttaaaaacagaaatgtattttctcacggctctggaggctagaagtttgagatcagggtgtgggcagggctggtttctcctgagcccccctctccttggcttgcagaaggcattttttgtgtcctccctccatgttgtccctctgtgggtgtctgtgtcctcatctcttcttcttatcaggacgccagtcagattgcattagggcccaccctaaggacctcattttaccttaatgatctctttaaagatcccatctccaaaaacagtcacattccaaggtactgggggtcagaacatcaacccatgcattttggggggcacggttcagtccctaacatctggcctctctctgctcccctctgtggcacagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctccctgtgagtgtcccgggtggggctggggacaggggtgctggcggtgggggggggtgccgggtgggcccccggnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgccgggtgggcccccgggatctgctggggcagagggagaggcatctccttccctcgtttgttcccatgcttgttggacccctgcacggctgagtgctgcgggcagagtgagtggcgcactcggccaaaccccctgctagccaggcagcagatgtgaccacttcccggggagaccacctggccctcagcgtgagcgctttgcacacagcagtttttcagctgggcactgttcacactggcgctggttcactctctcgggggccgtcctgtgcactacaggacattgagcagcatctggtgggtggcctccaggccatggagagacactatcaccccacctgccagcgcacaaatgcccctagatgtagaaagccccttggtcagaacccctgctgtacatgaattcttcttcttctttttttttttcatttaacctatatagagacaagacttgctttgctacccaggctagtcttgaactcctagcctcaagggatcctcccgccttggcctctgaaagtgttgaggttacaggtgtgatccaccatgtccagccacaaattctttttatcctaatggcctgtgaagtagggaccgtttgcatcctcatttgacaggggaagaaactgaggtgtgggcagagggacacggccaggtttctgcagctccatagggcagagctggccaggactcccccaaatactgccgcctgggacacaggcaccaggtcgggcacagggacgggacaaaaaccaacatctgtggggcagtttctccatgccaggtgttgactcgctgaatccttatgcacacctgctgaagttgggcccactgtgtctcctccacacgggagggatcgggccagggggtctggagaggacacacagagccaggatcccagcctggtggagctcttcgtgtgtgctggatgcctgcctgcatgtgctatactagcgccccaactggactctttccttttattttctctaacagctttattgagatgtaattcataggccatacaattcatccttttaaagtgtataacttagtactcttggccaggcgtggtggctcacatctggaatcctaacactttgggaggccgaggcgggagaattgctcgagcccaggagtttgagaccagcctgggcaacatagggaaacccctgtctctacaaaaattaaaaaattagctggacgtggtggtgcgtgactgtacctccatctactcaggagactgaagtggtgggattgcctgagcctgggaagttgaggctgcagtgagccatgattgcatctccagcctgcgtgacagagcaagacctgtctgaaaacaaacacaaaaaccagaaaaacaacgtagtacttcttagtgtattcagtgctgtgcagccatcatcactctctaattttagatgtgatcagacgcgttcggggtggtatggctatcggcagtcactatctaattttggaacattttcttcttttctttctttttttttttttgagacagagtctcgctcttgtcacccaggctggagcgcaatggcgcgatctcggctcactacaacctcctcctcccaggttcaagcagttctgcctcagcctctcaagtagctgggattacaggcgcccgccaccgcgcccggctaatttttgtatttttagtagagacggggtttcaccctgttggccaggctggtctcaacctcctgacctcaggtgatccacccgcctcagcctcccaaagtgttgggattacaggcgtgagccactgcgcccggccaaaatttcagaacatcttcatcctctcccccaagcagaaattctgtacccgttaagcaatcactcggcgtccgtcctctcccgcagcccctgcaacatgaatctacttactgcctctaaggatttccctctccgggacatttgtacaaacggaatcccacaccgtgaggccttttctgcctggctcctttcatatgctgcaaggtccccgagtggtggcgggtggcagtgctgtgttccttcccgcggctgaatgtgtcctgttgcgtgggtccaccgtgccctgcctcttcctccgcctgtctgctgacagtccctggtttccttgtatctctgggctctcgtgctcctgtggacatagctgcgcaggtgtttttatggacatttgttttccgttctcttgggtgtatacctagcagtggagttgctgggtcatatcgtaactctacatttaatctgttcgaggttggcttttttttttttctttttttgtttcttgagacggagtctcgctctgtggcccaggctggagtgcagtggcgcaatctcggctcactgcaacctccacctcccaggttcaagggattcccctgcctcagcctcccaagtacctgggtttacaggcacatgccaccatgcccagctaattttttttgtacttttagtacagagagacggggtttcaccctgttggccagtctggtctcaaacccccgacctcaggtgagcacctcagcctccctaagtgctgggattataggcatgagccactgtgcctggcctgaggttggctattttttaattccagcagcctatctggtcattgaaatgggggctgtgaggggggtccaacaccctctttctctccctcacccccatgtatcctgagtcctggaatcagtgttgtgttcctggcagatggtggccccagccatgcagaggctgggaggagaacagggagggtttgggtaggaggagattccggaagaaggaagcattctgatgaggcaaggaaaggggcacttggaaagtcacagccaaaactagggtgacagggacagacagacatggggcagctcggccacaaagggcagagagaaggacatggtgtcccgagggccagagcagggtagagaggggctggcagagttttcttctaatagcttgcattaaaaaagaagtctttaggtcatcttggtggttcacacctggtcccacctacctgggaggctgaggagggaggatcatctgagcctgggaggcagaggctgcagtcagctgagatcgtgccactgcactccagcctgggtgacagagtgagaccctgtctaaaaaaaaaaaaagtcattacatatttttaaaaatctgtgagacagtcacatcgttcaccaggtacaaaagagtacatagcaaatggtccctgtccccaaacctggtccccattccagagaaaaccactgttatacctgtttctgcttccagacattttaataaatctgtaagaacaaatgtgggtgtgtgtggtgtgtgtgtgatgtgtgtgtgtagtgggtgtgtggcgcatgtgtagggtgtgtatggtgtgtatgtggggtgtttggcgtgtcgtgtgttagtgtagcgtgtacatgggttgtgtggtgtgtggtatatatgtgaaggtgtgtgtggtgtgtgtgttgcatgtgtatgtgtgtgggatgtgtgtgctgggggcaatgtatgtatatgtgtggggtatgtggggtgcatatgcaggtgtgtatgtgtggtgcgtatgtgtggtgtgtggatgtgcatggcgtgtgtgggatgtgtggatgtggtgtgtgtatacggggtgtgtggtgtgtgcttatgtggagtgtgtcgtgtgtggtatgtgtgcacacagacacacggattaatactcgtttcctcagatgtgcacggctggcacaggccatcctgactgtggcgcaccttgacctg

SEQ ID NO: 1085 - DNA, 838 bp, Homo sapiens
gatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctccctgtgagtgtcccgggtgggg

SEQ ID NO: 1086 - protein, 258 aa, Homo sapiens
EQRRLEDPGRPSRIDPSGRQSCFSGDHLLPLTHSSLLHKRPMSDEGSRGSRLPLALPPASQGCSSGGGGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISL

SEQ ID NO: 1087 - DNA, 49507 bp, Mus musculus
  misc_feature (1)...(49507): n = A,T,C or G
cattattctgtttgtgtccttaccacaacttgtaatggcctgctctgctcctctttttttatttacttcaaagtcagagtcttgagctttgcaatgctgttacagattaaacaacccccttggctcattattgagtcccggtgcccttcattcttgtaaaagtgccaaataagggttcattgcttggccagagaaccagaaaaggaatttagtcctgatcaaatcactgagagctaacagaaaagtgtttaaggctgagaccactgaaagagggcttctaaagtacattatgtgcgtgaacaaaaatgtcacacctaaacccacgatggagtctgagcactacacactaataattttagaaggaagaggtaaagaaaagaaaggggagctagacaagattaaagatgaggacatcatccttctggcataggggaaggtggaagaggtcaagttcattctacatggtgttcagagacagctaagtaaggaagctaccgtggacaccgtgtgtggatttcagcagtcagtaacagagaatgctttcccaacattcaatcttctaggtaagcttaagtaagaccactgtgtccacaaagtcaactagagtgcaaatccagagaatgaattgaggtagttatcacaggggagagagaaaaggagacgttttaaaagacatggcagtcacataaggcaaggataaacatttatgtagatctgtttgcttgtcaactttgtaaaaaaaaaaaaaaaaaaaactaaagcaaaccaatcaaagtgatgtgagtagcgatgtcagctcggcatggtggagctcttggaatagaagtgatcgtagctgtagctttgctcttcttctgctctagcacattcctttctcctgaaggaccaacgtctggctctcttgccagttcttgggggatggtgagtattggatgttttcgtctgagttcctgtcacgagtaattctggaagctgctaagacaagaatgctacattccatgaatctttgaatgtttggctatagggtgagtgttcctggttgagaaaatattgctaaacttgagaattccaagactcaggatcaggtgacttaaaagtacattcaccagcttaggagcgtaaaggtactagagattaagatgttgtctttcccttcccaaatttctttctaatcctcctaccccccagccctttccccactctcgcctcttttaaacatggacagtgtactatccttctctccctctctgatttactaccacgtattttaaaccaccaatgcattttatacctttcttaatgttcatactcaatcacgtacttctatttttgtaaatatttccgttttgcttatgcacattttcctttggctccctcaatagataagctggtccatttatagttgctttgtttattttttgtttttgtttttttttttttttttcattttgaatccaatcagaccttcctcttgaaggaattcatttcagagcttgctgaaaagtctcatcataacgcaggtaacaatgacttaactgaattgatttacgcattcaattcaatccacaaacacataatttatctgtgattatatgcttttttctatttataaaatcatgaacgtttatctatatgcctgtttgtctaccagtgtgtgttaccatggttatttatatgatcttacatgctttttagaaaaggagattgtaatccgctgggaaggaaagacaaagaaagttagatttgcgttgttctgtaaaggtcattaggcttccgggttgttgttttgttttgttttgttttccttttggatcagtgaaaaagtgaaattccaggccccgggtcttcctgagagctggtttaattttgtttttgtttttaaaggttatatttgcagaatttccacattgttctgagctgctgggaaaagatagtcacagatatattttttcatgtttcttagggatttttcacctcagatttcctcggatgttgtcaactagagtacaattgtctgggttttgaatggataatgaaatggcattgtaggagacaagttttatagatagaggatatagggagggatagaggttagtaaagtctgacaatattgatattttggaaactgtgtctgttaatgattactgagcatttaattggtgtatatgaggcttaacttgtataattccctaaatttaaacacagagatttgtattttcttttctgtaaaagataagtgcattgaacagttactaaggtttaggagggctttcgaggatagtttctgagctctatcattgtttatacatccactaagtaggcagctaccacatagacaacaagaggacaacatattgtgagtttactcttgcctatttcaggagaatatttgaggggacatgatagtacgttaaaaaagaaaaaaaaaataaacagaatactagaaaaggctgaggaaaacacagactctgtggccacagactgctaagtcagatgcaggcatacaaatttcttcatggacttgacttgaaagtattctcctcctcttggaactgcctagtccacaacggaaaacagaaacaaaaccaaaaaacaaaagacaaaacaaaaccccacagcctcccataggacagtacttttccttactctatctacagacatgacatgtcgcttgtgtggtatttcagaaagggattcccaagtggttattgacctcaacagcttacctcatgatatttttatagcaggactttgaaagatagctatctaaaagaacagtaataatcacagagggtgagcttactatgagcaagacattgcttgctagctatgagttcatatacttgatataacctatgttctagttacattatttttctcattttattttattttattttattttttttaaagatttatttatttatttatcatatgtaagtacattgtagctgtcttcagacactccagaagagggggtcagatcttgttacggatggttgtgagccaccatgtggttgctgggatttgaactctggaccttcggaagagcagtcgggtgctctaacctactgagccatctcaccagccctatttttctcattttaaagataagaaaaatcttaccaaaaagtagttcttatagcattcacataattagtagtggtcccgttggtgtgcaaactgctctcaaacttgtgctagtaagtatttctctggtgcagagtacaaactagggatagtatgtctgtcctggtgatcataatggtaatcctttgtttactgcaagggaaggatgtacatgtctaggatgtaaaacgacagcattatcttctcttcttggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacatgggtgagcttgagtgcaagcacacacacacacacacacacacacacacacacacacacacacgtacacacacacgtacacacatgaatatagcacacacatatattggctattagaatgatacatttgtttgtgtctaaactggtggacacattcttgtttaatatttgagtaatttgtctaatagaagggattgagtttactggtttttggttttttttttgtgtgtgtgtgtaccaaagaaagaactatatagaatacctgatgacatattcaggttcaaagcaaagaacacgtaactgacataccagactaagagcagaccatgttcccctgcggtgttattccagacagtttgagagaagggctgagtgagtaagaagttttctctgctaaaatcagctgggtcacaagattcttccattccctcgcccagccatcctctccattatcattgtgtttctacttcaatattttactctgagacaccatgtatctcccatctgtaaaactgagctgttttcttcctaattatatcactgatggttgtgaagatcaactaaatactatatattaaagtcttttggaaatttccacgacagaactctaattgtgaaattcattagcattttctttcaacaaagcaaagcatttttatctttctcttaaataatattactgaacaactatatatcaagttaatggctgttatatggcatatataaattttatgtaaattatccaattcatttaatgtttttagattttcttgcttgttactaacttttctttcttgtaataaatcaattacttgatttccccaagtgtctgagataaataactagcatcatcaaggactgaaatttggataatgccagctaggtaaaatagcatagaattttaactgaaatagaaattctatttacttgaaatttcctatatttcctcagcaggaacaatcaagattatttgtaaagactgcctctcactattgatgctgaactttgatcatgttagtcattttggaggaagaaataatgaacttaaattgatcattttgaacctttatttttttacccctttgagttttctttagcataattcatgcttgtctctttctctaagaatgaactcaagtcccatgcctacaaagtatttttttttgatgttttcttccattctgaacatcctttagtgtgtatggggatttgggttctattgtttacccttatgcagagtcagttacactgtcagagtgtgagatggccttggcagtccaacatctctgttttcccctgtagaggaggaggaggaggaggaagagctgagggccgttctttgctctctcagctctcagccttggagtcagaaggctgaccctggaccgtttccacctctattctgttttgttgggtcttgattgtttcatgtgagtatgttcggtcttcctggctgagagatttattttgtaggacatggtctccttgcttatctgcaaattgttttccacttctctgtgtagaagaggcacacaggaaagctttgtacacctacaagtacaccccaatcctttgaccctgtggttattttaaaagactttcaagttttgggtagctaaaatatatttattttaccccatgtattggtagaacaggttagtactatatatcattcagattttgaactttcatagttgtcctgacaatgacgtgtaacaaaatatagatgtgttcattagatgattaggtaaactttcaatttttgattccttagaatcctgtatgaaggaggtgaatagtaagatatggattttactacctgtcctgcttggacacattttttttcttgacatcactcttccatacacaaagccatgtgcactagatcctctaaggttagggtctgtgcatgtatgtgtggcaagcattttcagcatggttctgactcatcagcaaaaccaagaagcatggcttaagagtaattcactacacagaggagaagaacccattggccgcatgtgtaatctcttacagtttggtccatactgatgtcctatgctagggaaatcacttggtgctggagatctccaccctaggcctacacatagtaaccgaattgcaaccttaaatcttcatatatccggaatgaatgcaatggcttgaaaagcaatccttagtttcccaatgcttagtttgcatgttacactgcaaacgtatgttgataatgaccatctgttataaacattgtaccattcctacatttataatggtcatatgataaatgtctaatatctaagtcctctgaagaagtacacagttgccagggttgattctgtttagatgttgtccataacatgaatgattgtctatcactgaaatccctctttctccttcccttccatttcttcagcgatgagtgtaaatactatttatgaatctaatatttgatattcctttaagatgaggagatgtaaaataatacaagtaaatggtgtccctgtcttagcttttcctagcactgttaaatggccacagaagcttagtttatacaagtaacgaattagcctaagaccatttcagtttttactgggagcctttactgagcctcactttgggctgggtgcaggagattatcacaggacaaactagtgaccagctttcaagccaagacatttagttttcaaaggaggcaaagttggacaccttggtgattgtgatgtcgtaggactctcacacgacttatttccctttgaagctaatgagaaatggagtggtagttttttcctttcctcatttgacttcaggatactggggatcatctaattctagagtttgcagataagcaaactcattttaaaaagcatgataaactgtctcttgataagaatttgtggtagaaggaactccatctccccctaggagtaggttacatcatcataaatccatgagtatatggagcacgtgtcattgccacttattctgtgaggattggagtgggtctgtgcttagcactcgaatattggacatgattcaaatatgcgtcaagtgtgtctagagggtttattcatacctattttcttttagtcagcaatgcctcataatgcctcggtttcatgaattaattttaatggaattaaacttgaacagctcaaaattatataattaatttcattcagcttcaattaaagttactaattgaatcaagcctactagcatgacacctggcggcagtcagcttcgtaacagtgagagcacggaggactgctgataagtcagttcctgtgaactggtgaggtcggagaaagtctttcttactgataatctccaaaaggctgggcttgactacagcagtaaagaattctggaaccctttaagaaagttaagattttaattgaaactaacacatcatttgaagattacattttcccctctgataatgctgaatagatgttacataaatctagaacatactggtttagtatactttcctttatatttcactgatgtttgaatatggttttgcagtctaaaaatgcttaaaaccatcctctgccctgctttttgtcataatcttagcctctgggtttcaacctgagtttacacccaactatttctcatgtgttgaaatgtgctttgtgacagaattgttaatttgttgtgaaatctctgagatacatgaaactttttttgtttgtgcagaaatttcttctcccttctactggaaatgttaacaagattgactaacaacttctgtctgagttgcgtctccttcatttctttgcctccgtagcttgatatcatggagcttcttgactttcccctaatggtgcagactccattctttctgccaatgagctcagtaattggaaatgcttcagcagtggaatttgaggatgacgaatggtgtgtatccagcaagattccagaaactgacctgactgggccagcaagagagtgaagagaagacaaaactcatggacacacacacagtagggatcaggtgtactgggctctctgatggagaagcctgcagcatgctggaagctcatgtttattttacacagtggaacgtgaaggcagtgtttacagtgtacagctgagtcatggagggtttacagataccggtgagtcaaagaggcagatttagctaatatcagcagaagcagtctctacaggatagctctttttcaggttgtaagggaggagggcatggcctatattttctgcatacaccatgattatgcactcttggacgagaggaaggttttgcaatctatctgagactcacatggtgtggaatgtgccaagtctccaagggtcttaggctttagtccttgacgtggctggctcaagtacaatgatacacatttactcaggatcttcaccaactccctgcagactagctaactatacctttgtttctggtttgtacactcacatactcagttttcaaatcttctcccagactatgaactgcacagaggctggttaatatgttatctttcaagatatggacaccacccagtgaaatgaatacatgtttgtatgcaccatatgtttctgtgtatataatgtataagttattctcccattctttggatctttcaccatcaaatctagatgaaaagattggtcatttcaaccccatccacttatctttttaaaccttacttagtttctcacatctgccactgttgtcactcagctaaactctcccttggtgtctattagaacttggctaactctccacttcagtgcctgtatgagctccttttctgtcgctatggtaaaacaacctgacaaaaccatcttagggagacacggtttactgtggagacatgcagttcctcgtggcttagaagacaaggcctcagaaagagaaggcattgtggcaggaacaggaagtggcctggttacattttttttctgcacttagggagcccaaagtgaatggaaggtggaacatgctatgatacctcaaggactacctaccccaagtgacccatttcttccattgaggcttgacctcataacatttccacaaccttttcaaatagccccatcagcctggaccagctgttcacatatgcgagtctctttctctccctgagtctgtctctcctctcctcttcctgttcttcctctctctgtctctgtctgtctttttctgtctctttctatgtctctttctctctgtctctctctgactctctcatatccagtgaatatataaaggatataggaaaagtgcatctcctgaggatagctccttgtctgtttcataaaatagaattattcgtcctggccccccaatcaattaggattgagattgtttattaccccccttaatatggagccttacttggtcatttcacaaagcttccatagcttctttgatttgccccccttgcttttgaattaagccaagttttcctctgttgacattcagatatccacattctatcttcatcagaacttcacagcctcacctcctgtccttctgaaagagcttcctagcctggagctgggacctttgcccaagtgtctgcttttggagttttcccatgctgttcttctacctttctcccatgtgactttttgaagttcttctaatcttttagaaaccatccaacgcgctcccttctctatagtgtctttcttgatctccgaatcctgatgagattttttttcctctgatcgtttgaactcctttagtgcactggacctttcatagcatgcattttaccttgtgttataggttgtgtgttgtttgacttatgctcccaacaagacattccatttccttacatgttgtctttccatccgagaactcataatcctacataccaacctctcatcctaaacacttgcctctccgaggaggcactgcacactctttgactttttccttcggtttctatagagagacctctgtatctgtttcctagatcctcactgcccagttacttctcattcagctgggctctgccttttatgtccatcaatcatttgtagtctcttctcctttgatactttttctgtctcacctgcctcctacctgtatggactcactcgctctcatccttgatgtaacctttctacattcctctgctatgacagatcacctactgtgctaaaacttatttactgctgtcttgatacgttttattttcttgtgagcatgcttccttaatgatgaaaagatagtaggtgcccaaatgttaatgggctaacaatatgtgcaacggccaataatggtatattatatatttccttaacctatggcagacttggaagcagtaagaaaaacttatgtcatgtgtggtgctgcacacctatgattccagtacttgagaggtgctggtaggaaaatcagaaattcatggtcatcagctacatggagagttccaggcctatgttctatgagatactgtttcaaaaaattcctcaaacaaacagcaaccctccccgaaatacagaaagacaggtagcattcaccaaatgataataaatgtttcatctttttcagaagcatgtaatgaggacaatacggagaaagataaaaggccagctaccagtggccataccaggtgtgggctgatgcgggaccagtccatttggccaaatccttcagctggtgaacttgtcagaagtaagtatttcttaaacgagaccttctgagacacagacttatgattatgaaagcatacctagttaccttcccaagtaattttgctacacatctctaagtctgaaagtgtttctattggtgctataaccatcagagctaaaattaggatgtaagtcactatgagcattcatatcttctttagaatggaacaactggcctgtaaaaacattatactctatgttagatttagtcagctctttctagagtgaggacccattggaaatcaagtgtcgtctttaaatacctgttgtacacaatatcagatctaaaggacaaaatgctcttggggttgctattcttttggtaattgatacctaacttgtttttatgttgctatttgtatctttgtgatgcttctcttgcccctgaggtggctttatagagtatttataaagcattggtgtaattatttcactctgaggattttaggaattatggtatctttcaggggatgttcagaattcaatgtgaggctttagatgtggaacttatgtctctgagtctccgagtctctctaggtagctcaaattacatttgccattgaaaagaatttagtacagggaagagtatatatggccatatttgaaaaagcatagaaggaaatcttttgaattcttgttcatggttactttgtctcggtattagcatgctaaagtgcagagagaatgcatttctcgcattcaagtgttgtactatctaatttaattttcactcatcagttcagagaatttataatatagattccctcttgtgttatattctttttcttcaaaacttttggtgttactttcttttgaagaatgctcagttcctggccctcagtgaatactaagaaaacatcaacttggcagaaaattagcaataatagtaaaaatactgttgagatatttatagttttcctttctaaaaaggctctccaagcatgttctcttaactttaggtttgagatacttttggctcagagaagggaataggaaggaaggaaatataacatagacattagtgacaaacaggatttataagccttttccaaagaatcacagaaacggcatttgaagaaaagttgtccctcaatatatattgatcctcttttattgaaatattaactctaaaattgggaaaaacaaggcttggtgaaatgctggcatattttgcatgtgatttcctaaaaactagacttggagctaaggtatacaggagagaatttaaactccactccctgggggacacatgtgagcccctcccaatctctgtctctgtctctgtctttctctttcttactctctgtagaagcagaattgtaagagtttcatttaattaatttgtttctccagttttctttcccaagcccacagtagaataatgtaaataagatcacctaaggcaaaactccaaatacactgtggcacaaggatttggagatttggattaatgtgttacaaagcttttttgctgcttgatggcgctcatcctagacacagaattcatcttgctaaaagacaggattaaaagtgaattgttcttcccattgtctttcctgggtaagtagacatgaatcaaaaatattgcagggaatagtttccttactgagctaatgatgcagtgtgtaccatgtgagcatttgggaacacgtgtttaggtcgctactaatgttcccagaaagaatgtagagatagggaggtctatcacctcctatgggagtgctgcggtgaccattggcagttaaatagacttgagaaaataatagccacagcctgtagtagcaggggaaacctgagctggcaagcattttcaaatacttgtgagtgaccatctgactcagagtgaggattaaaaattccagagcctcttacttctgctagtttcccagtcatgcttttgtagatgaaggctatcttgttgggtgtataagaaacattcgaagtggaagaacttagagcatgctaaatgtgactccatcacagccacatcaagaagtctcctagcgtgatagcaaaagccagtctatctctctgagttaggagtccatgaagctgtctgtctgcctttgcttcttcaacttttccaatagcgtcctcagtcatttctttttaagtcaatgtctgcttcccacattaggtgagatgggtgtgtttctcttgctttactgttcagggccttgtggagactcagcagatcttataataacaataggccttggaaagggagctggtggctcaaatctccacaaggctggaagtgaacataagccatgagtcagttctggctcgctcctgttccaggagcgctgtgtggctccctgagtgccgtggaagaacaggacagctggcttctacagaattgatgtgagtgttcccactgaggcgctaggttggctggacggatggagagagcatcagaaaaagaaaagaaaaagacggctggggtgtgggaacagtttcaaacgcacagcccactcttttttccagtcctccatgggatagctcagctgcataagtcaaaagtgcaaagagcaactgttgaatctgactgcgttttctttatctgctcttgagaggagtttctgtgggctggtgactcactggctgtctccactgtccaggaagcctgctgctttctctattggacatttagggggtactttataacggaccgatatctggcaatgtgaagcggctgtttgcacttttcttcactgagaataaaacagccctggaaaatgaagggagtggctgctttggaaattacattctagttagagggtgtattctcaggcttcctagatgagacccaagcagagaactatttccaaattattccgtgaactttaaccctgacctctgtggaccacctgcttgtagctcacaccccgagttggctcctgtgctgggcggatgtttgagtttttctcatttctgtagtccttctagaagaaatatggaaggtggccccccaggggttgtgatttgaaggcttgtatttcaaatctgttgcccctgagttgctaacttattagagaaaaaaaaatcctttctggaagtaataaataaaagaagaaatccatatggaatgaaacactttgaataaataggccacacagagtctagtgcaggaatgtgccttgtgaatatctttcttacaaaatttaaatgcaaaaaaaaaaaaaaaaaaagacagctcgagctacttatgtttgttttttttttttaaagtcttaaattagcaaagaattaaagcacaatagtggttttctggggaaattttaaagttggaaagctttctttcctattttattatttttaaaaagagacacttaaacgcttaagaaccattcatattctgagaaaatatctttgagtataatttaatttggggggatttatttcagattctagaatttatataattttcttgttttccccgagagcatggactgagacctcggtttttctccttagaggaggacatatggtgtgctgcataatttgaacctatactttttagtagtgctttgttttaataagcaccagttttctgagttcataaaatagacattgcaatgaagtgacaccctagttaatattcatttttctatttaatctgtaatacacgcaaatccataaaaagtaattggcaacataacatgttttaattataattgagaagaaatgatcacggggtggtttctaagataggtggggatgtttctatgtctacatgcagaatcatacatacgtgttcacatgcatgtttgtgcatatgcacttatgtgtgaatgtacgttatgtacacatctacctctattgacaggcagatagcatgtgtcaacaatgttttggtttaatttaggtcaaattctactatcctggttatctcctatgaagcgcttacatttttctttgttcttcttcttaagtgcctgaggtctctattgcagaattttctaggtctttcctgttacttaactttatccatggacactgctttgtatgtaaatgcctctaattctaaatgccactacttaactccagaaatttttctcagcttctcttctaaaataaatttcccattaaattaaaactgtttggttcagctaactctctccttggtgatttttatagaattcccaggatctgaagcagagttagaatgctctacttaaacggcaatccccatcctgtttaacccatttattcattgtgaagagttttagctctcataatagtaagcacttaattggcaggagaatgcaagccgctctctaattcacacttgcccgcccttaccgagccacggttccttccattgccactcaccctcctacttgaagccttcctcttggcatcctctgagtctcctctccagatcaacaggctctgctgttagcaactctattatgccttttctgagcctctgccagcttagagctgatcacccttaatgaacaccattccatcactccaggggattctgcctgtgtggaaaacacagaaagaaaggcaggtgctcgggcatactgtcatatacttagaacatttcttatttcgatgggagggagggagggagggagagagagagagagagagagagagagagagagagagagcgagcatgaagtggttttgatttaagagttttccacagctctcttgtttgaatgcacatttcaacaactattatttgcctttctttggagttcggtttatatgaaattaaaaattgtgccccattgatgtagcaccttgagaggactggtagatgtagcctattaaaaatcacgcttcttattaatttcaggcattgcctgacacttcatgctcattcatgtctcggagaagtactaggagcaagttgttctgacttctgagttcctcagtgtcctttcctgccctatgcagctgtcaggaaactctttgtcttcactctgctgaccaagtgtttacacccactcgcacagtcgctttgcttattgtcccagagcacaccatgtgatcatcagttagtacaaatcaagcgaacagcttggtttccagtggggtgtgtgtagtggtgagccatttttggatgttctcctacatttacctcctctgttaattgtaaccatctagacccctattctagagcagaggtgaagtttcctgacacaattcactttcatgatagattgttccatgcttaccctgggttctttcccttaattggagttaaatagtgttcatcttttgtgttgaacatcttaatagtaggtatgggaaggccagtggaaatgaactgctagggaaaaggtcctgactgagtggttacttaccactggtgttgagtaagttatctaacatcagtcaactcctcttagtccccaaatggagcctaataccaggaggctcattgtgtcattttgaggattctatcaggaactttgtgttccattgaaggaacggatggtatgttagttcatcagtgtgcattagtattatccttgagctgagctatgaattttaagatatttttcttttcattatggtgcattgagccagatgcttggaagcactacgatatatagactatgttttctaagacctcctgatatcatggccacgggtttgctgcattcagctgattaagagctttaatgtgttataaagtagcaagatgtttataaaccattatacagaacgtaaaaacatattgtgttgcacttatgggaataggtgattgcatgcgtgcctcttcatcattctccaaaccacatttttcttttctttttctagttctcaccctgtggggcaagacctcctcagaggtcgaacaaccctttcgcaggggtctcctgtcagatatcctgcatatcacacatttgagttacgaatcacagtagtatcaaactacagttatgaagtagcaatggaataattttatggatgggggttggtccagcatgaggaactgtactaaagggttgcagcgttaggaaggttgagaagcactgctttagatcaattccaggttaagaactcacgggtgtttctgtgaagactgtgtggctgtaggttaaagtttcctgagttacgcacgagacaacaaatgttgtcattattgcgcttatgcctctgtttttgttctaatttatttgtatatgttcttcatcataagctaggtcacttgccttttaatctacatcatatatttgtctgccacagattttcaagttcttcctggtcatcctaaagtctttggtccttccttgccagctatgtcgttgagctggagggcaggtaggggatagggcttagcactgacctgagatttagcttctcgtttgtacattttttaggcctctaagaagaaccgaggcctgggaattatcatagagatcatctcaaaaaatgttaacctctgaagaaatgaatagcatttaattatcaagaccacaagtgctgtggtgtagataatttcagttctccaacctcaaacttcctgcatctgaaaattctgagaacttgtacagatattaatcatttgtttgtagattggtttaatatgaaacttttgggattaggacttgaactaaaactttgaaaggacacattatgatggttttgtttactactgagttacggtggggatcgagtcatgatctatgcaggtgtagcttttgcatgtgaaatttatgatcttgtgagagagacagtttttcctgagatgattgcttgtgttagcaataccttagggaaaagtgcagggctactgtaggtttacatgggagaaatccaagtcctgacatgggaagggcatcagacagagctttgcagagggaagccatgaggaagccatgcctgtgattctaccaaaatggtttagataactaaaacaggatgtgtgtgtgtgtgtgtgtgtgtgtgtgtgtgtgtgtgtgtgtgtgtgttggtacaagtcaaaagcacagcacatttttggatctagaaataaaagagggaagagttgaatggagtcccagttttgcatatactgggacataaagtgtgggatttagaggaagagagcgatggcagggaaagacttccttaggtgaagactgatggtgttggagttttgacctcataaggtttatgctgttttaatctgaacttatttttggaagattgtttttgtaatgctttggggagtaaatagaaatgaaaaggactgaattccataaatcatgataagactgttgagttaactgagataagaaaggaaggtgttttgtctagattaggtacagaggattgcaggaaggaagaaacaggaagtgggtttcgctctagagtctccctctcagatctttcaatagggtctcactctaggcaagactggccaggctagcttcaaaatcatggcaaccctcctgcctcagcctctggagctcagatgtgaaccatttggtgttattcacaaggttcattatttggtgaggtgaaggcaggcagatgaaacaagtgctgggaacaaggctaaggattttggttcaaataaatgttaattgttatgcaaggacaatgcccccccccccccgcatttaaggtcctgtcatcagagggtttaaaatgacgagctgtgggtataggggagaaaagacatgaagaggcttacaaccaaagaacaaaaacaaatactccagaaaagtttctgttctttcagactcaagataaaggactagttgtgattgctcgataggaaatgtggaaagataagctcaaatataataacagaaaataaggatttacagaatgtaaatggaaccattttaggtgagatcagggctaagggtggtcatagggatgaacaactaaaatggttcatgtcaaactcagagggctaacttcaacaaaagctttggaggtttttgaaaaagtcccatgttgcctagcagggtagcagagagatgcaggtgtttcttcctgttaacagacctagtggtggagaaagctggggccttagctgcctgtatgctacacctgggttctctgcggaactgtcctgcagtagtgcccatactcgatagattatacagctgtttccttctgtgtgcttgtatgtgcttgtgtgtagataagacagaagtagcttgatatcaccaaactaagcctctgaaaaggtgggaaatgatgcaggtcctttgaagctgctgaccttgattattataagactctaagaggtttttctatctattacagtaaacacccaacattggaatgaaaaaatacatatgccatgatgagtattaccttcatgatagagatgtgtatagctatctgtatcctgtatatatagcattgcacatgtattttcttactacaaggtatgtggctacttatttacagtagttctaccggaaacttcggtgaaattgagtgtagacatataggtgaaaggtatccacctaatattgtgtatagctagtcttcgcttctgaccactttctttagtgagttactttattacattaaatgtaatttgataatattaaaacaaaacaaaacaaacaaacaaaataacccaagtgctcctacatagcaaaaataaaagagtagagagagagtccaccaagcatacacagggcaagcttcagggtatagccaggctaggaaagtttaattttttttccttcgggttctgaaaacagcagaaaccaccacacaatttgtgggatggacgatagtagaaatggagagggaagaagggagaaagagacagatagagagagacagagacagacagagagagacagagacagacagagacagagacagacagagagacatagagagaaagaaagagtgatacacacacagaggagggagagagaaactcttattccaaaacactatgaattttaagcaaatagagagagcattaagttcagtgctgggctattttaagaactgggctctctgtagctatctatacagttatatgtcagtaaagcagggtgtggatggagaggcagtcataaaggagcagggatctagttttgctaagcatgaagcactactggatcttaattttataagttacttctctctgcattcttgcaatgcagagtgaacgggggttttctgggtttcggcaaatctgttgatctcttagttaacaccactgagtagctgatatagctgaggaagaaggaactatgagaatctctgcaccgtgaagcttctccatctgcaccaagcacagcctataggagggtgagacttgctttcagctcagtccatggcttgaaacagaggatgagggtgtacacggtgagagaggttgtggaaagcctttttaacccctttcagaagctctgttcctttctcgacacagcagagggaagaatcaatgctataacttctcctgtttctttcaactagtcctcaggagtcagtggcaaatcactgcgacacagttctccattaaaagccgaactcttcccaagtttcttgggttcatcagcaagatacacaaaaaccaggggaaatcgctctaaagctctcaaatgatgccattagagggtggaaattgcattaagtgaaacagagacaggagcggatacagaatgtgttctgccttggaacactatttaattaaatacatttgccatggctcttgagaacttgtgagaacttggcctggaaaatttaagaaatagagattcccaccatcagaaattgtcatgaataattgattcagccagaaaatggctgttcggctcatctctggatgctgcctgccattccttgtcccctttcccactttgcagattgtcctgtcactgttcctttgacattacaaagctactgtcccagccacagagagtgacaacagcaacaagtcccatttcttttatgaagccaaacaattctaaacctaataatttaccattggggacaaagctaaatccattttcctataaattcaaattttaaatacttgaagtaaggtggctgatgtttctgttgacagtttcttttaaagatcaataatatacttatattgacataactgacattctaaataactttagataacttagttaatttttaaatgacttaaatttctaggctaatgactcaatgaaataaaacacgtataactattaaaatatccgtttaaaagataccttgaataatactgacttttctctacgttccaaacttgtttaaagttactaaagacttattgagtaaaatcttattgtttgaatgcttttaaatgttatattggttgtgcatctcagtcctgaattcttagtgttggagattcccggatgacaatggaaaggagagggctgatgcttagtgaatcaaagtgtatgttatgtgactgtgaccctttacccagcatgcatacctctggcttaacccaaaggtgacatctgaactctgactagaatcttgacttctgagtcatgattccgcagtgtttggttaacccagggcttctttcaacatcatcaattggcatagctcttccctttgaagagctgactttgtttctgttattttacaaatatgggaaaaaactttgtctttatctcttctgcttaaaattttcaaatccagaattcactttcctgcttttccacaactttgccttagaagtaaatatggcttccagggctgtagatgatagaggaagaaataggtaccattcaagagtcttctgtacttgatggttacactccagtagactaattttcttccttatcctttctgtagtatttgatggaacacaacttctgatggacatttcctccctctatatatctagttccactgtctgcctctgtagtgagcctgggtttctcttctctgagacataccattccttctaaggttgtgtcaacgttgttgtcttcccagatacccacatcctgcgacactcaatattctttcctttttagccagtgcaacgatttgtgattttggtcaagtccgtgcctacagtcacaagctcaatgacatggacataagcccaattccaggaccacaggaaacattcaggcaatgaacccaggtgattgaatctgggaccaacatcaggcctgcttttgatctcaccagttcgtttcatgaacccgttcatcctcttcttcctttgtccttcagggcaggccttcctttgtgcttcttctatttgttcagccaacggcaaggccagtacctttgctctcatcaggacagggtcagtctgtctccctcaggacaaactcactgcttttgaggttgcagtccacttgtgtgttacctgctcatccactgcggggctgtagtctcctcaaggcaaagttggcatctcaatgaattttggggcgccctttgtgcacatagaacaggcaggaccattctcaggttggttcatctattctgtgttcattgttggataaagggaagttttaatcagaggggagggattttatgatgtcttgggtcctctagtgcttatttatttatttatttatttatttatttattttctctaacatgtaagtatttcaaacccaaattgatgaaaatgcctgttgcttcactatcattaaccatgaggccgtagcctgccttagtgttgagttgtgggaaaaagttagaataattgcaatatcctatatgccttccatatttcatatttttctgtaataaattcaagacaatttctggttttaatataagtgtgacatcttagaaaagtaactgctttggttttcataactttgagcttggtatcattccaagggagagataagaaccttggcatatgccattcttttttgaaacaccatttctttttcaataagaagaaatctaaaagactgaagttgaagacatgggtggggcagggacaagatgctgtggtcgcatccctctgtggggagcaatgggtcccactcttcatgttagcttaacaaacagtttttgaggtcccgcccaaaccaattaacttggaatcttgtgggagtggaacttagccatccttgagttccctggataatttcagtctgcagagaaaccagtaaggtttgcacttgaacatactgccccagaacagatgtatttgtagaataatctgagcattagttatcagctaaacatttgccttaaaggaagagaaaatgaaaaaaaggcagtttcttatgattaataaaaccactaaaaccccatctgtgtgactagtagagcaggtaccagattctttttttaatcccatagtcctttggggaaattgttttctcacacattgttcagatgtgtttcttacttttagtttcactatgcatgacttgtcagtctcattatattaaaacagaactatttaatttgcacatgtagccttgttaaatggcagaatgaaaggacttcagagtctcttagatgtaatcttaaggaattatttgattgccttagtattcttgataccttaaataaaaatcaaagtttatcttatatatgagtgaagttctaaagatgaaaatcatgttatcttattttatgaagaattacacacacctgcctctttcatcttcttttgatactgtgtcttcaattggagtaagcttctctttcagttgaaaatgcctagaataagcagtctctaatcaagtgtttgtagataacttggaaagaatatcttaactattacatctagagcttgttcttggaggaaagtgaggccttctgtaatagagatacggtttacctaagagccatactaataagaggaaaaatcagctttttgaataatatatgaatccatatggtatcagtggtatcaaggcatttgggacaatacataattagtttcaattccctttgagggggagatgtggatgttaaaataaattgctgatgaagcacatactttggagaacagtgtatttcaaaactttatgcaatatcagctatttctttcaatggtatggaaatacagagggagtctgagaagatttattaggtgtgattttaaaccattcttatgatataaaggttcatagtttgcttatttaagacagaaagtaaaacaagaatgatagccagtgcttcgagtctctggaagaacacaacttcaatacactgtctggtgcctttgtttgtagtcaatgaactaataacaaccacgtgtttgtatgtgagctacagcatgacaatatttaacactacataggacttgagtatttaaattacaatgagtttttctttgctaatgagcaactctgaaaagtcagcattcatagaataagaaaatgtggaatcatgaaataaacaatgggtaagaaagaagaatagaggctgtaatatgtacgatgtcttacgtgaaagagaaagaagggcctccctgcaaggaactgattggttgcacagatttcgtatactaaactagaatttgcttgcctggtagattttccagtcatccttatgtggaatatgagcattgcaccttaatcatggaagcagatgaggttacagtatgcctaatgcacagtactacatgtgtgcagttttctgcttgctcctccttttaaaagaaactcacatagaaaatatcatacctcctcacattggcttcaacttttattctatgcatttaaagcagtatccttaataactgacaaaaaattaaaatgacttaaaggcaccttagtgtaaaatgatttatggtataagcatgacatagtcatatcatagccctaatacataataaatactacctagccaaaaaataggtaatatatagcacagtgtcacaaatgctcacatttctgcattctctatagaaataataaaaatccacaaaaatgaaatctatacttcttttggttctttttagacagcgtctcagtatgtagccctagctgccctggaatttcctatttagatcaggctggccttgagttcatagagatcagagtgtctctgactcctaagtggtgggattacaggtctgtgtcaccacattaaaccttagtgctttgagggtttttctttttttgtatttatttattttttgattttttgagacagggtttctctgtatagccctggctgtcctggaactcactctgtagaccaggctggccttgaattcagaaatctgcctgcctctgcctcccagtgtgctgggattaaaggcatgcaccaccactgcctggctgctttgtgtttttgaaatgtatatcttgaaggtggtgtggtgatcatcattattttaaataacgcaacctttcttcttgaacagtgaagcccatgacattgctctacccaccacccttggattcacattttgcacagacttgcttgttttgataagcctggagttcattgcagttgtatgaaactggggcgtagtaaaacactgattgggaagaagcctttaatttagcctgttttcctcatgttatctactgttttaaggtgacaacatttgaatggtacagttcccagggtatttatttaatgtgcaatgaccatgtgggagtgctcattttctgcagtttttttttttttttttttttttttttaaactcaaacaagggctaaccacaccattttgagcctaaacacccaagctctcagagtcagaatctagagctttggtaggactgggagggaacaattatagcctggtcagtaataatgacagattttaatgtccaaaacattaaattacagtgaattgaaaaatgggcagtttgtagttttagaatagcacttctcagagttggaggcatcctttacggatggccttcttctccttctcctcctcctccttctcctcctcctcctcctcctcctcctcttcttcttcttcttcttcttcttcttcttcgtcttctctttcttcttctccttcttcttctccttcttcttctccttcttcttcctctttactgatgctatcatttttgtttctttgtgtatgagtaagaaaagtgacaatatgtatggacagtctctttgggtgatcagcttgttaccatatgtacctctatcctaaaagtaccactgtgatacccatttggcacaccacattaaatcacagtcctttgactgttacatgctacaatgatggtttcttacacaggccctacttttataaatctttctaaagagtcatttcagctcagataatttccatccattgtccacctgaggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctacactggggcacctattgaaccttcataggaccaaaaatctctcctttcatggatgcatcctctgctacatatgcagatggagccatgtgtattcctttgttgatggcttagtccctgggagttctgggggtggggggctggttgtttgatactgttgttcttcctatgggattgcaaaccccttcaactccttcagtcccttctctaactcctctattagggatcccacacttagtccaatggttggctgctaacattcacctctgtatttgtacggctctggcaggacctttcagaagacagccatatcaggctcctttcagcatgcacttcttggcatctacaatagtgtctgggtttggtgatgtatatgggatggacccccaggtgggaaactctctggttggtgctggttcatctgtcggtcagcatgtagaagaacgaaaatcgacccattcctatccccttgtacaaagcttagttccaagtggatcaaggacatccacataaaaccagatacgctgaaacttaaagaggtgaaagtgggaaagagcctaaaacatatgggcacaggggaaaaaatcctgaacagaacaccaatggcctgtgctgtaagatcaagaatcaataaatgcaacctcataaaattacaaagcttctgtaaggcaaaaaggcaaccaacagattgggaaaggatttttactaatcctaaatctgatagggggctaatatccaatatatacaaagaactcaagaagttagattacagagaaccaaataaccctatcaaaaaatggggaacagagctaaaaaaaagaattttcaactgaggaatatcaaatggctgagaaacacctaaaaaatattcaacatttttagtcattgggaaatgcaagtcaaaacaaccctgagattctacttcacaccagtcagaaaggctaagatcaaaaactcaggtgaaaacagatgctggtgaggatgtggagaaagaggaatacttctccattgctggtgggaatgcaagctggtacaaccactatggaaatcaatttggcagttcctcagaaaactggacatagtattacctgaggacccagctataccactcctcaacatatacccagaagatgcgccaacatgtaatatggacacatgctctactatggtcatagcaaccttatttataatagccaggagctggaaagaacccagatgtccttcaacagaggaatggatagagaaaatgtggtaaatttacacaatggagtactcctcggctattaaaaaagatgaattcatgaaattcttaggcaaatggatggaactaaattttatttctaaatagagtttacttgtcaggggacgttgggcaagtcattctgtctttcaactgtaagtccagccatctttggtctacacttagaggtaattcctttctcattattcagttgattggtcaagcaagataatctaaatacactcttcactgtccaagtcctcaattaagaggctagaggaagaagtgtgggtacactgtagattatgctgctctggaaatattgccttttcaggcacaagtgtgacatgcagatctgtgagttgcaaggccagcttgctctatttatctataactgagtagcaaggccagacagagccaaatagtaacacgtatactgttcactgttttacccacttcctccttaagcatttactcacgtggaccagatgctatgaatcagacatagaaaatgttcatttttttaaagccctgtgaagggaaatatactcagttcactgtcacattgtctagtgactctctggtagttcgtctttctgagaaaatactgatgctcagcagtctatctatggtcctgtgatcacatgctggaaaagatgaaatacttcccggagaagaagtaacatgtgataaatatgttggtcagttctctgaagctggacaaagcttgagaattattgcctgaggcttatgtactttaactgatcaaggaagccgggttaggaacaaatttagtaaaaacaaactggaggaatggcctcagccctaagatctgttgaacagcattgtgattcttgaaaaccttttctttgttgaaagagcaccaagccattcctcctccatggctctggagccctagatcagttttcaccaaatggcagcataaactggttagcccatttcagaggcatggggtatatgccttttgttcttgcaaggtaattaaagtgtaaaatttctgtaaatgcttcctaatattctaagttgtggttttatgttgcatttgtatacagttggtgactgtgcttggtaacttcctaagagcccttttgtcgggagtgtcttgaatcacatcaaactatttactccagcttcttttggtcaatggaaattgagaatggtctcataaatgaataatgtattgtagtcatgggcttgtggtaaggaaacacgggatccagaacagtatttcctggaacagttacggaagcacgtcctatgtttttccagcatattcattattgtttatagttttaactatgagataaatggattatccaaagggcagtgtatgatctccctagggaggctggcttcttctcaggtcagcaaaagccctgaggtctatcggcttccaggttttgccaagctgttaggctgaccagattcctcttccttctccttgcgaggtctttttcctttcagctctttgttgagatagcctttgtagctttccaatatggaaaagtgttttgtttttttcctctgttattgggaaaatactgttttgagtagtttattatttttttcttttactttgtaatagttaaacatacttttcagttttgcactattggtgctcttcaccaccgtttcactagcctgtgcattgtgtctgatacttaaagtacactcagcaagcacatgataataggcagtagagcacccaaaacaaagcaagacaaaaaaaccaacctcactcccaacaaacccagttctctgcacagcagctgtttgcgccaactgtttacctcaagttctaaaacattttgttgctttagctttttattatctctaattatttacaatttcttgtccactgttggaataattggtaatattatactaatgtgaaattaatatgaagttcatgataatccataaatttgacatttttcccctaattcatcagaatgagaaatcatgataggcctaatgaattacaggctatgctgggtggttggggatttagaggatctggatacgtgacacacgttataaacatcaccaagggaaagaaagaagccagattccattagggagtgtggggaaaggcaattctgcttagagtttccatgagagcactatatagttatcagtgcttcatttaaaaaaatgaaactgggcgctgtggaagaagagctactgcttccatctttctatttctgtcatttttgtgatgttcattgctctaaatgctggagcagatactatgtggagctttgtaggcatatgacacatgggtgtcatagtaaacacaaacaaggtgcctgatggaaaggaatacagagtttgatggagaggacagtgttttatacatgtttcttcttcattccaaaaggagagtgctacagacatctcaggtagaaccgtttagcaaagatgaagagttgatgaatttgtggtgtagttttgaagtaagaggcagtggagggcatcccatggcagtggatagaagagaacgtcacaatggagagactgacacatttgagaaatcggacaagtttcatataactggggaccagggaaatgatgggatctgagatgaaggcatcataggaaatgtttcactaacgtactgattttatcctaaagatggaaaaataaacatggaattctttatcagtacagtaaggcaaatagagtctgggttggttctgtttgtgttagtttgaaagtgggctggaggtagagagttctgataaggtggccttgatgactttaggtaagaaatgacatggcctggtggggcccaggcagaaggaagaatgctaagcataggcggcatgcgccacagggttgtgtgagcggaggcttggttgagatccacagggagcctgcttgtggaactgggattcttttggatgtgctcttgctcatccctcaaccccgccttcatcgtctctttcattctcctgcattcctctttcatctcctgttctgccgtatttttcctttattgttttgttttatccttgctttctgatattgtatctcagttttgtctttgcttttccttcttcaagaacactgtgatttaaacatagtccgtgcaaacaaaacagcatgtgtctgtgcactgtgcttctgcagggtgttgtttatacacaccctcgcagaggatgctgtcgcgtaggaaaatgtgccaagctgtatagatgaaagtgattttatttttgttttgttttgtttttcctttcctataacaaaagcaaactcaacatactgtacaagtgaagctagtgtgtccttgagcacaggacagcagaaatgtaaatcatgtaaacattgaaggaactgcagttagtgagaggatgccacacgttgttcactctgatgtctggcacaccggaaaactgtgatgtcattttgatagctactctccctacttttgaatccttgcctttaatgacaataatgtgaaattaacactcatagggatgtcctttggatttattgttacttgaaatcataaatatccataagctctatggtggtagatgacttctttgtaaatttgttccctgttagatcccttgtccctagaatagtacataacaaatattttataatgacttatttcagccgttttgcaggcaaagtgaccttgatagatttagtgtattttaatggagaaattaggagaggaaccatttatgtaaatggtctcaatctgtgactcctcaagtgtggttaatggctctgtccctctatgtgtagccacttgttgatgcttttgttttaagtaatattttattctgtcaagtaatactgtaatttgatgactccaataatctaaatcagaatctggaaagttaaagcaaccgtattaaagagaagttaagatttaaccttggggttgcgaaagggaaaacagtgttcagtgtttggctccttattcacttacatatttattttccctattatgtatctattatatatatatatatgctatgtatgtacatatttaagtgtgcaaatgagactctacgtgtgaatctagcgatccttcgcatcacttccttatagagaaatgttgccaggatcctctttaggagtcaaacacgatgattagggcctgattagcgtttgagtcaacttttcgaactttactttcaatcttgaatcttcacattatttcagcaggaatgtcatttgtaacaagaaatgttactaagcctaaagcacagaggtttcctagtctcagaccacttattgaagttgctcccatcgcagctgctcaccagtgaacttaggatcatgagcttggttgaagctgggggtgtttcttttggaaatttgtttttcttttggtttactttatttaagctatcagaaataccttttccttgttatgcagtaagttacttggttagcattttaggttagcattctacctgacttcatcccttttacccgtgatgtcatctgtacatccccattgccccatgctcaaagatgcccagtctttgcttgcccactaagttgagtttgcttttgttatgggaaggtcctcttagatatataacttggcaatgactttttgcatgctacttttggaaaggttacttagtgagcctttttgatgcatttctccacacatcctatgatatcggtaactgaatctttaattcccttgttataacagacagagtttcttgagtcttcactacagttctactctccttctattatgcttttacagcaattccctaggctcgggaaggtgaaggatgaagtttataatggtactgaataccaaactgttgcttgatttattcaggaaggttattatattcagggatcaagtgacagcttaaaagctagtatcattcatcatcatcagctaattttcactgggtgtccactgggtgctgagcatcatacaaggctctttgtcagcatgcatgtgcctgataaggttgatgggattctaggaatacaggatcctgtcctccaggaacattctgctgtcaatgtgagtcactgaagactcaggattgtcaagttctgtgtacaaatgcatgtaactaaaaacacttcattgctgcagaaattactgtcagcaaatctaggtcctatcctcattaatatctacactgttgccagggaaatagagagatgttgaacagacaagcataggtgtctgctctagtgacctgagctcagcagcatacatttatgctttgggtctgcagcagatcctttctgtcctatacacataatttcgctccgttttttacttaatgagatccaattgccccctcctccaaacacctatgcacttcatctttccttgtgagaaactagtcacatggattacacatctagatctagtgcctgttcttctctagattgctgtgtgatatatatccctctcctgaaattatttggaagaccaacctagatcaaatttgcttcaacttgttatcatcaatatgtagattaagacagtgaaggtgaggcagagcagcccctgtatgggtggataaggaacagggtgggtctctggaatacttggtaatgagaatagtatgagctgagcctgtgcacagcatttccttgttgagtttcttccctgccttaggcctgtgttctgctgagtgcagtgagttcgtttactggaggcctctgctaagatttccttgtttggtatccatcacagccattgcagagaggactcccttggaaaagacttagcagttcttctccagttgataacaaacatttaggctcggggattaccacaagagtggaaaggcctcaggagatttttatgtagcagtccaatttttcccccttctctcttcctcccctcaccccgtttcctatggagaacctcatctttgtggtactttgccccttttacttttgagatctggccttctctgttttcttttcgttaccacttaactgcttcttgtcaccagcctgtatcagtagtggggcttgctccaggcaatatgtgcttccgttccttgggctttctctacttctgcagtactcctgtgcaggatatggagacgtatttgccgtggtctaaacgtttcaggtttccagtgctgttcttcctgcttagtatcttctattcccctttgtagtgtttttaattccaacactaaattgaggaagtaaaaaataattagcctgctgcaacttagctaacacacatgcttatttgaacttcggtgaatccagatctctggctgttccttgcaatcctatatctcatcgaaggttgcttgatctctggtttcagaggcttttcaaaatttgtctgtatagaggggtacatattctggatttatacagtggcaaatttatttgcatatggcgaaaaatgactgttgctttaggaaaatcagcccttcataaagcttcctgagttttctggttggtgtgcactgcccaataccactttggtgttttaactatagaatgcccagagtccagtgcctattagcaaatcaggactgattcctttgaagagatgaattcattgcaactcttaaactctctgccatcttatacaaatgtcagtatataaaaaaaatagcttttagaaagatcataccttaatggtacttgtttcattgagttattgtttgtataatataaagcatattttaataatttccttttctgtaaattatgtataaaatgcatatgcatttatttttaggtgtatccataatataataagtattaataattatagatggcagtcatttttatcagttgattcagtgatagaatggtatagaagtatctcttgagtcaggaaacaaagagataccatagcaaattctataatgctgtgagattacccagtaaggatactattttatcatatacataaagctcgtagatgatgctttataagcaaacctgaaaatataaacttttcaaatccatgaataaaatcctctctacccagataagttatctagaaactacgaagcatcataaggccagacttttcattcatttgaataatcaagcagtaggtgcgtacatatctcctatgtctggagagagaaaagtagtgggattttgtttttcacagacttatagtttgaggacattttagagatatttatatatcttaaatgaaaaaaaatgttctatgttccttaatttttcctgaatttattcatttttattatatttctcctagaaaatgcaagattatgtttgcatatttatttgacagaaggttttcaatagaagattggaaaacaaaaaattagtagtattgtcacagaatgtaaaaacaggaggcaaacgagaaaaaaattaaaatgtgggtaaactcagtaagggaaattaagggaaggaccaaaaactggaactgggaagtcagtcttctcattgctgccatgaagatttctggtatttgaatctttcaacatccctgaattatgcttctcaactgtgattaaagcttggtggctcccagggtaggtcacacccaaagcctcagggccaggcctggaaggagagtgtggaaacaagtctatctctgagaacctggaccaatggctgaatctgccttcaaggcaagattcagcacaggattagataccagccttgaacaacatggaaatgcatttgccagaagttatctgcctccaggtgttaaatatgtttagttatgtgatagtgctctttatgaaatacggtagccatactccagttacttctcccagcaattttgaacagttggtctcttttattttggatggtactacttcccattgtcatctggtaatttacttcacatttgatttaatcttttaacataaaccacagtattccagactcaagaatggtctctgtcttgtgaactcacatccaaggagccatagcacctgattgggatcgcaaattaatgaatgctccaaaacacataagaattccaaaatatacaatatgttaaaggtacacattagatgcagtgaagatagaaaataggatatgtgaccaaaagagtccagagactctttgtaggtaaataaaatcaggaggtaaataaatgagttccagaagttcttggaaggtaatgtagagactctggcagggcagagtttagcagaaatgtgcacctagcctctgcacatagagtcctgaccctggctgataaaaaagagaggattgtcacctttggagtttacctaaattcacattatgtagttaaaaaaaaaaaaaacaacctagcaaacaaaccaaaaactagtatagatttatcatggctcatattgaaaaacatttcatctcccacttaagggcaccaatgcatagaaagtataaggattagagctatatcttaataacatttttaatactctattttatacacatatatccatgtacagtattgcgtacataacatctctaccattactctgtgtatgtgtttgtctgtttttctgtctgttctatagacatcatgtggtactgcatacccactaagaaccctaaagctatttctaagaaagcaacttgggatttagtgtgatttttatgtgtacatcaaccgtttaaattaactaagtgcacgaaaactcttgtaattttattaaatatagctttgatggagaccagcaataaagatgatttgctccttctaatagattataccctggaataaaatatggctctctattgctattccagcagctgcagtttcaagtatacttattgctagctacgatatcactgagggttttttttttaattatcaaaagaagttcatgctatcgactcctttaccctcatgtttttattcccattgagacctgctagaccgaattctgctggtttccttcctgattgaaaacatttgaacctagaaagtccagtatttcttaagacatttgtaactattcatcatggatattaaaattacaatcatgctgcattgtatgagtcgtggtttaaaaggagaaaatccctacacatatggtgatcaggtgaccaatgctatccaggtttgaaaatgctgagtgttctaatacctggtatttgaaattttgacatgtattgcattggtttctgaatatggagaatacatttttgctcatagagagtaaatttaaaatggggtcttttgtagcagcaccagtcctgtttggagtgatattgcacatgctgaatgttcacatatcaaacaaaatgccagccttctgtagaaaagaggtgtcaaaaagtttctttgtacctttaacgcatgtgattatgtagtacaaaatgcagagtttgtaaaaaaatttcttgaatatacaggcaaaaaaatgaataattcaaaacaacccctaagttctacattctattgtctctttataacacaggcagaagatagcggtgtactcccaatagagctgaacttgcacaagttacacctcggaaaatgccagatggtctatggtctacttttgagagctgtcacatatgtaaagatttgaagaaagagagacagctgaatgagagcagtgcatcattaaagctagagcgagggtccccaggcgttgcctgtgttttaagaagcattgtgtcatctccgtattagcatgcgtgggttttttttttttgagctatacatgatttgtacacaataagaggaaatctattataaaccaaatagttgtggtaaaatcaggcaggcagtttcactcttcatttgaaaataaaataatattttcctgtttagttttaattgaatcttgaccatacggttaaaatcatagccatgaaaaatgagtaaagttacacttcctttctactgagatgagtaagagaaagcttatccagttttgatttcctgtacggcacacatgcggcaaaatcgctcaatgaaaaaaaaatgttttaatgttttaaaaatatggaagtgaagagttaatatttggttatttcactgtaattcagaaaccacagaaaaataattaggtgacagtgaaacaaaaaataaaagtactatcattttactgcactcagaaatagataaggtttgaagattgaaatgtagataaatcatttacgatgcattaaactatcacttgaacagtaacccataatttccagagttggttctgttaggcggggggaaaagggtcaaatctctcattgtttagaatttggaggcaggacagacaccgtctaccactgtctttttatttaatgagactgataaactgttacatagtaattcttaggttctctgggcctagagtacgagaagacatttttgacttattgatgagcccttgtccagctgtggccaatgacatttcaactttatcaaactctcaggttgcttgacttgttagttgtagagatgtagctcaaacattccatttatttggagagattcctggaaagtgctctgtaaaggataatgaattgtgtttagctgtctttttttttggcctctcctgaaacgcatcggcatcaccagcagtgggttcagtagctgccattaggatgtcattctggttgctccatgaatcaggagcatatggttctgtaaatcacaagatttcatgttcctaggaagtggatctcgctttatgaggctgtagatactggtcctggggtcgcgtgcagctgtttagaaatgctggtcaacaaagagtatcactattcacctaatggttcaaggatgcgttgtccaaactattaaattcattagcccctcttagtacaattaacatattctatctttccactttaaactaaaatgggtttctttctttctatcctttccctttcttttttcttgttagtggaaaagaattacccatctgatataacacgattaactttcttatgccctgtatgtatttggactccgccacgcttttcagtaatattttccagtttttgacacctgtacgcaagtcttcctgctttagctctgggcctctattattgctttacagggtgggttaggattttaatttttaccctatgatgaaaatctaaattttccttattcatctcttaactaattaccattgatattctagaattctgtttattttgtgcagtttatcctgtatacatcttctcagttcttgccctttagtaacttagattattcattcatgttacaactccacaagtttgtgtccccctttctagaactttgacatttttcttaatttttctcacttttttcttttcttggggcttcagatgtagcattgtctaagagggatgaatgaaggggagctcttttacctggtcagactcaaacgggggttgtcctgaagtgtgcacatttgcctttgacagctacattagatcagattgaagtagattgtccttaaaatgaagttgaaataatgaacacagaaaagattttctcccagatttaaaattattttgaagaaaactgtatgtttgattactctccaggtttcaatgtctgaattcattcatctgtttgttataaaatgtaattggtgtgtttaatgatgcaatcctggtattttgtgtatagtatttaggagagaaacaaaagcaaaaacaaaataaaacgccaaaaaaaacaaacaacaaacaaaagaaccaagagcagctttcactgaaccagtgttgaaatactgttttttacatattttatcttaagtattattttaagttaccaaatagatcattgtatttctctaattttatatttttgtacgaattttttgttgaatttatttacattttcctttctaaatcttctgagctatatctacctttttttctttccttccttcctccttcctttttccttctggaacattccttttctaccttttcttctttttcttcttcctctccctcttccataagccccccttttctttagttttatcatcatgggttagatctcaagtctgtatttttttatttatattttcaaatctctactttcattattgtaaaatattagcttctctgctaaactaaattaactttgtttgtttgtgtgtttacctcagcccaacctgaacgtctgcctcaactccagacatcagcacaggaacccggcaaggaggaaacaggcaagataaagaatggcggccacacaaggatgagcaatgggaatggaattcctcacggagccaaacatgtgtccgtggagaatcacaagatatcagcccccgtttctcagaagatgcacagaaaaatccagtccagcttgtctgtaaacaatgacatcagtaagaagagtaaagtaaatgctgtcttttccccaaaagcagcctcctcacccgaaggtgagtgggacatcgatgtgcatcttaaaaaagaaaaaacgcctcatatgaaattactcagtcatagtaaatcaatcaagaaaacaccacttaactttctccaataaatgtccaggataaaaaaagggagactgggcagccagcactgcttttagattgccaccttagagtgactactcattactttaaatataacaggtgctggttgtttcttttttaaatgccacagctaaaaatataaatattccatttgggggcgtatcacagtgcctctattctttccctccttggtgcaacatgttactctgtgcagtagagataagattacctgcttgcatttttttgtcttgcaaattcattcataatatgcaaagctgaaatagggaaaagatcatgtaatttccctggtcttgctggagaatggactaggtgatgggtatctactttgtgagccatcttccagttcccttgctgccagcacatagcactcacccactccagccctgcccaatccttttactccgctctcagaaacacttgccaatgctctgtgacctcaagaaagctagttattatttcatcttcaatggcacctcatctgcccttaaccaacttgaagttaggctaaatactatgaacccagggcagtttttctttattataaaacaaactcaatatgatgaaacctgcagatgctctttggatggttcgttgtgtcgtatttaaagaaagaagaaaaccccaatctgtgtaattaaggttgtaaattattcccagcctgtgtataaccttctgttcttcctcctgtccctatttgcaaatccttacctaaaatcctgaatctgccatatatatttggtactagtaaaaatctgtattatgtatatagacacatatatttcattatctatgcatatttcctttacctttctattttaatttccctgaaatcttagagaataggctcaggaaagcctctgtaaagttagctatgcctcctcacagtgatagattggactgtaaataaatggggaattttgttacgagttctcagtaatgagtaggagaaaggatattacgtttgggctactgatgtcttaaactcaactgaggcaaagtgttaggttgatcaaatgatatgataataaatggtctgcatagttccaggtcagtgaccctactttccaaactaattagattgaaaaggacatgactgacatttgaaaatgagtttgacatgtaagcttcatggtcatctctgaagtataggtaggctgttaactaaactggctctccaaggagttgagaaggcaatgcaattttctttggaggatctttacttcgaggtgattgggtgaaataattgaatgcaattgaaatctacttgttttatacatatgaatttatttattgtgttcttaagcccttgttttccagttggcatttacttgttttaatatcaaaaaatgatgacaggggcatatcaaccaaactagaaatagcctatggagctcttcagtcgtttttgctttttaattgtgtttgaattcatttgaaatgcaaggatgcagctttggaagaaacacagaggagaaaaggcaatgtgtatgaatgaaacacgtagctctctcccatggttttcttctcatttctttattttgtcatcctcttctctgctttccaatctctacttagaattgacccccaaatatttggatatgggcagtctatacactataaactacagttcttataaaatagcatttaagatcaaattgggagcatgaggagaatgaaacaccaaggaaagtatcaaacatgttgcagagacccgtccatgtcttttcgcttagcttctagaattgaggtagctgaatattttgtaatctggttttgattcatgattaacatttcattgtcctatttcttatgttctcttcattagagatcttcatgaattcaactctcatttaaggttatgcccttaaactttgcctcacatttacagtcacgtgcctccttttttgacctcagagaaggtcaatacggcaaaccacatataggccaagctgtggaaagagggtgtcttgtcttgaagctcagttttaccttgaacctgttgactgtggtgtcgcctctgaactcctctgtacctgtttcctcatttctattttaataattgtatgcaattcacagacaaatagtttggctgttagaataggagtccccatgcaggaagcaggtagactgtttatggtacatagcaggtatgtgctaccttgatgagacaacacagatggaagaggctgatagactgcctcttgtttgcagtcagctctgcctcagaactccacacactcagccatattgaagtccaggccttactttcgtacacaatgccctatccctaaaagtgttttccatactgggtcagtgcaagctggtcatctttgcaatgaatcactgtgtattagcaatatattaattctttcatttgagccagcaagatgtctcccaagttatcaatataatttatactcaaggtaaaagttgcaaccaaaagagaggatagtgtcaaagtgggtaagcagagctggttttgaagttttcagataatattattttgtactttattgttagattgctgaatgtagaacaaacatacatgatgaaggctgaagtaaatatggaacagaaacaaaagattgcacacctataatatacaaacagcatcacaattctggcaccagtggtacctacaaagctagttgtagacaatccatggctaaatcatagtaaggccctgtctaccaaaaaaaaaaaaaaaaaaaaaaaaaagaaggggaagaaaaagaaaatatccctcaaacaaagaaacagaggcagctttttttgggggggagggaagtctattgattaaaaatttccattgcaattattttaaaaaacaaatcccatgcatgtttattcacacgagtaaccaaaccaattcgacccccactgttgtatatagtatagttgcatgtactatgggccttctgcagccagggacaatgccagcagagccaatccattcctgctgtggccctgtctttagaggaatgcatcaattttctccacctttcacaaggaggactgtcctgcgtttaaagtagcttggctgtaaaaaggcactcaaaacttaaagacaaatctgccttctgaaatgatgtaatcaagacagtggagaggtggcccagcagttaagagcattggctgttgctccatgtgacccaggttcagttcatagcccacaattgtgtgggcttaatattgtctgtaactccagttcctaagaatccaatgcccaattctggcccctgaggacaccagacataattcaagaccactttgctctgcatagtgagatatgacctcaaagaatcaagctaactagccaactaaataactaactagtctgaactaaagacagtttacccaacattccaacatcacttcattgtgaatggcaatcctcttgtggtggaggcatggggttccatttcagtgagcttgtatctacttaaatcctttcctttgaggagcagctatcacacctgtgctctgtactggttttcctcccctaagagattgaattctccagacttgtgagtggtgctgactctgtttgtaatgttctccctggtgcctgcagtcttacagtttctcaagtattcatgagtggtgtgctgatttatttcaaaccatggtgtctcactcttccttgaaactagcatagctcatatattcttctaaattgttcatttttgcagcggagagaaaaaagtacttatgtggaaagacagcacattttacttaaaggttattaaattagtagatttcttcctgttttgtataattaaatattttcatacattcttaaattttctgattgcatcacccaggtggagagttttaagactaaatgtgtaagactcttaacctttgaaataattatagtgtaatttaggatcatctaatattcaaattgccaagggttttcattagtcttgaagacacttttcctttcctagagatggtaaatgctaatatgttttaggtgtgccagttatagctatattttttttgtaaaaattaggcttccacaaaaatattgttaaagaatttttattctctttagggatgtttggtaatttatttgcactccacacttgagactcaagagtcagtatttgtaagaggtacacattggatttcagcatctcactgaacatcagtgcttggaacaactgaaaagcactggctctacggcaatagctggagctatctcacgtttaatcatatggaagtggtgtagtctgatatgtagaatatacattatagaacctgtctgcctgggtttgcttatcagctctacccttgaccgttattcacctgagggtgaggtagcagcctgtttgtactgcagcatcttctctggaataaggggatgttatatgtacctacattttaggattattataagcactcagtgaggttaagcagctttgtggtcatcattactgaggtgtatggggtcggtagcacaaagatgcttcctggaaagggtgctagatggaaacttaagagatgaggtagagttgagttaaatggttgaaggtaagactgtcctaggttttattttttttaatttattttttattctattgctgtggtcaaatattctgataagagtaactgaagaggaaaaaggtttattttagctcaccatttaaaattagagtccatcatagcaagaagtcaaggtagctggaactttaaaaagtcatggcacatcaatagtcaaggccaaagaggcacaaatgcacgcttgcttaacactcagctcgctttcgttaccacgatactatttagaacgcaaacccagggaacgttgttgcccacacggactcagttttcccacatctactaatgtaatcaagactatccccacctactggtccttctgatctaaacatttcctcatgaagactctcttgtcaggtgattttatactgtgtcaagctgacggtttaaagtaaccatcaaataggaggaggaggcattggaaaggtacaagaagctttatgaattagtttacataaacaatttgatcttgtggataagctgacatagaagagatgatactgaatgaacaggaaggcgtcattccactggcagccgggatgtcttttctgaagatggatccccattctctatgacttgctgaaggacatcattgtgtcagctacaataattcgtgttgtattttcattttattgctgagaactcccttggttgttcttgtatatgtctaggcaccttcttacttggcacctgcactgcagtctgtgcagtgtctttactctgactctcttgcagcctttctgctctttagtgatgaactattactgctaagtcagagagtacaaggtttgagacatgatggatttcagaagctaagaggatctacttgagttctctggacctgcggatggattaaaacccaatctctttggtcttttcttctgttgcccttctttaaattgtcctatgagattctgactctgtgatcttctctttgctccttttaaggctcttcctcttccttcttttctgtgcattttcctggacattcatgctggtgttttgtttgtttgttttgttttgttgttttgtttttaataatatactagagagttgagtatcctcttgacaacaacaagtcctccaggaaacttctgccagccttaccagtttattttattattattattattattattattattattattattattattattattattacaattgctattttattttattctgtatagttttagatgacttacacatccaaaatttagaagcaaggtgtaaagtgtcaacatttaggttaagttactcagtctaaattttataacactttaaaagctttgtttttccccacgagaagattttgcctataactgtagaagtagcagaccagtatcttggtatggatggataatgatcaggatatatggtgtcagtacagtgttccagttgaagcttccagagacacattttcgatgacttgtggaaaatatgtcatggcattcctcaaagaacttaatttgcctgggtaacattgtgattgcttgggttctgttttctcaggcacagtgttttccagtgcatggcagaataacaatcagtgcgagtggtttagaattgtgctttccagtgcactatttgccagtacgctggagaataggggttcgctgcacatccagtgcactaaatacaacagcaagtgctgtgtgtggatgctgtaaagtaagtctttatgttttacttacttgaaaaaaataaatgtttaaaaattgtaacaattatcagtaactttacagcaaataaacatctaaataaatttatttagaatttaggaaaaatagaaaagatttaacaaagttttgaaacactaaagcacacacacactaacagagatattgaaaacatgcctcagtcctcagagttcccccatgaatcctttgttaaaagaatcaacatctttgtaggttatctggaatggtgttaaaagctgtcagctacgtatgaactctaccactggaatttctggcttttagttttgtagtgaatttgtgtcatgcaactgatccaaccatttaaattagctcagcatccactcaggagatgggtggggaggaaatcaaacaatagggatacagatagattggccaggaagcattagggtgtggggcgcttgggagaagaggctattcagagccaactgaaatcgaatgaactcagtagacctatgtccctgtttgcacagatgctttttagcatattggtttttagtacagttgtttaaaattataggtgtgtgtgtgtgtgtgtgtgtgtgtgtgtgtgtgtgtgtgtgtgtgtgtgtgtatgtgtgtctctatcttttgcttgcttttgttttgagaccaattttaactctataggagaagtgggcaagaatataggaaggtgtattctcaaacccaagttgtgccacgtgtggacagtagaagccctgaagttttgttatatgtgtttcagacagatggacagatcttgatcttggtctgagactacccctaagtagaacaagaacagaagtcacatgatcattccaaggtcttctattacttccctagtctagtcattgggaaaataactagaaattacaaagtcaagaggaataactgaatgtagttggcagctgcttatggctggtcttataagggatcagtctgaaataattcgagtgggaagttcgaaaacacatctgcaaacacattcatgagccttgagagaaagtttaggaccaaggatgcctactaatatttattctcactagaagttatgtgaaactctgaatggtctgatcttaagtagagttttccaactgaaaggcaggtggttggggtcagattcctgaaggctggccaagttagtgccataggtatgtaagtgctggagtcttaggagacagatatagagcaatgccagacattttccagatacaaaatcagatggaaagcaagtctgagtgatgccacaccgacaagatagcctggaagattttagagtcagagagaagcagaagaccattccgttgggaagaattaagaaaggcaaggatacatcctctgtggtctattttcaagagtacagagaacaaaggctctaagaccatgaaggtgaccatatctggttgtaccaagttttgtttgcaggtaaaataagattagccccaaaaataatagatttagtaactaggaaaacacaaagtaaaacccttgtaaacacacacacacacacacacacacacacacacacacacacacacaagaaaaatatccaaaacaaaacaacaaacataaaagccggagccaaagtacatatggaaggaactgattttcttaagtttctatttttgtttgttttttctgagatgggaaagatttgagtatgtttatctttgggtgaaaaagatctatgagaagaaaaggttgaagatatgagaaggtaattatcgtggcttcttcacaaaccagcacgtagtttccttagagtttagatctgagttctgtacactagattaaatgaatttacaaacagcatcaaagcaagagcgttgagtagcaagagaagcattagatgaggcactgaccgcaggggcgctgctctgtatgtactgtgtgcttggttaatcctgcaagtcttctcaggtaacttttatggaatgacatgatatgaagctttgctgattaaaaagtggctcttctcaagtccatactcctattttcaaataccgataccatttgaacagaaggcattaaaagagtcttatgattatgagtctcaaattcctgaattttgtgtcttggttcagagatccatgggacttgttagcttcttgtaaccaacattcacgaggccctgagttcaatttagtcaaagtttttttgtttgtttgtttgttttgttttgttttgtttgtttttttaaaataatagttagcaataaaacaaggcacaaagtggtaaacaaagagttatggcattagagcatgtgtataggagggatgagttaggaaaccactgaagttcagacaagcaaaactcaatatgatgattttaatctatgtttaaagatgtggtgtagtcaggcgtggtggcacacaactttaatcccagcactctggaggcagaggcaggtagatttctgagttcaaggccagcctggtctacaaagtgagttccaggacagtcatggctatacagagaaaccctgtctcaaacaaacaaacaaacaaaaacaaaacaaaacaaaacaaaacaaaaaccaaaaccaaaaccaaaacaaaaaagatgtgtgattcctggggaggtatgaacatttactactcatcccagatagggaatcaatgacaaaccaaagccccacttagtaaactggtgagttttattagagttacttacaagaatatgtgtgaagagttacttttaggaggacaaatatcttaaaagcatttgtactgttgaagtccatcccagtgtgataggtgacagattacacacacacgcacacacacacacacacacacgcacacacacacacacacagcagaagactttctctcaagagagttctttccaggcagctcagtctgtgttctacaccctctacttaacttagatgctctctgcttcttctggcagctcagctctgctgagcctgtttctcagcaatccctgcagctaacgcacacttgggaaggagggtcctagtgaatttagtcagtttcactatcaggatcttccttgaagtgtgggtattttaatctggacgaaaagggttacacaggaaagcaaaggtgtggtttcgtatggtctgctcttcataaactaatgtcctagcggaggtctgaaaagggtgagatttaaagtataattgtgagttgtaattaattgtgagttgtaattaattgtgattgtgtcttacacagtcactgatcatgtttggtttaatgtattaatttgagaatctgataaaaggtgttacttttttttcctaagacttaaaaaaaaggtcaaaaaatcttgttagtttttgtggcattcttgaggtaactaaagatggtagatatatgtagataccttatttaaaaatcaagtggttctaagaactgaactgatggtaggatttaatgaaccactgtggctggttttaattttgagacaggaagtctggagcaggtgttcagcaaactgtgctgacatgatctagatttactgcttttaaacctcaccttgtcttatctgatgagtataggttactagtatgaaattactagtaaatggaaggcttttttaaatagctcttgccatgattcagagggtaagtgatgagt

SEQ ID NO: 1088 - DNA, 402 bp, Mus musculus
aagcatgtaatgaggacaatacggagaaagataaaaggccagctaccagtggccataccaggtgtgggctgatgcgggaccagtccatttggccaaatccttcagctggtgaacttgtcagaacccaacctgaacgtctgcctcaactccagacatcagcacaggaacccggcaaggaggaaacaggcaagataaagaatggcggccacacaaggatgagcaatgggaatggaattcctcacggagccaaacatgtgtccgtggagaatcacaagatatcagcccccgtttctcagaagatgcacagaaaaatccagtccagcttgtctgtaaacaatgacatcagtaagaagagtaaagtaaatgctgtcttttccccaaaagcagcctcctcacccgaag

SEQ ID NO: 1089 - protein, 134 aa, Mus musculus
  VARIANT (1)...(134): Xaa = Any Amino Acid
ACNEDNTEKDKRPATSGHTRCGLMRDQSIWPNPSAGELVRTQPERLPQLQTSAQEPGKEETGKIKNGGHTRMSNGNGIPHGAKHVSVENHKISAPVSQKMHRKIQSSLSVNNDISKKSKVNAVFSPKAASSPEX

SEQ ID NO: 1090 - DNA, 116792 bp, Homo sapiens
  misc_feature (1)...(116792): n = A,T,C or G
taatcttctctttacttggccctttcccctactctacttttaagttctgttagagcagggactttgtctcttatttatttatttatttatttatttatttatttttgagacagaatctcattcttgcccaggttggagtgcattggtgctatcttggctcactgcaacctctgcctcccaggttcaagcgattctcctgactctgcctctcgagtagctgggattacaggcacatgccaccacacctggctaatttttgtatttttagtacagacggggtttcaccatgttggccaggctcatctcaaactcccaaccccaagtgatccatccaccttggcctcccaaagtgctgggattacaggcatgagctacagcgcccggtcctttgtctctaattctatgtgcctcctacacactctcatagcattccatcattttcatcactaaacgctatttgtgcttatatatttgcatgtgtgattacttgattaatgtctatctgcctcatgactaaactttatagagccagaacacatcagctttctttcccattttattccagtgtttgcaaagcaatgaatctctgttgttgaacaaatgtattgctaggacctaacaggaagtctggtgtacagcaagcactcaatatatatctgatgaataattagatgcgaatttcagttaaagtccaagctttttaacttatagagtggagatgacaatacatttaataccagttacacagagttatcccaatgataaaattgagtgatgtgtggttaaaaaaaagtgtacattttaagggactctgtatatgggagtgattataatgaatgctaagagatggactggagctgcagaggtattgggacagacatatgtcatcctcaaaaaaaggtttttttgatgaaagaactgagttccttcaggaattcaagagtaagattgcgtttcttcttgatagggagagaacagcaaaatttgaatacttaacgttagcacactgagcctaaatcgtctcaatttcactgttcctaaagacaagttgtattggtttcctgtggccactgtaccaaattacccccaaaatttgtagtttaaaagaacaaaatattattctcccaatcatagagaccagaagtctgaaattgaggtgttgaaaggccatcctccatctggaggccctaggggagaatccactccatgactcttctgatttctgatggtgggacagcttcttctgcttgtggccatttaactctaacctctgtgtccatctttatgtcaccttctcctctatgtctgtcttctcctctgtgtgttgcttataaggatagttgccattgaaattagggcctacctggataatccaggagtatctcttcatctcacaatatttaccttaattacatctgcaaagactctttacccaaacaggtaacattcacgggttctgagtattaggacatggacatatcttttaatgagccaccattcagctcactacaacagtctatacagattgagtatcccttattcaaaatgtttgggaccaaaaagattttgaattttggattttttcagatattggaatatttgcatatacatcatggatatcttggggctgggacctgagtcttaatatgaaattcatttatgttttataaagacctcatacatgtagcctgaagagaattttatataataattttaataatatatgtgacctgtcacatgagctcaggtgtgaaattttccactgtggtgtcatgtcggttctttggattttggagcattttggatttcaaatttttggattagggatgctcaacctgggagagcttaggtaaaacaaacaaacaaacaaacaaaaacctcacctttgtatagatttgctgtttcaaccaaaattttccagtgctgctgatcttaaacacagccaaactaagtagtcccttctacctaattttaggtattttagggatatgtgtaaggtactcctcccccagtatatatccctacaacatcttcatttcttctgataattttattacattgcctgataatctatcaatacaaattcatgtaacacttttattatgatgatgattatttttggcagtgatggtggtagcagtagtagtaaaagttgtcataatgatggtcatagtcattattttgaagccctagagcagagttgagttaatcagcaccttggtatatggtacattaccttcactggtctgtgcaaggcctccctttttatgcctatgtttgtctgcatgtatttatttgttctccctaattcccagtctcaattctcttctttgtctcctcataggttagcattctcagatgtttatgtacgtccttgtttgtgtgtgttcttataaaatgtgctctgttttccctgcacgtatttttagttattaattggttctgaacaaaaattacattttgcttcttacatgtttcactaagtatcatttttagatctattttgtttctacatgtgtttatcatctgttccttctaatagctacacaataccccatgctcttcgtctacataatcaactttctgatttccaaaggatggctgcctaggttgacttcagctccctgctatacaaatagtgtggcaagaaataacctgtctatgtctccttgtggtcctaagttcatttttgagggtctgtgaagatagagacgtaactgttgggggtagaattaagaagatcatgagttattcatatacttgtatttaacatgtaaaatcaaatttattccgtataatgcttggcccagatttgcacactgtctaaagttgagaacctatggtaacaagaaaagaatatagagctgcaagtgccggggtgacagatgggctgttcgaagtaggagagagaagaaggatgggaggtggaaggatattcaggaaaccttcactttttcccggagttcattataggtcccatgcttgggtgaacaatatacagtcatgcatagcttaattgatgggggtatgtcctgagacatgtgtcactggttgatttcattgttgtgtgagcatcatagagtgtacttcaacaaacctagatgatatagcctactacacccttaggtggtatggtatagtctactgttcctgggctataaacctgtacaacaggccaggcatggtggctcacgcctgtaatcccagcactttgggaggctgaggcaggtggatcacgaggtcaagggttcaagaccagcctggccaaggtggtgaaaccccgtctctactaaaaatacaaaaattagctgggcgtggtggcagacatctgtaatcttagctacttgggaggctgaggcagggagttgcttgaatctgggaggcagaggttgcagtgagccgagatcatgccactgcactccaacctgggggactgagcaagactccatcaaaaaaaaaaaaaaaaaaaaaaaaagagaaacaaagaaacctgtacaacatgctactctactgagaactgtgggctattgtaacacaatggtaagtatctgtatatctaaacaaaaaaaaaaggtagagtaaaaatatggcgtaaaagataaaaaacggtatgcctgcataaggcagctctgttacaatcttatgggaccactgtcatatatgccatccattgttgattgaaacattgttatattgctcatgactgtagttttgttgcaatcctgctttttagatttagcatgtatttcttaatacaaaatttggagaaatacgggcactgattcaaatgtcacagttgatattttctttctttatctgagaatttaaatgagtttaggggttatagtaacaaaagaatcctcatcttctacaccattttaaacatttttgtcatgatcatcatgctaacattattttcaactgcagtttcagcagatcagtcattattttcaggagctccttgtatttaaaattttccacaattttcattctcctggtatatctaggttcagtttctaagtatgaagcaaatgtctacttattgtctactgcatatgttatggccattttcatttctgtcttcagtcatgttgcttttatctgacaagtaccactgtatgccttaacatctccctcccttcctttaaaacacaagaaggaaagtacagtgacagcaaggagagaccctgaaggccagtgccccaggccagagaagtcagccaactgaaagggacactaactgagaccttggagaggactaattcagcaacaagagattttatgcctggttctttggttacccattcacaacagaaaatctttggaacttcaaaatataacaacaggcatgaccttacttcgccatcacttagaaatgatggattcatttacgtgcattatccagatagctggagcaagaagcctggatgacaagaaatttaggctcctaagactggctctgtaattaatccacgaactgacctttgccaagtcatttaacttctctggggctttcacatttctttgtctttgtaagtgttatttccatctggaattccctaacttctttgacaggcaaatttactcatcgacaatactcagtttggtattatcgtctttctgaaatgtaccctgactctccccacctacgcctgagctgagttaggtaagtgctacttcctttttgctcctgcagtatggtaagtgtttgtgactgttctgctgctacattgctgccttcttctgcctctggccttatagactatgaactcccagaagactaaaacagtatttcttctatacttgaaactctagtgtctggcatgtggtttgacatgtagtaaatgttcaacatatgtttgttgaacctagtaagtaaactttatgtctttgtatttttctatatgttaaatgaaggagttgggtaagactggtgatttttaaacttttaaaaagcggaagaaccagttgtttcagttaaaatttaagagaaggactaatacattatggagaaaaggaagaaagtgctctactctaagagcagggttccagaaacctgtgcacctgaccttccctgcacctgattgcacctgacacagtactaggaggtggaggaatgcgatccatacagcttggcctggaattgtgattgctaatttcccttgcagctgtaaaattgtcattctgtggaatttactctttcaagtagcaacctttttttaaaggaatttttgaacatgtttgaaagagtttttcctggaatgtaaaaagattgacccgaccccctaaaaacagaatatagcactcacataactaactgactctttccttaatgactcaggctcattaggaacattgactatttcacgaagctgaattcacaaaggcgttgttacaacatgtttattttcctgtatcttccttgtctgtcagctgtcatctctcctgctgtcagtttttctgacctaatagctcccttagctaatcccttctcctcaatcttcctgcgccctaagttttcttcttctaaaacaatgtgagctgaaacagtagaaaataaagtttgattagaggtgtgtattcacaaaagaacaagtaggatttgagaaggattatgtcttttgtgttggcagtttctgaacatcatgaaggttattttaggtatttagtatgttgctgttatttcctggtttctaggtcattgggtttggggattgccaaagtgctgcttctaacataaattaggtaaatatattttccagaaaaactatccttgatataatctgggaatgactccttaaaggattcaaagcatttaaaaagtttttttttctaaacaaagaaacaaagtatttgaatgtgaacctttaatgtatgtttacttataaatcatacccaagtacttttgtaagaatgtgcaatacactgtataaaaacatactcaaaagtagaaattaaaaattataacataaaaacatatataaatgctcactctgatattttctgcccacatttcagtagattgtcttatgcatcccttggaatgcccttacaattacacaccccagttgtagacctctggtttagatatctgtgtatggggattaattttgactttactaggcaaataagcctctgcccaagtgaaaactaatttagctgcttttcaagacatcaaatcaaatttctttatctccagagcctaatatgtggcctagcatatagtagatgcacaataaatgtttgatgaatgtttaatgaatgaatgatgaagattaagtagtccataaggatgctttataaactcttttaattagttctttattttatttgcttagctcatgtcagacctctttcacaatgtgttcacatattattatatcatcattagtgtacacatcactaggcaggaatggttgtaaggcacacaagaatttcaaaggcaaggggctttgatccggggctaggacattgagttccaccggcaggctgatacccctaaagaatttccacctacgcagattaagatagcttaagacatggcaaaatctagcttaataaagacaacccagggggatctggggtagcaagtgggacactgacagtagtagtacttaaacagtagtggttctccaagccaagctgataatggtattatgtcactgggaaggatgtggagaaaaggagagaggccagtaaggatacacgtggattgagttccaaggcacagctgcgtctcagggcttctgcttttactctgcacacttgccttggacattcttataacctgctagtcagcaaagtaccatgtatatgcttataatccagtcccatgtccagcagcctatgcaggacagttccaattagctgtctcacacatgctgcatcatttgcatgattagctcagcagctttccccaaaactggcctctcctgaatgttttcatctctgtaggtcataccaccaccatcaacctggatgcagaaagctggtagttgctctcgattcctctagcttcctcatcctttatccctatctacttggctccattccttctgccagccatcagccctggcctccaaattggactccctagatccactctcagtcctccaaacaattttacgcataataccagagtggcttttataaacagtaatttagaaaatatgtctccccctgctatagtctgaatgtttgtagtcccccaacattcatatgttgaatcttaatcaccaaggtgatggctattaaaaggtggagccttgggaaacacttgtatgtctttttttttttttttttttttttaagagacagggtcttgctctgttgccgaagctggagtgcagtggcccacatagctcacagtaacctccaactcttgggattaagtgatcctcccgcttcagcctctagagtggctggctacaggagtatgccactatgccctgctaattttttaaaaacaattttgtagagatggggtctttctatgttgcccaggctggtcctagagtgctggcctcaaaagatctccctgcctcagtgtgagccaccacacctggcctcttgtgtctttttgtaaggacattaattccattcatgagggctccactcttatgacctaactacctcccaaaggccccacttactaacaccatgacattaggggctaagattttagcatatgaattttggggaaacacaaactttcagttcgtgacactgagtgaaagaatgagagatgaacgtactggagtgcttgtcagtaaacaaatgaagcaatcagaacaagcaagtgcagccagggatgtgggaaatgggaggcgtgatggacactcaggagcccacacttaacttctggcatatcagacaccaggttaatggcattaagaccacttctaggtcctccagaaggaagacctgagttacctagggatgcaggatagcctggaagagagacagacctgagttctaatcctgaaggtacaatcctggcaatttacttatagggccgatggaagaattcattgagatcatttgcgtcaggtgcatggcatgacaaactggtattttgatatgacccttttgatacagtcattatgccatgctcagctttacccatcaagatgcttccgtgtataatagtaataatagttgatacttttgaacaccttttcccttgagagtcttccaaattttataggaaaactaccttacttagtgctcaaaaagaaactctatgaagaatttcattctcatattatgaggcaaccaaggtatagagtgggtgactaactgtccaaagtcacacagctgaatgaggtacagtatttgacaaccttggtgatgctaccctacagcttctcatttgctcctaatgttattttaattttatgtcttctccattaaagattttaaaatttaatttaaggaatatctatggaatcacccaccacgtgtgcaatattaaggactgtgtgaaattaaatgaacaaatacttatcattgattatgactttctagaagaaagctgtaacttctttatattattggactttaacatctttgtgagagaattttaaaaatagggcaaggaatgatacagggataaaacagaattttccagagcaggtaaacaactcctttgagtgcagatgatgctgcagtgaactctgagacgtcctaaatgtttgttctctagtggtgatgaagtcatcttcagaactgatctgcttccatcagacaaattccaaacagtccaggctcctagataaattttcaagagaggtaatgcacttgatttcataccatttctgaaatctccaagtgaaaaaaaaatgttagttatgtgtaatggggcaaaatgtcatttgtctttttggggagaatggtctgaatgactgtcatcagcaactttgaaggctgtttttttttttttttttttttttttaaatggagtcttgctcttgtcgcccaggctggagtgcaatggcacaatttcttctcactgcaacctttgcctcctgtgttcaagcgattctcctgctttcagcctcccagtagctagaattactggcgcccgccacaatgctcagctaatatttgtatttttagtagagattgggtttcaccatgttggccaggctggtctcgaactcttgacctcaggtgatccacctgcctcggcctcccaaagtgctgggattacaggcgtgagccaccgctcccggccgaaggctggcttttttaccatcattgaaatcaagttagaatgcactgtctcttcataggtaacaagtaaatctttgtaatcaattggaataaattccaatgagctttttgaaaaaatgaaatttctgggatattattaatgatgcacatagaaagacagtgaatccaatgcacattttcttcagttttgataacgttactgtgattcctcgcttgtccaaaagaatcgaagaatgagttcgttctagctttctacaaatgaattctgcatttcattcacaatgaaataaaagagcaaaagttatctgagtataccactaaagtactatatatctgtaaattactttacacttgctatcctcggctcatcagattaagctacaatcagaatgtctcatttataaacggaaagttgatcagctttttacttccgaccacaagtttatctcccctcagataccactgatccagtgaggcatttagcttgccataggccaggctggggccagtaccacggcatccgcaagggtgccaaccttgtttgcctggatgcctccagcagattcgcgcaaactgcaactggttttacatcaggaatactgtttgaccaaagagtaatttaggagccagagatgaagtgagtaaacgttcaaccgaggggtcaaggtttcaaacgcacacgttctctatcccaccaggaaagttcgatactgtaacagtgttttcgtttttccttgtccaccctaaaggttttcgtcaggatattcccaaagcctccgtcggtctgggggcaggagtagggagaagggatgaggtgactttttgggcggggtggggggaacgtctgggcagccagggacctgcccattcactcccctttcccagccccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggaggtaggtagtggtctccgggcggggaagaggaggggtttgatccccatccccggggttctcccaaacccgatctctctttccagcccctccccgctgggtccacctcggacccctgggaccccgccgctgtcaacttgcgctgtaacagttttcttcgcaagtttcaaatcaaaacttccccggggtggagtttgagggagggaagtggagggggagggaacgtcccgcaggggtggtgtgctcttctctaaaaacatttttttttttaattttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccactcccccttcctttggttgcgaagaaacaggatgacaggattgcttctttcttaagcatatgcatgtttgggcctaagactcaatgtgtaggttctgaagcgcttctcctctaggtctcttcagcagatccaggactgccgcagctctctgaacaagcgtgcacttactccatttcatctttctgtttcttgttggctcctctaccacccggttgataattcaggtttctgtgaccagtagctttggaatggcttatgcttgttttcaataactggtttgttttgaaataaataaacaaggtttataagaaacactttccaagaatgaattagcttctttgtgttcttccaaagtgtaaacacacacagcctataaaatactcttgtgtctgggaaacttccataacaagcttctaaacgagttgaacctttcttctcttgaaggcaatatactttaggtttccattggtgacagagaggaaggttcttaaacttctaatgcattttactctaaggatggttttgagctaaagaattctgtcactgatatatcagaactaagtaatttttccagtgctcaaaaacctagcatatacccctgattttaggcataaactgatagctttatttcccacttgtactaatgtagtgaatcttagggattttttttaaggcagcaaaaattggagaaggagttaactttcaagctgcaataggtaaaagcagaaaacatcttggttaaattaaaatgttctggcacccagggctgttaaactgaattacatttatcattattttttgcctctaaatgagtgactcagctttctaaacagaaaataaaaatgattaactgcagaaaatcagagaactagaatgataaacatatgttttctgagaagcagcccgtgttctccaccttgtattgtcagcacaatcattttcctgtcattaggcatgcccttagtagtcatatcgactcattgatgggctgtttatgctcacacttgagctgctaatcacaattgttaaaccaggcttatgtcaaaaatcaacatcaaacacccaaggaaaataatttgacctggaaatagctaatatctacaatatccaactttaatagtttgcatttctaaaatcatctgggagaatgtgcagtggtacttaatgtacctgtgcattaggatgctggatggtgtcatgtgatctgaacttaagaacccgaaaatctagagtggcctgaagtagcacatttgttgggtacaacacacgttatcagtgtagaaactcttgggttatattttacctgaaaattgccttagctttagcaacatagttatacatttttattattattagtttaactttgatccaaaactttctttaaatagggatcagtttaatttaaatataaagttgatttttaaaaagagagtctgcagaatcttgttaaaatatgatgtcttaaacaggcagatgtcataaggtgtatttaaagaaagaaattcttggagcaaatggttagaggaaagcttcaagggaagcttggttaggttggttttattgataaagacatttgtgaagaagctttgctcgaaggccactctactcttaagccttttctcaagttcttttatcctcttgcttctgtccttggattctttatcatcctttctgaagaatagcttaataattctacggtaggatatggctgcttagttaacagaaacctaatttttaaattctttatattaaagtcagtaagaaaagtggaattttaaatacaaattaacagaaaaaaatattatttcaggaacatgaaggatatgatcaagtctacccctgcaaagttaaatatatatatataggtaaataatgacattacaagctctacatttattactatactatattgtgatgagctatccatactgttaaccaaaggcatggaacattacagttgaaagtaattttggggattctctaatctgaactccacatcaagtctaaaattcaattctacatccttttaggtgttttgttaaaaacctgtagtgaagcccattctagtattagcattaagaattagaaaggttgtccatattaagagcatactcttcctccttaaagtttctacctttttgttgtggttctgcaaggctttctattgttttgaaagcattaaaaagcattacaaatctttcccatgtgttttgaaaatagttacagagcagggacataagcttacatgctccaggctgtaagagggaaccaggatagatgtcagacagtatggagcaatggggattttggggaactggagagctcatgggccaggaaacaacattcctcagttttagctaattgttgccatgtgggttagtatcttcagatatttcaagtgatactggaaatccagatttttatgtatcatctctccatttttaagagtttgcaactaattaaacaccaattttgtgcaggccaaacaaaacaaccacaactgtaggctggatatggcctctgagcagctaatttgtgatctctcatacagaaaatagaaagtaaacatgtaatttaaagctatattcttatttgttactaccttgtgaaatattgatttactttctcatgcaaagtacttgtatacatgtcttgataggtgaaaagccatttcagttatactttattttaagagataatggatcttgtttgtgtggtccctgtaattgccatttgtcctggtttgattaaacattttaaaattcgtgttatggaaccacattgaaaatgtaagtatttgccctttggtgcaatagttactagaactcctataatccaaagagcctttgaattaagtgcttctttcataagtatgggatttgtaactagaggggtctttagaaataatttaatccaacccgctcattttttaaataagggaaaggatgtccaaagaatttaagtgacttgcccaaggtctcatacacagtcagtagcaagaaatcagggtagaagcacaaattataacataaattgtatgtcattgtgataaatgcagttgaagtagagaatcagttcaacttttttatagggctggatgcattgacaataggcttgggatattgtgaatcacttgagcttgttcccatccctgtatctttcccccaaccccccaagacattgcatttgtcaagacgtagatcgttggactctgagtgctagaatatattttaatgtgataatgtgtgatttaatgcactcttctctcttgggagagtcctcttgagactattaggcggacttttcttagcaggatgcaaaatgccagtgaagttaattaaaaataatctaaaatagaagctggggagaaaatcaagttgaaattacataagaagagctttgatttagaagcttagctgagttgtcagtagtttatagaggctaatcagattttctttttgggaagccagtttatttcaatgtatataatgtatacttgtacatatctgtattcttctatttttatcatattattttatccttttgattaaggatggcatttcacaaaatgtgtcatctttgaacagcttctaatcctggttctctactggggacaattttgctcttcaggacacatttggcaatatctacaggcatgtttggtggtcgtaatgggggtgctactagcatctagtgagtggagatcagggacactcctgaacattttgtaatgcataggataggacaacctttacaagaaagaatcaccagtaatgttgagattgagaaactgctatccttgaggcaactgacgtttttggtttcatcccagacttatagaattaggatctctggatgtaagagccaagaatctgcattttaatcaagctccaggtgctccttaactctagttgagaatcattgttttatgggctttaatctctaaaaggatatgttatagtgatagacttttaaaaacagtcctttttttttttttttggagggaaagacttcagaaagctttttaaaagttcaccttttcaagttccaaaatttaaattgttatcactccatgtaaactctctaataatcctctctaagattttttgtcatatgcttcaattcatcctcaaaatactgctgcatagtcatcctcaaaaaagcttatttattttcataattatatgcactataatacaaatatatttttaacaatataaaagaaatgcaaaagtaaaaattaataaggatgagagactaaataaatagaattttaatactttatttcactatttcagtagatattcttgctaccctacactttggagactccaacatatggcaaaacaaggaaagaaatctccagttttcacatgagttgtgttccattgtaaattggacttttagagcctggattctactttctcatagaaacagagggataaattatatttagttccctaataaaagtcaaaagattgttagaattaagttttattaaattttgtgtgcttttaatggtaactcacagaaaacatactattataaaactggcagcaaatacaaataaccaagaataaaattaaactgaatagaaattggtttaaaacactttttgaatacagatgcttgaggaaggacaagttaattagaaaaatatagaagggcatgtagatttgaaagaggatttgggaacattttgaatttagaaaatgaatcttagaacttatacttctaactttttatgcctaaaggaactaatgtacattttatgattttagttatacaagtggagggcttatcagctgggcatattcattttccctttgttaagaaaaagaaccaaatgagtaagagaagaatgtaactgggaaaaaactaaaaacagaggaaggaagtggttaaagaagatatatctgtaaatttaagaaagcatttggagaggttgaactgtttaagaactgtgaaaaaaaaaaggtctacggaatagcatggtacatgctgagcctgtggctggcatgttaaggaaatcagtgccatagtagaggcacaaagaaagtgtgatggcagaacatgggcgagagaaaatatctctagtaggggatttggaaaagcctcaagaaaagttttgatttgagttggaccaggaagcatagcatggttgtaggactcagttctgtggagataagtggtagaaaacaaggcttgggggagatgattacagaatattgggtacttcaccaagaccattgttggggctgtatgaagggtcggagaacaagatagcctaaagtcagtttcaggagggccctgattctcttgctgaggagcttgcatatctcttctgtaggagttggtgaccactgaagtctcttaagaagaaaaggacaggaaccacttgtgtttttaggaaaactgttctggtgacagttcatagaatggttttggaggaagaagcaagagtggaggcagtgattataataggctgacaaaagattagaggacttagggcagcaccagtaggagtaaaattgaggaaattgatttaaaaacaatagcaaaaataggatagagctttactcagctgtgagaacccctgagggaatagatttttacttattcatctttgaaactcctgagaccaagcacagtgtccacattttgatgaaatgatatggttgggtaaaaaatatagatatagatctatagataactatagatatagatctatagataaatatagatctatctatctatctatctatctatctatctatctatctatctatcatctatctatctatatattttgagatggattcttaccctgttgcccaggctggagtgtagtggcatgatctcggctcactgcaacttccacctcccgggttcaagcgattcttctgcctcagcctcctgggtagctgggactacaggcgtgtgccaccaaacctggctaattttttgtattttttagtagagacgggtttcaccatattggccaggttggtctcgaactcttgaccttgtgatcccctgccttagcctcccaaagttctgggattacaggcttgagccactgtgcccagcttccattcctttttataatggagttaatagactgccagttaagggacctgctatagatatggtgtctctggattttggcaatcagacaacatctttaatgatagttttctcgcctagccggtggttgggtaaaatattttatatgggagatggtggaaaagtagaaatttaaggtaatccataagtttgctttgtagcctgagtggcaacctaggaggagctgttgagtcttcttagtcacaggagcattggatatttggtggatacaaaagatgaaaagagttttggtttgtttaagagaaacagggtgcatggaagacttctcttgcttggatgggtggattgaataccctcactgtgcactaatgagaagaaagccggaagttagagagaaaatgaagatgaaaggagatggaggagggaggaagtggtgcagtaggtgtttgtaagggaaagataaaaattctgggatggaatgggatgaagggaccagtctttggaaagttgggaatattcctctttgagatggaggtgggagaaaaggataggtgataatctagagaacatttgatgtgaaaatgaatattgagggcctagatctcagcaaagtaaatggtaacattttctgagagcaaaggaggttaggatgaatcaagaagtttgagatgtctggaaaagatttggaagagggaagaattaaagggatagtcaatctggggcaaataaaatgcctgctgggtaacacaaagaaattaactaggactgaatggcatgaattcttagtggaagtgatcagcatggttgattgtctttctcagccagggagcatgcaggagcttgggaagggaagcagacagaatggattttgcaattagcatagggttggaggttggcagggtggaagtgatgagaggatgacaagtgacaagggatgcatatcacgcatgtgtgggaagtgtttatgttaaccggtcttgtattccaggctgggaagagaatccagagaccagaaatgcaattgacaggctaagacctctggcgagaaaaaaaattgtggctgttgctttgtttggtcagttcacatatgaggatttaatatatatgattgagtgacctttacatggctatgagggaagctgtggaatttttgggtgtgtaaaggcttttcctgtttctttgaacctcgtttcctggatcttgttgagatgatttcatggaaagaaggcctaataacagtgtgcaattattttattggattatgtttctataataataaaaggtttgggagtaatgaggaaacatcaattgacaccatctaaagttaggccatatgcaaatacaaagttatttagaacaacaacacatggaacagataaaaaaaaattcaaccagattatctttctgagacaatgtaaatatttttctgtacaaaggcagaggataaatcgtgatttctatgtttctacttctaaaagcattcagtttttattaagagaatacattctgtactgactagattctagattttggacaatttaacttcagtgattcattggagtagatcaaagaaagttgctgcagcccttctgtcttaatcagtgctatgtatatgcaccagtattttggatacttgatctctctctctccctccgtccccttttcctcctccctctctctctctctttgtctttccagtaacactttattgaagttacttaaacttttaatatctactttttacattagcctacatgtcctgaaggaggaaagctttttaaccttaagtttttgaagtctagttatattttatagattcttcttctaatcacttagggtttgctaagtagaaactatgagaagagttattttaacatgaatttaatttcgtttgtggtttttacttacagtctacttctgttttcagattcacgcccacatgatctcaagtgagatgattcatatacatgtgcttttatgcccaatttttggtagtttcaggaataaagtctgaaattaatttttatgctagcacatatattttactatggagagatttgaaggggaaaaccctgcccacaaatatttttcggtgtgcctacaaggtcctgcgaaaattaagaatgtatagttttgcccacaatgaatttctcaacaggatgagaaaggataagacacaaatgtttaccaaattaaatttcagtctcttactgaaatatcaattcaagattaaaataatagccatgtgacagattaatttatggccagatgccaactaactggtatcatcctggagcaggaaaatttagaggttgagagaggatttcaggatggcgagaaggaatcagttttgtctaagttggactgctagtgtccatagttgaagaatataccgtttgtagggttttttggtgagaattatgccgtgttgagccttgaaactaaggtatcttgtggtcgagcaggtgacaggctctctgaaactaggtggcagagtatgaaggaaccagcttcctctctttacttttgccactccgaggcatagtcctcctactctttttcaaggtgaatccgccctgatctttcgggtgtttgtaaacgcagacgctgcttttgggtttctataaacatagttcttatttctttcattactcaggcaatacataagatctgaggggttgtactatttatttctcatggggatacaagataaaattattaagcgtgggaaagtataggagtttacaatataaaatattctaaaatatctatgttcaaataactctatcagtttttcaccaatatgcaaaatggatataattcatacttcagctaaggagtaacatatttgatcttggtgttaggaaagtatttttgattggagggtaaagagactgaggcactggtagtgggtgtggaaaagaaactatagatttgcgagaaattggggagttgttactagcaggatctggtaattgattattttggaataggcgacataaaaagaaaataaagagttgaaggtgattctgtaactactattagctaagacacagacaacagttatagaaacagacaggaagagaagaaaagtggtgatgaattttgggaaatgttgagtctgagttgctaaagatatatttatgtagagttaaaacttcaaatctgtagctcaagataggtgtcagggctagtaaaatggatctacaagttatctccctgcaatttactgaaactgtggaagttgatgagactgcaaagatggtagagccaaaagaatataggttgtggtcttagaggagaatccgaagaactcattgctctacagcaagggtggggaggacccagaaattgagaggctgagttagtgaagtttataagttcctgatttgggcctttacaaaaattgacagatgacacaccttctgatttcaatttcatatctaccattctgaagtcccagaattcaatttcagtatacttcaaattcacttacaattatcttatttgtgcctttgccactatttggaaagctcttctctgtcctctatttatttaattcaatatcagactcaaagcataactctgaaatgctcttacagattaaacaaccccctttgattcaattttgatttccactagccttcattcttgtaatagtgccaagtaagggttctttgcttaactacagagcttgagactaaaaatgttcttcataaaataactctgtataactgagaggtaacaaaaaggtttttaaaactgtggtgcatatgcaagttatcatgctgaaagactaaagatgggtgtgaatcatcatttaaaaaggggaagatgatagagtgttccattcttttttttttttttttttccttttgagacggagtctcactctgtcatgcaggctggagtgcaatggcgtgatctcggctcactgcagcctccgcctcccaggttcaagcgattctcctgcctcagcctcctgagtagctgggattacaggcatgggccaccatgcccagctaatttttgtatttttagtagagaagggatttcaccatgttggtcaggctggtcttgaattctgaaccttgtgatccacctgcctcggcctctcaaagtgctgggattacaggtgtgagccactgtgcccagcctccattcctttttataatggagttaatagactgccagttaagggacctgctatagatatggtgtctctggattttggcaatcagacaacctctttcatgatagttttctcgacaagattaagaaggctattgcgtctataagagtgattagaatgtgatgcctctgaaaagccactgaatcaactgagcatatttagcacagagaagacagaagaacatgagatactttctaatatggcactgtcacatggagagaagattagactttgatttttttactttgattttgcaaaaagcaaaatgtgatgaatcagtgaaaattttagggaagtagattttagccaaatgtgaggatggtccgaataattaaaactctgaaagtggaataagctattttctgaggctgtttctctatccctgtaagtattcatacctacagtccttggcctgttcttgggaatgttggacgtcgaatgttttcatctgaatttattttatcagcttctcagagggacctgtgagagcacatctaactccagatttcataagcctatgaatgtttggctttagtatgaacatattgtttggctgaataaacatagctgaaactgtatgtgagaaggaaggagtttgctgtgcctcaaggtcaatcatcctaaacatttattgttggggtaaggtacagtaagtttagatgaaaaaggtgcaagagactaagatgactaagatgtgtcctggttcctcatatcagattgctgttatccaagcacttattttcttaagtggaagtacaggattcttccttctcccttcatgaatttagagccctgatttattgagatatattttaaatgattgctgcactttatacctattccttcgcatatttatactcaattggattttcatataattttgtaatttgttttctaatttgctgtgtacatactccattcctttcacctatcccaaacctataaagtgattgagtcagtatcattttcccaccattcttttgggtctaaatataccataagcttctaaatacataagaagcccttcaaaggaatatattttagatcttgctcagaagtcttattatttttcagaatactgataacaatgaattaaattacgttgattttagcatttgatttactcaacaaacatttatagtgtatgattatataacttccttgtgtttgcacaatcttgaagttttatgcatatgttcactcatctgtttaaatgctttggttatcttaatgtgtatttttggacaatgcatttttaatccattttagaatgttaggcaaagtaggttggttttgcaatgttccttaaaggtcattaggcttgagggtttttttgttttttttgtttttggatcagtgaagaagtaaaattccagagcctcaggtcttcctgaaagctgccttatctttggttttttaaaggttacagttgggaaacattagcagaatttccacattattctgaactgctgggaaaatacagacctagttttttttgttacttttcccagagattttagtctcagattacttgaaatttcataaactagaatacatatcgatcatctgtaataatgctggttttttaatggaagagtaaatatgaaattgtttaaagcaagtttgttatacataagggaggtatgaatacaaattgcgtatcaccaataacaatatacataatatgcagattataaatgctctgtcatagattattatcaaatatttaattgaagtgtatgagagctaacatgcaaaagtctcaaaatttaaacacaaagagaactagttatactcctttttataagactatattttacactgattaagttttatgaggttttataaagattcctgccaatcaacataatttgtattagtctttcttgaagtaagcaaataaagtatgggtaacaagtagaaaatgtatttttctttttgtttttttttggtttgtgagtttacacacacctctgcctggttcagtagaatatttgaggtggcttataagaatactttttaaaaaggattaaaacagaataatggtaaatataagtagactaggaaacccaagtccggggaaatcagaatatataggtataggctgtggggtcaaacacagttattcaattttgaatgtagatgtgcgttcaaaagaaaacttttgggggatatacttttcgttgtctataaggaaaaaaaataacatacagctactcagaggaaacaatacttttccttgtatttagtctagaaacatacttattgtctggtttttcatatagagatcactgaaaggatactgccctcaccagcctccttatgatttatttatagcgtgttttaaaaaagtgcttactgcaataacacttaatgtaataataattgccagtgtgaatgagctcttattctatatcagacactgtgctttcctgtcttgatttcatttatttccacatccaccttacgaggtagagactgttgttattcccatttaaagttgaagaatctgacaaagattaacttgcccaggatccacatcattagtggtggacccaggcaccctgatttttgatcctttgcttttaaacacttctctagtgcagagtaaaacttggtgagagtacttctgtcccagagacactaatgagaatcattttattcgtcaggaaggcttcaagtatttggacttttaagtggcaatattgcccccaatatttttggaaaactgtggcatgtacagaaatttgaagcaacattctcaggttcttctgttactataatattatttgttaaaagcattcagttatggagataatattattgcttgattgtaaattattggaaaaatatccctcttcaatagtttgaacagttgtcttatagaaaaggtaaagtgtacatttctacctacaaagggcagaactaagagtagttataaatgacttgatagcagatttatgtttaaaaaaaaaagaataacttgttaatgcaccaacctgaccaagaataaaagttgttcccttgtgaagtagcaatccttgaaattttggagaaaggctgagtattgcgatagacgtttctacactgggtgggatgtgaaactagctgagctgcagaggattttatcatcctgtttccaactgaatatctatctctgagactgttttctcatcagtaaaactgagctaagtttttttctttattgcattgttgatggttctgaagatcaaataaatattatatatttaagtcctttgaaaaccattaatattgtaattgtgaacattgattaatttattctttcaacaaagaaaatttttattttttaaaaacttatgtaacaaacatattagttgagtggctattatatggcatataacatattttatatgttattatctaatttattattaatgctcttagatttttctctcttgctaatcaccatcttaatattttattccccaactgttggagacaagtaaaactaccaagttttaaatttagataatgccaactaggtaaaatattatagaattttaaattaaatggaaattctatttacctgaatatttttcattctcctttaccaggaagaattgagattggagaagattgtttcttaccattcatgcccttctttagaaacaggaaaataaagggtattgattctgtaagatggatagtcatttctgagtaggacatattgtatttaaattgatcatttggaacctttagtttttccattttctcttgctcaattcatgtttgtcactttctttgagaattaattcaaatccaatgccctacaatggcttttctatgatttcctctactccattctaaacactcttccttgtgtatatgagagtttggctctattgtttagctcttgtgaagaatcagatttgcagaatttttgagccagaaaggcttcttcattcatccagttcaaccctctcatttcctgatgaagaggatgaagacaatgagtcccagtcacacagatggtcagcctttgagccagaattatgacagagcagttgtcactaccttctgttttgcagttgcttgattgtttatgtgtgtgtgtttggtcttcccagtgagaggatttgttgccagggacctcgcctttttcctcatccaaagcaaagtagttcttcctcacttctttgtccagagtaaacatactaggatgctcaggagctagtctttggaagtagatgccagtggtgttcaactatcctttaatctagtactatttttaatgcatcttaaatttttattttgatatctaaaacatatttcttttatcccattattagtagaattgattagcattatatataattcagatttcatatatatgtatttttaaatgggatttcgctcttgttgcccaggctggagtgcagtggcgtgatcttggctcactgcaacctctgtcttcccggattcaagcaattctcctgcctcagcctcccaagtggctgagattgcaggaatgtgccaccatgcccagataattttttgtatttactagagatggggttttaccatgttggtcaggctggtctcgaactcctgacctcaggtgatccacccacctcggccttcccaagtgctgggattacaggcgtgagccaccatgcccagccagattttgtattcttaatagttatccttacatggagacagaaataaatacctctatattaattagatgattagatacaaatctattttctagtacttggaatactgtgacaaggggatgagtagcaaagtctgtatctcaatatttgatatacctaagttttttttaaatataaatagttgtgtagtacaagataagagttcacttagaatagtgcccctcaagtctggccatatatcatgatgacatcactgccccagccccatacacacttgagttgaaatctcttaggttgggcctgtgcatctttatgtttcaagagctgcacagcggttctaaccctgagccaaagtagaggaccattggcttagaaagacagcattgttgagataatgaaggcccccttttaagagaaaattgctactttgggttggggggaatgtatgcctgttggacatgtaaatagaaatcttatagaaaggtacagactgatttcatatgtgactgaaatcaactgattgtctatgggttgtctttcaggtctacctactagttgagttgcaactacaaacctccattatccagagtgaaatttattaaaccagggctgagttctttgtttctcatttcagaaataacatgaaaaacctactctgataatagaaattggttactagaaacttccattttgttattgtaatgagtagtggctgactcaaccaattgaaagctttagtaaggttggtttcatgtttggatatcatgatccccatcttacaattatctatcaataaatcctgctccctcttcagagcatttcttcagtgttatatgtaactgcccaccatttatgagactgccatatgggtagctcattgaaatgagtaaatagtaagactatattaataaaataacatgcatatattagaaagtcacagaacagtcaagtggtcacagaagttttgtttatacaagtggagaattggcaaaagtcaatttaaatttttttattgggaaccttttctgaatcttgctttgggctgggtgctgcggatcacagcaaaaccctgagaccagcttttgagccaagacatttagttttcaagagaagcaaagttgaatagactgaggatagtgaattaatagtaattgcatattatttactattcattgaatataatcatacagagaatgatagtctttttcttttttgacctgagatggacactgggaatcacctaattctagaattttgcagataaggaaactttcttaaaaatgtgataaattgtccattaataacaatttagagcaggaagaactttattttttgcctagagtgggttatatagttgtgcatctatgtgtatatggtccacatggcattttcatttattcaatggagagttgagagggtctgtgtttagcactcgaatattggacatgattcaaatatgagtcaagtgtgtctagaggctttattcatacctattttcttttagtcagcaatgcttcataatgccttggtttcacgaattaattttaatggaattaaatttgaacagctcaaaattatataattaatttcattcagcttcaattaaagttactaattgaatcaagcctactagcatgacacctggcggcagtcagctacataacaatggcagcaagtatgtaggactctgctgatgagctagttcttgcctactagtgagtttccatgaaaaatctcttttattgataatctcagaatgaccttgagttgactgtagcagtaaaaagatttctggagttgtttaaaaaagtaaagattttaattgaaactaacatatctcatgaagattacatttctctatgataatgctgagtaaatgttacataaatctagaacatattggtttagcatattttcaatttatattttactgctatttgaatatggttttgtttataaaaatccttggaagttaagaccccatttggttcagagaccttagcctctggactcggtcccaagtgggtgtctctctatttttatgtgttgaaatttgtttcatggcagaactttttaattgttgtgaaatccccatggtacatgaaaaatttttgcatgtgcagaaattttttccttccactggaaatgttaacacggttgactaacaacttctgtttgaatctctttcctttctttgcttccatggcttgacatcatgcagtttttcttacttctctaactccttcctaattgtacggactcttcttggtacttggtactcttcttgatatttcttaatatattcactctttcagtgagctcattaatttgaatggctttggaaatcaagtttagaaagatgactatttctagctataaccttttttctgacttgcaaattcaaatgtccaatacttaattcatccactagactgtaaactccaagaaggcctgggcagcatttcataagtcattgtatcctcatcacctagcacaatgcctaaacatctactatgcaaaaatatatattattgaaagaataaattggtctcatgatttttaggctttcccagtcaaatccaaactgagaacttggtcatatccaaccccatcttccttgataatctttacaaacctctagttagtttctcacatttactccctattccatcttgttatccagttaattaaactcttatcaacttcaatatgggctttgctaggtctctcttttagtttcccttactgtattctccctcttagatgtatccatactccattggaatcatctgagttcagcctcttctccctcagttgaaatagaatctttgattctggtatccagaaatatgttttttgtttgtttgtttgttttttagttctaaaaatacttacaagaaaaaaaaagctcaccaagtgaattaaagtgaagccagaactgagaatcacaagtgtgcacaaatttattaatcttcctaaggcgtggttctgataaggcatttcataaagcttcagtggctagtttgacttatttttcttgcttttgaatttcatccagatttctcaccttagcattctaatatccacacaatgtctctaatcaaaccttcgcagtcttctgtcctaatttgccactcatagtacttcacagtccagagagttggaacctttgcccaaacgtctgcttttggagtttgcccgtgctgttcttccacctttctcccatctggacttttggaaatccaactaatcttttgaagtccatccaacatgtatcattttcttcagtgcttttcttgatctctgaatcctgatgagtattttttcttcctttgaacctttttagtgctctggacctctcatagcatgcattataccttgttgccagtttgcttttggcttgacttatgtgccccaaagactttacatttccttacatgttggctttctccctgagaacccataaacccacttgcgaatctctcgtcctaaatacccccttctcagaggatgcattacacagtccttgactttttcttcacgttctagagagagaatgctgtacttgttttctatacctcctcactactcagtcactcctcattcagctgcaggccgactttcgtctctaccactcatcagagcttcttctctttcacccctttccctgctgctcaaccccctacatgcatggactcactcactttcatgcttcctgtaaccttttcacatttctctatcatggcacatcacttgctgtgttaaaattacttgtttactctaaacttaacagattatttttaccatgaacatctctggttctttaatgccaggctgatagtaggtgctcagtaaatacctgttactgagccaataaaataggcagcaggcaatagaggtatacctgttctatttccttaaattatggcagacttggaagcatttagaaaaatgtatatactaaaaaaggagagaaaaatatataaaatcaattatattaaatgtatcttttttaattcaggaaaatgtgataaagacaatactgagaaagatataactcaagctaccaatagccacttcacacatggagagatgcaagaccagtccatttggggaaatccttcggatggtgaactcattagaagtaagtatttttagaaaaaactttgagtgattttgggatatgactatggtaatatattcttcgttaattgccccagataattctgctacaaatccgtaaatcaacagcgtttatctaaaagtggtttcatttgtattttaaattacagagctaaagctaggatatacataatgctgtcagtgttgcctttcttcagaaatgaagaattgacgcgtaaatattgaactcttctcagagagatttagtcaaaattcagttcctttttgagtaacaactaagtggaagtcaaacaactctaagtatatgtggatggagaaactaaaaagaggaagatggagctaaaagattaatgctactatggtctctgttcttctagctaactgactccaaattttttttatgattaatattttatcactgtttgttaaaaaaattttttgtgatattcttcttcctaaaattgcatacaaaagcttcggtctattttcatgttattctttgaatgccctgcaataccttgtcttttgggtgctgatcagaatgctgagtccatgtggggttctgctcttgagctcctggagtttacgttctggtcactaagttcccctaggtgtgttcaagatgaatttgccatacaatgaattactcgacatagcaaacacctaggtgtaaagattgctgctaagccacacctggaagagcatagggagtaaatcttttgatattcccctttggagtaaccaaaataccatgtttccttctcagtttttcagagtggatggaggagaatttacttctgggatcaaatgtttattttatgtttaaaaacttatttctttagtttaagtaacttcatactatagatcctttacagtcttccacattacacttactttgaaacttagaacatttctttcctctctagaatgccactacctgtctctaactgaaaactaaacaaaataaattagaaaaaaaaaggaagagggtccaacttaggagaaaataaacaacaacaataaaaacactattgaaggaaatttccaggtttcaaacaaaagctctaaaaatgagtgttttaggttaattttaggaccattttggtttttatacactttggtcttggagaagggagtaggaaggaaggaaatgagactcaggaattagtgaggaggaagatttatatagctttatccaaagaatcatataaacattatttcaagtaaatatttatctgaaaaacatatattgattagcatttatctaatattgactctgctattgtgaaacacatgattttgtggaataactggcctatgttatctctgacttcctagcaaccagagttagtgagcactagaagaagttctagagacaattttacctctatctgttgggaagcaaaatggttttctcacttttttttcggtggtaacaattttaagtgtgtgcttcatttaattggtttatttccttaatctcttttcctagggcccacaataggaaaatgtgaataagatttcttagaacaacagcaacaaaaaagacaaacactattaaataagaatatggagagtcatgctaatgtgttaaatttgtttatattatttggtgaagctcatattagtcatagaatccataccattaaaaagaatgaattaaaatgatttactctacggtttcattggttaagtgggtaccaatctaatatattgtaaattgcatgagtttctttattgagataatgacgtaccctgtgccatgggactttggaacattaggaaaccactgtctagtttcttactaatattcactgaaggaatgaagagatacagaaatttacaccccctctgaaagggctgctggggaaactgacagtttgaatggatttacaaaagatactggccaaagatagcaatgccactcctgcctgaaacataagctggcaaatatttccaaatatttgtgggtgaaatctgactctgaattttgattataaatttcaaaaactccatttttgttattttcccagtcacacttttctagacaaagtctactttgttggatcaacagaaaaaatttgatatctggattttgcagaagtggaacattttatatcatctttaaaactgactcaattctggatagcatttgaaagttttgtattgtggtagcttctgctattccaactcctttgatattaaactctcagagctgcctgactttccttctttggccttccccacagagtcattggccatctctgtgtaatttagtctgtctgtcttaactctgaagttaggaagatgtgtattttcctcttgcttaagcatctcgcacattttgggggcccagaaactcttttgtaataacaataggccctggaaaaggagactctggctcagagcttcatgggaggaggggaacatctgtgttgagtcaggcccgagctggctccgattccaggagtcctgtgtggctctctgagcaccgtggaagaagcggacagctggctctcacggaattgatgttagtgttcccactgtagcgcgagtttggctgaatagagggatcatcagaaaaatgaggctggctggggtgtgggaacattttcaaatgcacaacccactctttttccaaacttccatggggcagctcagctgcatacgcaagaagtgaaggagacagacgcggtcgaatgtgacttctttttctttattcttgaaagtggttagtgagggcttggcagctcgtgtctccgttgtgccggatggctgctgccttctttgccggacactcaaggcataatttataggggactgttagctgtcagtgtaatgaggctgtttttacttttctttgctgagaataactgagctctggaaagtcagggagtggctgctttggaaattgtattctaattaaagggtgtattctcaggcctcataagggatattcacgctgagaataatttccaaattattctatgaactttaaccctgaccttagcggactacctgcttgaactcatacttggttcatgctctacacagaagtttgtacttagtctgctttccctggtccacgtagaaaacattgcaggtggaagacctggggtattatggtttttcagggtgcggatttcaaattggttgcccttgaattgctaacatattacagagaatacattatggaagtaataaataaaaagaagaagctcatatggaatcaaacatttcgaataaataggccacacacaatctggtcagagaacgcacattttggttctctttcctatgaaatttaaatttaaaaagacaattccaaccacttaaatttgtttaaaaatttctaaatcaaattagtaaagaattaaaaacaatggaggttttatgaaaaaagtttataattggaaattctctttttttattttatgactttttatcctttttacatttcaaaaggcttttatactcttagaacataatttggtgtataatttaatttctgaaaggtggcttaaattttggaatttataagagcaccaactaagcctttggcttttcccctcagattagcgtatatggtataattgaagctatgccctgttttaattgtcactattcctctgacttagtaaaataaatgttacagtgaagcgacaccatcaattaatattaatttttctatttaacccgtaatatgcataaactgataacaggcaataggcaacatttcatgttttaattagacaagaaaaggaacagaagcaacagaagcaacattttgatctcagtctttgcggggatttctaaggtaggaagaagagtgtgtgtgtgtgtgtgtgtgtgtgtgtgttactgtgcttacactcaggcatgtgtaatattttcctttaatttaggtcaaattctactattctaattatttcctatagagagcttacatttttctttgttcctctttataaagtgcctcaggtctctatctcaggtttttctaggtctttctgaaaattcttattacttaactttatccttggacattgcttttacataaacgtctgctaattctaaatgtcattacttaactccagaaattttccttagcttctcttctgaaataaatttcccattaaattaaactattttgttcagctaattctctcctttgtgattttatagaattcccatgatctgaagcaaagttaaaatgctctacttaaatggtaatccccattctatttaacccatttattcattttgaagagtttttagctctcataatagtaagcacttaattggcagtagaacgcaagctcttctccggctcacacttgctcacccttatggagctgccgtatcatgccttttcactcatcttgctgcttgaaacctttctcttggcatcatctgcaattcctctcaacatcaacaggctctgttatttggagctctattatttcttttcctagcctttgccaacttaatgcggatcaccccttaatgcataccatttcatcactttagggaatgcctcctttatgtaaaatactgaaagaaaagcagatactcaggtgtgctatttatatacttagaacatttttactttgttggtaagcaaagagcattaagaggtttgtattaagtttatttcacagctctcatttgatggcacatttcagtaagtgttaatttggatttctttagaattcactttatatggaaaaggtcatcaaccagcccctagataactatgacctagttaagactggaagatatagctatcatattatgtttcttgggtcatctaggagttttttccctaatatttcatgctcattcatttttgggggcacatattggaagcaaataattctgacttttgccttgctcaatgtcttttcctcctccatttggctctcagaaaaattctctttttattcagtatgttggacgttatgtgactgtggtacacatgctttgattattgttttagaggaggatctttatggtcagttattccaaaatcaaaccaatcgtttgggttcaagattgggtggataatcctaagtcatttttgatgggctcctgtatttatctcattggtcaatggcagccattaggctgtattctagcatggaggtcaagttacctgacacacttcttctcaggctccattatttcatcctcatctggcttctgcccagaagctggggagaaccatttcattttgagccgatttttgtttggagcatttaatgttctggggctaagaggtcaatggaaactgacttccaggagtcagaccgtgctgcatcattactgctaatgctgggccagttacctacctctctgagctctaacttctcatttttaaaagggaggtgctaacattttatgcctcattgtcattttgatgattatacaagaaaatgcatattgtatgcttccttagcacaaagcaaaatgagtaagcacacactgaatttattggttttcattgttattatccttgagcccagctattagttctaaggtttgttttgttttgttttttaagttcatcatggctgcattgagttacatgtccagacaggctggatccaaaaggtcatgtctttctgagacctttgatattgtctacaacaataaccagcacattgattgctgaatggtttatgcttaataaatgcatgatgacttaagtgtattgaattaataagggggagggaagagatgctttacctaccttgcctctattatttcagacgttaaggtcctgagatgaaggttctaaatcactacagtattccatttattctttctaactcccttcttactcccaggctgcacgtggtttattcatgtcaagtttgaagtatgtatagatgacttttatgatattaaagcaatcaagttctaaatttgactatcgtttactgataaggctactttgaagagttttcagtgaagttcttatggtagtgctctgtataacattcattttctgaggaggtgaataggaatgacactttatttatggccttttttgcatccgatgttccttatttttcttgcctacccgtaagaaaaaaaattcgagacgaccttacttccctccctgccttttgcatccctccctccagcttggatggacttttcttccatccttccttctctccctcccattcttttgtcctccttttcttcctcttttctttttttcctcttttcttcttctttctcatattattctctgcctttctaacagatgtgtgtaatcctactgcatatatagatattgttcatcagtataaaggtatatataatgaaatccattactatttaaagattgtaattggtaataaattccttctcatatttacctctagttctctggaattgtaaattggaatttgctcatggattttaatgagttgtgaaatgacaagttatatacaaacgaatttgcagagtgtaagaaaaaagagactgctttacaatttatggaagtagatgtttctatgtatacttctctgtgtttcctccaaacaaagcttctttttgtgtttttctagatactttccattgtgcttaagtgatcagatttgttttcgtgaagattggataagaatatttttaaagtgctttgtataccataaagcacaatgtgtgttgttattattgtcttattattatcattaatatcattattctaatttattactttacctttcacttttattatattctatgacatttgatttgtaatctatatcctacttcttttgttaaaggtttttaatctcttcctgttattcctaaattatttgggtcattattgggggaaatgagatggcattaaagtgtaagtagtggacaagggctcagtgaggaggtagatttattcctctcctattggagagtgtttctgagcctcaggaaggagctgaggcttgggaactggcttagagatcatcccaaaaatgctaaccactgaagaaataaataacatttaatgatcaagaccacaaatgctgtggtctagataattttagttctcaaacctcaaacttcctggatctgaacactctgtgaacttacacgtaaattatgtttttgcagatcatgttgttatattgaaatttgtgaattaggaattaaagagtaattttaaaaacaaaattaaaaattgattacatgaagactgaatgcttacagtttaccaactgagttatgttggagataacagtgatgggtgtgggttctgcattcaaagtttacagtcttgtgggagagacaatttattgtgatatgataatgtgtattatgagtgctccagtggggaagtgcaggctgtagtaggttctcatgggataacacaaaccctaatgtggggagggggccagagggagctttccagtggaagtgttgtctgtgatacctaaagggagtccaccaactgaagctgttcgtgggagggactgaagctggggtgttccaagcccaaagcacagcacacctacagttctagaggtaagagaggacatggccattttgaggggagctggggaagttttgtgtaatctgggatgtaaatgttagatgaggcgtggtgagaaatgagaaagaatctgttaaagactaagggaagatagaaagtattgaagggagtagtgacttaatcaacattgtgttttagttgggctatattttaggatgatgactctggaaatagtgagaaaataaataggaatgggaaggactgaaggcattaagagatcaactggaagactgttatgtaatgcctctgagaaaggaaggtgtcttggactggggtaatgacaggtaggattacaaggaggagatggattcagctttctatgggatgtagccagtaagacatataggattaaaggaatgacaggtgctgagaatgaagcccaaggttttagtttggacaagtgatagttgtgatgaaatgacggtggagcaaatgatttgtggatattgtccaaagagggtgtgaagtgatgagctacggctataaaatgggtagggaaggaaataaagacaagaagggcatcataaataagtaaaaacatcagaggggttaatagtccataagtttcctgttgtttcagaaataaaacaggtatagatatagtaaatgaagggaaaatatgggaagagaagatgcagtatgagaatgagaaatatgaatttaagatttctgagttggaatagtctcaggggaggtaaaggctcaaggtatagtcataaggaagatgggtgactgaaatagtttctcctaaactaaaagtgctataatcagaaaaggctgcataaaaattgccatatataacagctggggaagaggagatctagaggtttgttttaatcaaatatatccaacaataggtaaagctgggtttttatcaatgtttctggaatttcagatgcctcattgaaacttaaagggtcaggaggggccaagtgcagtggctcacacctgtaatcccagcacttcaggaagccaaggcatgaggattgcttgatttcaggagtttgagacaagccagggcaatatagtgaaaccctgactccataaaacaaaacaaacacaaaaaaatcattagccaggcatggtggtgcctgcctgtagtcccagttacttgggaggctgaggtgggaagatagcttgagcctaggaggttgggactgcagtgaactgtgattgcatcactgcattccagcatgggtgacagagggagaccctgtctaaaaaagaaaaagaaaagaaagacaaatggtttaggaagaatagccagttggtctggtcatctctggttctttgctgctttggcctaaggtcagtcacctgttggggatgaatggaatagtagtttgatattctctaaggtgaggtccctgaaatgaatggaaaaaaaaaatacagattttttggaaccagtcttcattactgtaagattccaaagagtcttctccatttagtctagtagatatacaaaatgataatttaaaaaaagacatatgtcagtgtctgtgtatatatagatacatatgtatatgaaggaaagattaatatcaaattatacatgtgtgtttatttttttcttaatgcaagatatagatccatttcctctcaatagttacctttagggagttatatgaagttgagtgaaagcatatgggtgaagaggactcccacttaatattctgtattctcttttctgtgtttttttttcccatgaagtgaattattttattaaattaaaacaaaaatattttaaaaagaaaattatcacgtgatatggcaaaatatcagggtggggtaccacctctttaaagtagcattagagcttagtcacctgtagaagatacttcaggttataggtggaccaggacattcggcttccttcaggttctgtaggagatagaaccagctacatgattcagaaaatggagggcagtgcagaatgagaatgcagggtctcttgttaaaatattattatgaatttcaagagaacaacagcaaagcattaagccaggcacgggggtccttctaagtgctgggcttgccacaaccgcgtagtttcgcacccatgatgctgggcctggctgcaagcattgaaggagtgggactccatttctggtaaacataaagtaatattctatacctatttttataattgttttatcagcaaattccaagaattcaggaaagaaggagtttttctgggcttgggcaaatcagttgctattctactcacaaacatgagaatcttgtatagctatgtgaaacaatcgccatgggcaagctccggaaggcagtggttctcagctcttagctggccacagccagcagaaagcaggaagacctgcttccagttttatccaaggctcagtacagcgtgtaggggtccgtcagaatgagaggggctggtggaaatccctctctagcaagctgagaatcagtacctgatttgctccattttttttttttcaactagcctttaaggagttagtgacaaatccatgctccacagttttccaccaaaagctggattttttccaggtccctgagttctgcagcaagatacacaaaaatcaaaggaaatctcttctaaaacacacagatgctgtcttagagggtgaaaattacattaaagtgaaccatagaagagagtaggtggagaaatttgttctgctttggaacattctttaattaagtatattttccatggttcatgagaacttgtgagaactccgattagaaaatttaaggaaaaaaagattcccaccatctcaaattgtcatgaataattgattcatgccagtgtgatcataataagatcatacttcggatgctgcccatcattccctgtctttatgaaaaagatattaatatatcatttatgtgtaggcctgtctttgcaggttatcttcacgatattccttcagcattgcaaaggcgctgtcataattacaaaggagactgataatgtaggcagcagtggcaacaacaccacacccaacgaatggtgtgattattaataattaccattttcttcttattctttgtgagttgggttcttattattatgtttctcccatattcagtagatttttaatcttaccaaatggttttgtgtaaaaatatttactacagaacatggaagattaaacccatattcctacatatttaagttttcagtattttagccaatttgtgatagttgatttttagtctagctttacatcttttaaataacaagaacaagtcattcagcatttttaattcaaatacatgtaacttgttttttgatttctaaataaaaggttgtcttttaaatttattaaattcaaatattttaccccaatgaaacaaaaaaataggtatatatcataaaaatcttttttaaaaagaggattggaataatattgatttttgccataaaggctacatgtgtttggactaattcaaagtagatggaacaatttcaggctacaagaacttctgattatttcaacattaaatttgaagctagttaccaatctggtcctggatagttgatgtgaagggatgttgatattatattaattcccaggtgtcacagaaaatcaaatagcagtacctgaaattagtcaatcagtcattgtgtgaaacagtgttgagtgtgatatggctgtgactctttatgccttctgctccactttctagctatgtgatctctactacagttgtcccttcggtatccatgaaggtttggttccagggcccctgagcataccctaatattcagatgctcagatgccttatataaaatggcatggtatttgcatataacctatgcatatcttctaatatactttaaattgtctctacattacttataatacctaatacaatgtaaatgctatgtaaatagttgttatactatattgtctagggaataattaaagaaaaaaagtttgcacatggtccagaagttacaaccacctttctccccctgctggatatttttgatttgtgattgactgaatccactgatttggaacgcatagacagagggagctgattttagtgtcttatttgcccttctaggtcaggatttcccagtctcagactgatgtagagcttcttttcatttctttgaaatcacattgattctttaagtctaacagccgtacctgtttcactcattccaccctgcacaacatattgatataccttggacttttttattatggagatctgctccattctaaggttttgaaaccagaaattcacattctcatttctccctgtccttttccttaatgataattgtgcctaatctgctaattacgttcttttcccttgtaatatcttatccgcttcttgtcttcacctgactgttttcatggtcaactggaatctgcaaatgatctttcatgatctccctaaattccataatcttatggcatttctgccatgcttatgctgaaactatggtaacagaccacacatcggtcggtcttctcacttcaggttcccagcctgtggggcatagaggaagagtgttatgtaatggaaggattaattatagaataaatatgtgttctctcatctcagttgaaatgtctctgcttctcagtttttagttggtttccattttgggttcattattgccttttgattttataacacttactgttctgtaaggattcagattatattctagtcctctcattactgggtcattgtagtttatatttaagcacagctcctggtagtcaaatccagttctggtctacatgcctgataccttaagccatcttggtctatgtcctgggagaattagtaaatactactacagtagtgttttgagactgataggttgtgtttctcatttagtgcagtgggctcttctcagtccttattctatctgtaggatttgacaggacatgttttctgcttgaaactccctccctatcctaccactcccctcaccactttctgcctctatagttcatgttgactccctttcagtctctcagatgccactgggttcctttctgcctctcgtcggtcttttgcataccagatcttccttcaggcttgtcccttcagaaaggccttcccagacccccatctacaatggcttttcctatttctcacaacaccctttcctttttagctgttgccacaatttgtaatttatttgtgcaattcacatgtctaatgtctgctggctctaagttgtaccccaagcaatcagcataattccaggaccacagtaaactttcattaagcaaatttggatgattgattttaaaaattgaaataaattgatttttttctctactacttcctttcatgaactttcgccatagccaaaatatgttatttgcacctctgtccacttgtctagtattttccttttcccaggcttcactcatgttacccatctctccacgtctcccgcccaacaagcaaggctcgtgtgatttctgcctcatctgggactgggagtgtttaactgtatctctcctaaaggactcattaatttcaaaattgtaatacaggtgtttatgaccctcttctccattactggactgaaggttccttaagggtaagattggtgtctcattcagctctgtagaccccacatccctcagcccagggccatgcacatagtttcccccaaatacatttatgttaattgttgaataaatgaaagtctttaccttttgactacatttagcgtctctgtaggagactgacagctttcaattagttaagctgtggtaatttgtttaaaatgtggattgactatctttgcttctcttaaggagctaattttctcagtccgcagttcatgcatattaaaggatgtttttattagtaatattaacaatgttattaccatagctttttacagttaatgaagtttttcatatattgatctaacctgggctatcagcagctcaagcatatgggatgagtatcactattatttatctataagactgagctcagaaaagtcaagcaactgacctggggccatgcagctaatatcttgatttttcagcatacacccttaaccctagagtgattctcaaatggagagtggggtagagataagggtagggaagggactttgtgatgtatgtggtcctctagagagtgttagaatcataggagaggagacagttgttccaagttataaccttattccaagctcccaattctagtccactttcctagttgaaaattactgctcttttaccactagtattaataagactgcattctgcccttgtgttggcaagagaaaagttggaaaaattgcagtatactatactccttcagaacttcatctttgttgtgctaaattcaaaacagttcttgggcttaatacataaatattatatatatatacacacacacatatatatatatacacacacacatatatatacacacatatatatatatatttgacatcttagaaaaaaggcatttttattctttaataccatttacttattgcctcctggagaacttggtctcattccaatggataggtagagaatcagcatatgccatttttaatgtgcggtaaatatgcattttccttctgcagcaagacaaaatcttgataactgaaaccaatgatatgaggtggggaaggcattatgattctatagtcatatccttttgtgtgaaataatggttctcatctctttatcttggcttaaaatatgtactgatgtgcagaacccaccccagaccaatgaatttagaatcattaggggtagggcttgggcatttgtgagcccccatgtaatcctgaagtgcagcacagattgagtattaaggtttttgattgaaaatattgccctgaaacaaagttagtaaaataaggtgaatattagtcacttatctgaatacttaaagaccttgtttcagaaagtggtttcttacagttatgactgatggcccacaggaactgataggtatggctctctgtttgggatagtgtgtgttttggctccttggcttaacccttagctctttttggaagttggtttttcaagagatgtcatcattgttcagaatgtgtttcttacttgtagttttactctgtaacacttttacctaagctttataatattacaaaagaatgattataatttgcacaggtagtctggctaaatggtacagtgaaagcacttcaaaatctttcaggtgtaatcataagaaattatttatcttaggattcttgatatattacatcgaaatcaaggtttatgttatatttgagtaaagttttcaaggatgaaaactattttgcctatttttttctgaagaattacaaacacctgcttctttcatcttcctttgacactctgttcctgaattggagtaagctgtgttttttagttaaaaatttctggaataagcagtcttccaatcaagtgtttgtagatatattggaaataatgtctccttaactattatagctagagtttgttcttggcataaagcaaagtctcttataatagcgatacagtttacctaagagtcatattaataagtaaaaaaaagatcagctttttgaataatatataaattcatatggtatcagtggtatctaggcatttgggacaatacataattagtttcagttccctttgagagggagatgtggatgttaaaataaattgctgatgaagcatatactttggagaacagtgtatttcaaaactgtgcaatatcagctttttctttcaatggtatggaaatatagcataagactaagaagatttattaggggcagctttaagccattcttactgtataaaagttcatagtttgctcatttaggagtagttaccaaaacaaagataatagcaaatatttataggcctgctaggaaaacattgcatctatacaacttttggcaccattatggtcaataagccaataataattatttgcttgtgtaagaataatctgtatcacaatatttaagcatttaatagggtttggtcatttaattattaaaagttactcttttattaaaaaatgagtcatggacttactccagaaaaactagcactcacaaagtaggaaaacttatcattgtgaaataaatatgtgctgagaaagagtagaaggagcatagcttgtaataagttgattttattaagtaaaagtgaagaaactgcctctgtggaaggaactatttagctaccaggaataaatatcataaactaaactgttcttgcagagcataattctaatcactctcacattgagggagttccttcaatggctttagtgtttctgtggaaactaattaggataccacatacacagtccatgtagtataagaccatatgtaagcacagtttaccatatactctggattttttggagacacacaaacaaaatacgctctcttcttattttttgcataattttgtgaagtctttactctgaaattgatgaaggttatcaccgttaccttaaatatgtttgaaactattttcccggctgggcaaggtggctcacgcctgtaatcccagcactttgggaggcagaggcaggcggatcacctgaggtcaggagttcgagaccagcctggccaatgttgtgaaaccccatctctactaataatacaaaaattagccgggcgtggtggtgcatgcctgtaatcccagctacttgggaggctgaagcaggaaaattgcttgaacccaggaggcagaggttgcagtgagctgagattgcaccattgcactctagcctgggtgacaagtgtgaaactccatctcaagaaaacaacaacaacaacaaaataacaaacaaacaaacaaacaaatgattttccctaaaatatgcagcccattacttagctaaggattcgccactcctcatttattatcttcctccggtttgcttattttgataaacattgggttcacaatcagttccttgtcctcattaagcctagaggaaatgaggggtttgttgtaacactcactgggaagaagtcttcaattttgtttgtttgtgttatgacatctacagtgttaaagtaaaaatatttaaatgatacagttcacagagtacatacttaatgtgccaaaagcacaaatgtgtgggagtgttcattttctgaatttttctttttactaaaaatgaacaaacataagaccaactattacttcttgagcctaaaaaacaaaattagataactaagctctcagagtcagaatctacagctctggtatgactgagtaggtgtgatcatagcctggtcagtaataatgacagattttagtgtccattttagtgtatgaaacactaaattacagtaaattgaaaaatgggtggtttatagtcctagaatagtatttctcagagagcaaataagacattaaatcatttggggatggttttattcttcctcttaattgaaggtgtagtgtcattttcacatctttgttcattaatacaaatatgaaaatatttgtgaaagtcctcttggaagacaggctcattatcatgtgcatctccagtttggacatatctgcatgatattgttttggcatacaacattaaaacttagtcttttggaaaatgccataaagaagtttcattattcagataacttaatttcaacttagagagtttccagttagtcaggcctattgcagtccactctagtgtgccttgggaaataactgctgaaatttcacacacataatgattatgtaggaagactttggaataagtggaggcgtcagtgactatagatacaaacatagaatggtgctttaaaaaaaataatggaagatacacctgtggtaagccaattatcttgactcccacattctaaatagactaataataataataataataataataataataataataatgggactggaggaaaagtgaaaataaaagaatggctaaaagtgtacctttctcgtcagccacttcctatttaataggagtgaggtgcttagttagacattgtaaaggtgcaggcagcacataacaccagtgtatagtgaaagactatatgcacctagagaaggtgaggtgtggagctctgtgattcggatactaatcctcactaaaactcattcactgtgggacactgggtgagtcactttgtcttttagcttaaacttttgcatctttgaaatgtacttggagaaaatcccttttctcactacctcacggggttggtgaagggtcaaatatgaaaatcgaaatggaaatattttgttaagtctcaaagtctctagatggatatgagtcacacagagtgatgagaataaccagcacttggttaaaggaagaagtacagggccattgtgagttatgccatggaaagcatagaacctcttccttactgcgttttcaggctgatccagagatgctaagcagagaaccagggagaaaagtagagcttgacccctggatcctctcactgattatccaagagtaagtgggaaagagtccagtaggtgtaccatggcctttttttaatatagtcttaaaaaaccccgcaaacacatatcaaaagggatttctacatatgaggaaatgagccactgcactgaatagaccccttttatttcaaaattaattttcacttttaaatataatgaaagatctcaatcagaaaaatatgcacaagaatattataagtaccaatgtcccagacactcagatttaataagtgttaacatttttccaaattttctggagtttttgtttgcctcttaggaaataaaacatattttgttcaacatgcagattcaatatgtatattctatgatttttgaaatcccacttaaatgatagtaaattaataatacattttaaaaaggtacacatttaaagagaggcacagacaaggaaacaatagtggatcaaatatgtgaagacatttcttcaagacggcaagtagatggagaaataataactaattttatggttctgaaaatctggaacctaaatgtcagtatgacacaaaacacagtactaccccaaaaggctcaagatttggaggacccaaggctcttggaagatgggatgaaatttagacctgagaagaagagtgtgcaagatttagaatatcaggtttcctccgcaccacccctgcctgctctgggcactaggcatagcagagcaagcatgggagtgtcatactaaacaccgggtgctcagtgaaattgactgcctaaaggatgagacacaatcctttccccccacaacacatgaacactcctaacctctttctctcttgatcaatgatggccatgaaccagagattacgaattagagaacatgttagttttcatattctcttttattccctagttctttaactcaaagcaaagaaaggaagagatttaatcttacctcctcctggttgccattgtcactagtagcagccctgagctcctgacaccaggctgaaagcagaggggattatgacactagtatagttaataattgttggcagtaggtagacagaaaagtgctcaatcacttttctcatatactttactcatatactccttatatgagtccattcttacactgctataagaaaatacctgaacctgggtaatttataaagaaaagaggtatagttttctcatgcatatgcatgctgtacagaaagcactgctggggaggcctcagaaaactcacaatcatggtggaaggtgaaggggaaacaggcacataattacatggccagagcatgaggaagagagcaaaggaggaggtgctacacacttttaaacaagaagatctcatgagaactcactatcatgagaatagcaagggggaaatttgcccccatgatcctatcacctcccattagacccgctcctacaacactggagattacaatttaacatgagatttgggcagggacacaaatccaaaccatgtcactcctgcaggttaatttcactctaactgaatgtttctattgaagatatcataccttccaccctctcttacttgtttctctagaaaaagaagaaaattttaataatgatgttgataaatattatttagatgacttagattctgaattgcaaggcataatgaagtgggttcttacatagattctttccagatttttttctagatatcatgtcatatacacattgtttttctacatgttgacaataaatcagggatctatactcttgtaatttaaagatagcgaaggtgatcagagatcagtgtgttcaacctctgtgtttctcaatggacaaattgaagcagagaagtaagtagtttgcccaagaatactcagatagtggcagaaccggagctgcaacttttgaaaatgatctttgataatcaatgagaatatgtagtaaccacttgcaatttgtaaaccatgatatgggatttgaaaggctatattaatagaaaataattacttgaaattaatgggagtttttaagttcccagatatatagacatttaattcactgtcaagttgcccattttgttctcccataagggtttgcctttatgataaaaactgcccttggtcatcattctaaccgtccatgtttccagtattagaattatgattctccagtgaagtgcataaggcaggagacataagaatctctggaggaggagtctgttttttttgaaccacacaggatattactagaggatgtgcagtgctcagataaactctgtggagttggaaaaaggttgagaactactgctagagaattatgtgttttaaccgagtaaaggaaccagatttacgaaattagacaaaaatatgaagttagatacaaatcagagtgatagtgtcatttctaaaatctgagcagattcataagaatggcaacatgattccctcacaactgttcatttcattattaaagagcatcaaatcattcatactattctttctagcctaagaacaattttcactcaatttcaatataaataagtttgtatatttcagagaaatgaatgtatgtgtttctttcttggaaagtaattaaagtataaaatttctgaaagtgttttctaatattccaaattgtggttgtattttacatttatatacagttgatggcccctttatgtaacttcaaagaaccttttattgggagtgcctcagtttgcagtaaatatttaagccaatttctggtcagttatactgagagtggtcttataaatgaataatttataatggtaatggcgtatatggtaaataagcacaatatttggaagactattgctgggaatggtttatggaagtacattctgtgatttttctaatatatttgttaatgtttataatttgaattaggtaataaatatacatccagaggacagtgtgtgtattatctagccacactggctttccatcaggtcagcaaatgtgctgagccttgttcggcttcagggctttgcaggtgttgttagtctggtctgagactctgttgctccttgtctttgtgagggcccttccccttcagatctttgttgaaatgccattccttgctatccaaactaaaaaatttcccttgatattctctctgccagtagtacttttatactagttgccataatttaaaattgtgcatctattatttgtttgtttttgaggcaagatgtgtcagcctgtcacccaggctggagtgcagtggcacaatcatagctcactgcagcctcaacctcctgggttccagccatctaccagcctcagctggtactcctaagtagctaagagtacaggcacgtgccaccatgcctggataattttattgtttttgtagagatgggatcttgttatgttgcccaagctggtcttgaattcatggcctcaactgatcctcccgccttggccttccaaagtgctgggattacaggtgtgagccactgtgctgggctttgtttacttagatgtttagtgtatttttgtttacctttatttaactcatcttagcactgtgtctggtactttctagataaatgtccggtaaaagaatgcataatataaataaaacataattttatatataatgggtatttcaacttcctgtttttcttcaagtgctgaaatctttttattgttctatttttttattagctccatgtattattcatggtttttgtctactgttggaatacagaattatatttttctaactattgatgaaattaatgtgaggtctatggtgatgaatacatttgacattgtcatttttccaactaatttgaattagaaataataattggccttatgaattatgtgcatgggatggtttataggggtttgaaagaggcagacacttgctacaggttttaaaaatcatcagggttaagtataagaagcattatatctgggaagtacagggaaaggcaattgcattatttttcttaatttgcttttctaggtaagcaatatgtacttattaagattttatttaaacaattgaaatggggagctgcagaagaacattattgtttctttctattcttccttgatgccctcccctcccctccccttcccttcccttccctttccttcccttcacttcccttcccttcccttcccttcccttcgcttccctccccttccgacagaacatcactctgttgcccaggctggagtgccatggcacgatcttggctcactgcaacctccgcctcctgagttcaagcgattctcgtgcctcagcctcctgagtagttgggattacaggcacccgccaccacacccagctagtttttgtatttttagtagaaacagggttttcctgtattggccaggctggtctcgaactcgtgacctcatgatcagcctgcctcggcctcccaaagtgctgggattacaggcgttagccaccatgccgggccccttgacgtcatttttctatgtggtcactgttctcagtgctggatcagaagaatagcactgtatgtatgtgggcttccatgtgtcatttaataaatgttgagtgactatatgaatgaaggagtggaatgtttcttgttatggaaaagcatacagtttggtggagaggacggatctttaaacaaattttgctctagaggcagaggagggagccacaaggttcccagcggaacaatttagcaaaggcagatagtagatgacatttcacctaggtgttgatgtaagagtaagaggtagtgaagggcattccaaggagaggagtagtaggtacaaggcctagaggcatgaaaagattgtggtaagtttgggaatcaggagaaattcagtgtagctagagtgtgggaaaataagagaaaacaatggcataggggtttggagcaatactgtgaagggtttggaagaggctactgagttgtgattttatcctggagatgggtaaatactggagctttcatctaggacattaatgtaaacacattttgtttttggttttattttttagaaatgtatttttggtagtgaaatggaagatgggccggaagagaaaatctggactcccagagttcaggttaggagaccaagataacctagataagagatgatgaggacttaaactgatgttgaccaggtagacggaggggaaaggatggattatggaacacagttgacatttgagagatacttgtgtgcaaggcacacagcaaaggttactgattcagttagtgacaggtggtgggggatgagcagggacgggccagttttgtaatctgggagagttttcaagatgtattccctctctgacatctattaactagcacagagtcttcaggatattattaggtgctcaataaaagtttattgtatgagaataagcaatattttctttatctctcatttggttgtatctttccctactttgttatttcattttttcttacattttatccttgtattctgacactatttcttagttttgcttctgttttccccagaagagtactttggttaaaatgtatcacttgcaaaatagaataacacaccgccatgtagtgttgcttcaggttataattttccatatatgtacagtatgccaaaaggatgctgcttctagagagaatgtttaaaactcacttctctagatttttttaaagttactttagtgtttcacatgtttgccagatatcattgtcattgaagataagcattgattaaatttcagaattttattaatgaaagcaatcttttgagcaaatttagaaaataaatttagttttggtagggtatattatttattttttgtagcaaaattatttcttcataatgtcaaagataatagtcagtgttttacattatcaaagtaaattcccaaaggtaaagaatgatttgtgagtgccactgggcttggctgtgctgaaattgtgagcctgttgttacttctgatttatgactgggaaagtctgtgttcattgtgctcactctgatgtcctagtcaggaaaccaaaaaaaaaaaaaaaaggaaaaaacaccaccaaactgggagatgtcattttatatggttattttttctatcttcaagacaaaatcaccaagataacatttttgaagcaccaacctgcacttcgggctgatgagtactagtggaaggcgtcatcttggaattttacaacccacagtcacatgactacagctcccaccaacaatatatcaaaaagaacaggttgtttgtgtcactaaacactataataaaagaacaaaataatatttacagaataacagtttatactagagcaatagtttaaaatctggttgtatatcagaattacctgaaagcttttttcaaatattgtttctgggttccactctctggaagattttgatgccacagggcagggttaggcccgtagagcatatgtagaagttgtatctgggaagcatggttagtagcaataggacaatatggaggacagactattctaggagattgttaatggacagagtttagcttcttagtgatgttaagggatgaaggtgctaatattcagtcattcaaaaaggcgtattggatttttttttaaaaaaatatatctacttagagcaaatatgtaaaaagttcaaattttaaaaattctggtaaatttctgggtgttatatattattcccaatacttttctttgtttaaatttttaaaaaagtgttgatgcagttgaaattgcttgttgctctctgaacatttgcatctttcttaagagattacagattttgttcagatgcacaaaagtcaggtgaaaagattctgattagtttcagccagtcatggtcatcctgttccccttgcaagtgattggtttggaggtcagcctgtgactcagttctggccaatgagatgtgagaggacatctcctggagggtttctggaaaagtgtttttaaatatttttagaaaaagacattaagggagaatgccccctcttttcaaggcttgatgtcattctttgatgaaatgcctgaagctgcatcatagactcataattatgagggcaatagtcagatgagaaagttgacatgctggagatgactgtaaacatatggaatctttgtctttcatgatataaagctgtgaaatcaataatagtagagctgcgctatttttggattttctgttatatgagatgataaatatttgtaagttaagttatatgagggccaggtctttatacatttattctttgtaatatcccttattccaagaatggtgcctggcaccatagtatataaaaaaaaatttataataatgtatttaagtcggtttgcagccaatgttaccttgagagatttagtgggttttaatggcacaattagaggaaaaacatctgtgtaaatggtctcaatcatgttaatcttttatttctttttttctttcttttcttttttttttttttttaattttgatggagtctctctttgttggccaggctggagtggtataatctcagcttactgtagcctagacctcccagtctcaagtgattctaacagcttagcctctcaagtagctgataccacaggcacatgccaccacacccagtttttttaaaagacagggtctcactatgttgcccaggctggtgaaaaacttgtgggctcaagggatcctcctgcctcagcctcccaatgtgctgggattacaggcatgagccactgtgcccagcctcaatcgtgttaatcttgaaatgtggttaatgagtttgtctctctgtgccatttgcagatgcttatatgttaagtaacattttattcccaaggagtttaaaattatcttgctactttgatgaagacaaaatctaaaattaataccccccaaatcatgctccaaaaaattaaaacatgggcaagattttaatctcaggagaaagcaaatgagaatgagaaaataatgtcatttttacttattcatttatgtgctagaaatttccattgtgtttaagctgtctatcacatataaagaagaattaaaaattagtatatgtgaatctacttctgcaagtttggaaacttttgttgcacgatttatctgaatattgttgttcgattatgtgggataagcagcttgttcattacttccttatggaagaaactcaccaggattttctatatgggttggacaagataattagcaccatcccagttttttcctaagttaattcttagaactttgcttgcagtcctaaattatcaaattatgtcagacagaggttcatctataatgagaactgttattagaattaaagcacaaagatttccttttctcaatgtattttaagggaatttatggaagtcctcctagtaacaactactcaccaaagaactttgagggctatgagcactactattaaagttttggaaatgtataataatagaattgattttcttctgatttaccttgtgtaaactaccagaaataaatttaattttgtaaatgttcagttagcaatttgtatgctcgtctacgtaattccatatctcataactggaacttcatttgcattcccactgccctaatctcaaggagataccagtttcacttgtatattaagttgggtttgcttttattacaaggaggaaaaaactttcagttacgaaatttgactttgacttttctgacgctgttttcaaaaaggttacttaactagtattttagatgcatttctctacacatagtatgatatctgtaactgaatctttaattccctagttacaacagagtgaatttcttgaatccttgctacacttccgccatcctcatattatgcttttacagcaattccctagactcgtgaaggtgaaggatgaagtttataatggtattgaataccaaactgttgcttgatttattcaggaaggttgttatatgctgggatcaagtgacagcttaaaagctagtataattcatcatcatcagttaattttcacttggtgtccactgggtgctgaacatcatacaaggctctttgtcagcatatatgtgtctgatacggttgacggaattctaagaatataggatcttgtactgaaggaactctatataataatcaaggcaagtcagcaaatgcccagtattgtcaaactctgtgtataaaatgtattctattaaaaatactttatttttgtgaagggttcatgtcagtaaattgaggtcccagacgcagtatctatactgctaccagaagaaaggggtgaattggatagaccaagagcagttatctactatggtcttgtttttggctgatcagcacacacttatgtgtgtataaacatgcagatgatgtcacaatgtttctacttaatgagatccaatgatccctcacacaaacgtatatgtacttctctccctaatgagaaacaaatcaaagtaacatccagatgaagcatctagagctagtgtcatgttattccacagacctctaggtgatgtttgttcctcttctgaagtaattcagaaatctgtcctaaatcaaatttggaagtagcccttcatgatcctgcaacatgtggcttaaaacacctctggataggcagaacgtaggatagccacagtgtaaactctgaagtacagtgctggtctagggaatgcaccatttttccctggttagggctggtacagaagataatatggccagggactatcataagcatcttgttgttgagtttcttccctgaccttggtctgggttctgtcccagtggatttgttactgaaggattatctgttaagaagattccccttgtttggggaccttcatagccatctctgagaaggggttcagggaggattcccttgcaggggccttagcagttctttctttgttggcaacaaggacttggattcagattcccttagggtggaacagtcataagcatttatttgctaggctggggatgtttctagcaatacagtttctttattatttttgttgattgcttatctatcttatttttttgtaggtggcagtagaggatttcattttctggtcactggctccaaatttgtgtcaaataatgatctttgactctggtcccttgctttaccactttcgtttttgggctctgggctatccatatcgccttttgtatcaatttaatagcttcctgtcactagctgtacttctgcaagtggtgaggcttgacctgggttgctgcgccttctccaggatttactccttgtgaatgaatgatctgaatgacttaaaggcagtgagtggggaaggcacttggatgagcctggagtttcagtcttcaatagttcaatctcctccctaatatttccagcactttagtcagcatactaaactcaaacaagtaacttggctgctgaaattcagctaacatgtatatgattatcatgactttagtggtctcagatccctggctaccaaggctgttccttagtttgtacatgtgtgaattgcataaaggcaagtgggggctgaacttcagttcttcctctactcaccagcgcttgaaccacagcaagcatgactttttgaaatgtgtctctacagaggagaggacctttttgagtttacacaataagaaatttatttgcacattgctggctatggctgtatcacctgtaggtaaaaaaacagcttttaataaagctgtctactttttctagttggcttttacttcaactagttagaatgaagtgtattgttttgttgtaggaacttctgaaggccataaaaagtctaacatacaaatatatggacagttttctgcagagtaccatgaagatccagtcttagtatacacatttcaagaactgatgagctgctctttaatattaactgctgatttttcaggttaggatggagtgatctcattgttcccattcttgcctttacttagctaacttcacatttcaacaatctacttctgatacaggtgtttatattaggtcggaattcttggtttcaaacttttttatatatatccttgttttatcagagagcctgaatcacacagaggggagtaaagggatccaaaagcagggctgggtctgggacctctatcggaaaagcgttctgcatctatctaagtttgtcaatatattcattgaattgaaacctgagagtgctgtatgcttcttaatgggaggtcttcttgcatactttgtgacctgtattgcttgcttttgtgcttttatcctcaaatgaatgacaaatttggctttacatcaggctagcttttgtacatcataatttcttgttaatttctctggataataagcattagagaaaagctatacttggataaaatatagtggatttttttttcttcattggtttactatctggggatgttttagtaatacatgcagatcttaaaagaaaatgctgattattttctttaaaactcttatatttggatttacttttctatcacatcatagtttttctgaaaagtgaaagaaaatgtttgtatattaacttgaaaatgtttatttgcaaaaaggctttgggctgatttacagaaaaaaaaagttaataacacagaataaaaaaacaaaagacaaatagtaattcaggaataaatggggaaaaattatgtagaggaggataaggaaatggaaaaacaagggttagaggctgggaagctaggcctccccgtacataggaggatctgtcatttctctcatttgcatatgaagtcctaatgtgggggagggagggaatgtttagggtaaggggtgaagtaacttttgtaagaccacagaaatgggaaatactgactctagcattcaaaccccggtttgtcttgttcaaaatctacaggcttaccactatttatttttgccaatatcttgtttgaggaaagctgttagcagttacacatacattactcctgatacaaaggtgatcaactcatcccagattgccggggaccgacctggtttaaaactaaaaattcttcatcccaggaagccccaccccactctaccacccccttagacctgagtaaactgggattgttgggtcacccatctgatatcctcctagtcatgattaggatggaaatttgaggaaattttacataatggtcttcaaatggcaaagtaaggtgggatggatactttttctgcaaaactacatgatatcattattatacctcattaataattagaccctgcattgtaaagattgtcaactttctttttctctcttttttttctttctttcttgagacaggatctccgtctgtcactcaggctggagtgcagtggcctgatcatggttcactataaccttgccctcctgggctcaagccatcctcccactgtagcctcccgtgtacaggcatgtgccatcacacctggttaattttttattttttgtagaaacagagtttcactatgttgctctggctggtctcaaactcctgggctcaagtgatcctccgacctcagcctctcaaagtgctaggctctgcacctggctcagattgtctactttctaaggtccactgtagctgtggatttagtagcattctttctactactattaagagattgtttatatgttattaatagattgtttatatttttagccgatcatcatttaaacatttccttcttgtgaaatttggcatattttaagtcatttgggctaaaggcagtttatgtatcgtgtgtgtgtgtgtatatatatatatatatatgaatatatgtgtatatatgtgtatattcacagtacatagttgttaataggccttgatagaagctattaatgttttatagagtctcagcattaattctatagtttaaataggataaaagttaattccctatggaacagtaggaaatgagcattccaggtcagtgagaggctcccctccctgctgccatacagattccttttgtttggtctctggaacatctcttaagatatttcactcagctgtggtcaaaactggtttgctgccaactgcaaaaaacaaagtatagagagggcacacccgggttttaaggcccaatcctaaaagtggcagaaataattcctgctctcattcctttagagagaacgtagatacatacctgaacctaactgcaagggaaagctgagaaatgggactagccacgtactcaggacaattgggaaaattaatttggagaagaatctcttactccaggcattatttaaatctaagtactctctaaatgttcttaatgaaatgcagaaaaattattgcctctctaaacacaacttctaaagttttatcctttctttggggatgggggtagttgtacttcctgttgtcatctggagatttattttgcaatcattaaaaccgaactaatgttaaaaattctgtaagatgtgatataatcataaaacaattgcctcctttgcgagttcccagccaggtagttacagaatttgactgggatccttaaattgatcaatgttccaaaaaatgtcagaattccaaaatgtatttcagtatgttaaatatatacatcaaataaaataaagatggaaaatatgatgtcataaaagagtccagaagctcaagaggcaaataaaaaaaagattagaaggcccttgccagggaactaaagaaacagatacagaaagtgccagaagcttctagactatgtcagtattgggatatagggtccatgtagggtctccatattgaggaagatttggatcaagttgatgaaaagagttgggtattaggatgtttattttagttgattttagcctaaattcacattatatagcaataaaaatgtaagatagtttttatcatgttagttcatattgaaataacttttcatcttccttttaaagctgttgtatatatgcaaataattgcatatatatgcatattatatatatatatcttctactatctgtgtgtatatttgtcccattgtgaccatggagtagcaaagtcctgggcaccagtaaaagctttgttgccatccctgggaaaagtcatttagatttacaccaagtcattttccccctccatattctacattgatcattttgttactgacaattttacatcctgagcatttaattttgatttttttatgtgtacaacaaccatttaaactgaatagcatgagaattcttttgtaattttattaaatctgacttgtgtaaagagaccagtggctgaagatgatttgcacatgctaatagattatacactatagcaaaatgttgctttatattgctactccagcagctgtggtttcaagtatagttattactagctacaatatcaccagttttttaaaaaaattgtcaaaagaagttcatgctattgactcatttactcccatatttattattcttattgaaaatcgctagacctaattctattggtttccttcctgattgaaaacatttgaacctagaaagtgcagtatttcttaagtcatttgtaactattcatcatggatattaaaattacaatcatgctgtattgtgtcagcaatgttttttttttttaatctttacacatatgctaagccggtgaccaatgctatccaggtttgaagatgctgaatgttcttataagtggtatttgaaattttgatgtgtattgcattcattactgaatatcaagaatactttttttttgctagtattatggagtaaatttaaaatggggtcttttgtagaagcacccatcctgtttagaatgatataacagatgctgaatgttcacatatcaaacaaaatgccagctttctttagaaaagaggtgtcaaaaagtttctttgtacctttaacgcatgtgattatgtagtacaaaatgcagagtttgtaaaatttcttgaacatacaggcaaaaaaatgaataattcaaaacaactcataagttctacattctattgtccctttataacgcaggcagaagatagcagtgcactcccaatagagctgaatttgcacaagttacacctctgaaaaatgccagatggtctatggtctacttttgagagctgtcacatatgtaaagatttgaaaaaagaaagacagctgaatgagagcagtggatcattaaagggagagtgagggtccctaggcatcacttgtgttttaagaagcattgtgtcgtttccatattagcatgctttttttttttttaaagccatacacaactttgacacaataaggaaggaaatctgtttaaagccaagttgttgtggtttaatccgtcaggtgtttttgttcttcatttgaaaataaaatcatgtttcctacttggttttaactctaattttaccataagattcaagtcatacccataaataattaacaataaagttaaatttaatttctgttgagatagctaatgtatttaaggcttatccagttttgatttgacttacgtaatacacacatctggcaaaatcattcaactaataaatattttaatgttaaaaaaactagagtaaagggataatacttggttatctgatcataatccaaactatagtgaaaataattaggtgacagtgaaacaaaaataatgtactattatttatctgccaacagaaatggatatcattttaaagattgaaatgtagataaaccattaaggatgcgtgagaatatcactccagccatacctagtaatttgcaaatagtcaattttgatagcagaaaaaggtcaaatatgtcagttttagaatttggtagccaggatacaagtgtcttttaccactcttatttttatttactaaaaatatttattacatagtaattctaaatttattttgaattatgaaatatgacaagacatttttgattgacaaggagtctccccagctttggtcaatgacatttcaactcaatcaagctctcagattgcttgaattattctttccagaggaaaaagtggctttccagaggaaaaaccaaattaggtttaactgtcttttttggcatctttttaaatatgtatgcataactagctttatgttcaatagcggtcattagaatgtcattctagttgatacaagaagttacagaagcagcaaattcatctctaaatcaaaccattgcacacccgtagaaatagatctccttttacagaggctttgtagattttagttatgaaaagggcatatataactgctaaacagatgtttacttttagactattattcctctttatcactaaagaactgaaaaacggtaacaggatgttctatattagtttttataaatcagatattaatgctaatagacttggtgtgaaagtgtacatttaagtaaaaaatccatcatttttcttaaaatatgctaataaatgagtagaatattttgatatgttaagatgtttttcttcacaatacataggatgtatgaacaagaactgaagtaaacaatggcttactaaagacttactcagatgcaaactgtcttttttttttctgaaaaatgcttcaagtcttacgtagtcaccaaagataataagtcctctttagcacatttatcaaccccacgtataactgttacaaccttaaatgtaatacttttccaagtggaagagttcttcatagtcttatgtaatttacatttcataattgcttataatcgcgaacagaaaaaaagactaattaaaacagtaagttttagattttgaaattccaggaaagtatagcacagtaaaattttcacaatgattgttttttgttgttgctggtgattttgctgaaaagctgtgatatatagctttgcttaaaatgtatataatgaagataatgatgattttaatacttaatcgatgtaaacagataacttttggggggcatcaaggcttttagctgcaaatatcttggctaatttaaatagaaaataaatttattagcagcacatagatgctcccagagttatacagacaaggatcatgtccatccattcagtagggctgttctgttgaaaaccccactgctgtagcactgggccactgttttgctaggaggtgagggacaccataagttgtccctcactgctaaaatcaacaaatacctcttcactccctgtgttgagaggctccaccaccctggtgtggctaacagcttgcattgatcacttccaaatgcaagccatacttctcttctggcagaacttaggtcacatccttgtcctctagctccagagtagcctagggatgtcgtagaggaatttacctaactccatgagtgtgaccagaatgctggacaacacaacacaacaggtgaatattcacatttgttttatgattcattgtctaaaaaatcatatttgtttgtgcttatgctattaaaacagtctcctctatttacactttaaataaaaagttttgttttttatatataggcatttaatacatttggaatttacatgtactaattatattaagtatactatacccaaatattaattgtataaatattaacatttatataattaattatattttatttatatattttatatatcacataaatattatatatgtattatataataattacataatcaacataattatattagattatattgatataaccattaatatttatattaatattattatattaattggtataataaaataattatgcatattatttatattgtacccaaatatgtaggtgtgtgcatgtctaccttatattaatatatgagtcccatatttggggctcaataatttcataagcttcattggcttgtatgtctatgcctggtccaatgctgtactgctttaggtgctgtgatagaaatatctcatacatcaaatcctacaaccctctttttcttctaaaaatttccttggtctttcttgattactcttccatatacatttttggatcagcttgtcaagttccataaacaagcctgttggaaatgttatggaaatggcattaaataataaatcggagagaattaacataattaacatatttatactctctccacttatttgggttttttctatgactttcagtagtgttttgtaatttttgccataaaacctctgcccatttttttctagtttaattccaaaatacgtatagcatcttttgtttgtttgttggcttgttctttctttttttgctattgtgaagagttatttttcttgtttatttgttaattggttatactctttgcttacaggagcattgttgattttatatggttgtgtatcaatcttgctacatttttagactttcagtttttatagtcttaaacttagattatatatatactatatatttgaatgttccccagaacatccaaatctgtgcacatctcaaaaattttgttcattcctgtctagaagtcagacctattaaatttctttgtcttgtttattgcttgtactatgatctcctgcacaatattgcataagtcacgtaagggtgggcatttgacatacttctaaagtcctgacatttaattttggtagatatgttttattaaagaaattatcttgtattcctaatttttcataacttgtttatttaaaaatcaaattaaagaataaatatagaaaagattttcttctgcaggattcacaatgggattttttttaaaaacactgtatttttctttgtattgtctggctttgaataccagaacttatcatttctttccttttatttgaaaagacaattgagtagtttgttattagtagtagtattgagataacactgttgtgtctatgcacaaagagggctcagcatatagaaaataatcaacattctctgaatgagtcttaaattaccttttcagatttctaacttaaattttctttaaaaccgcccaaaacagtatttctatggtctactttttatatccttgtacaaacccacttttgatgaccccgttcccattttccattttagtaaattatactttctctatgtctatgttagtatttttctttcttttctttgttgcctcttcagtgttagtattatgggtaaaaccccaaatctctgttactgaatgtattttcattattttaaaatattaatttctttttctttaactggctgactttttcctgtttttaatttagcccaacctcagcgcttgcctcagcttcagacttcagcacaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaaggtaagtttgagatatatgtagattttatttgaccagatgtaaaataatatttcctggtaattatttgatcaagcatatataattgaagaatcttgcttatccttcagacaaacaggaattttggtaaaatgcagattaactttcccaaaggaaagcacaagatagaaaaggaagcagtggcagctgacatcctgcttttagataatcgtcttctagagtgaatagtcattactttaaatataactgctatacttctttttttaatgccacatttaaaaatataaatacaacattttgatggcatacatgagtgtgtgtgtgtatttttatccctccctgatgcaatatgttattctatagttcagagataagattacctgcttgtatttttgtcttgcaaatcggttcttaaatagacaaagctaaaatgagagaaagattaggtaattttcatgctcttgccagggaataggccaggtgatttctgttgcttgactgaccagcatcttccagccgccacgttggccagcacctgcaaccatctccactcccatcccatttcagcctcactgtggtctggtcttcacctcctcctttagagacacttggctgtgttctctgtcccctggagaactagttattacctcttcagttctatctcatcctgcccttggctgggttaaaagcaggttaaatactatgaacctgagaaagttctttattaatcaaattgcacatggtgacaattaaaacagactccctttacatgattcattgtattatatttcaaaaataaaaatctcccatatttaaggatccaaatttctttccatgtatccatggttctctggttttcctcctttccccttttagcagttattggatgtctaaagtcttgaatctgttatatgtatctgatatacatatatttctccttattcccctttcctttctattttgctatgaaatcttaagtaagagaaattttgtggaatgcctctgtgaagttggtcatgcttattcatagagacaaattgagttgtaaataggaaattgtattgagaattaccagtaatgagtgggagaaaggatattgcattttggctacaggtgtctcaaactcaactgagataaagtgttaggttgatcaaatgatatgataataaatggtctgcatagttccaggtcagtgacactactttccaaactaattagattgaaagggacttgattgacactttaaaatgagtttgacatgtaagctgcatggtcatctctgaagcataggtaggctgttaactaaactggctctccaaggagttgggaaagcaatgcaattttctttagaggatcttcgcttctaggtgatcgggtgaaataattgaatgcaattgaaatgtacttgttttatacatttgaattcacttattacgtccctaacctcttattttccatttgatatttacttatttttgtattaaagaatggtaacattcgcatatcagtcctaacttgaaatagcttatggaatgtttataaatttttttattattgcttgcctttaataccatgtctgaatttatttgtaatgtaggaatgcagcttcataagtaacatacgaaggaggaagaaaatcaccggtatatgaatgagatacagttttactcttcctctttctctcccttctcctttattctcccccttccctccctcttttactttttctttctcttctctcatgctcacattcacacttatggcctaccacagagctctggataagggaagtcccttgtaatctgtgtaatctgcttttatcacaaaatatgttccagattgggttggagacatgaggagcataaaatacaaatttaaatgtataaacacattttgcaaagtcttatccatatcttcattgtaagactatagaatttagacaattgtaggtttgttttattgtgattgcttgaatctagattaaaatttgattgtccatatttttctcaaagttcgatatcttcatgatttgttagtatttaaggttgtgccctaaaattttgtgtttcttctgactttcagttttgaagttatgtttattctctggcaatgtactgtaataaaaaccaaaaccaaaacaaaacaaaaaatccgttgaactggtagatggcaaattaaaaggaaaaacattctcaattctgccaccagcttgctggggtacttgagtttctatgggcctgctttttctgtggaatgaagggtttggattagataattttaaaaattaagttcggttccaagattctgtgagtctctttttacagcacctgcttgactctcaggatagatctcttgctctatagaatatgtgatctcttgttgaggaaacacctaaaacctgatgtgcagaatggggcaggggcagaaacagttgtggtgaacagaaatagcacctgaatttcaggaggcccatatgtcagaacagtaggccttgaataggcagcatgatttattgtgcaaataaaaatggatggaaatgatttttttataaagcaataagaatggggagatttagtggctaggtgtcttagtctatttgtgctgctataacaaaatacctgagactaaagtttggtcaggttggctcatatctataatcccagcagtttgagagggccactggggaggatcgcttgagaccaggagttcaagaccagcctgggctgcatagcaagatctcatctctacaaaaaagaaaaaaaaaaatctacctgggcacagtggcatgcacctgtagtcttaactactcaggaggctgaggtgggaggaccatctgagcccaggagtttgaggttacagtgagctatgattgtgccactatattccagcctgggtgacagagtgagaccctgtctctaaaataaataaataaataaaacacctgagactgggtatttgataaagatcagaagtttattttctctcagttctggaggctgggaagagcaagatcaaggtgctggcaggttaggttgtctggagatgaccattttctgcttctaagatgatgccttgttgctgcatccttggaaagggaggagcgtgtgttctcacatggcggaaagcagaagcgcaagagatcaaaaactgcatgaagcctcttttgtaatggccttaatctcattaattagggagaagccctcatggccaaatcacctcttgaaggacttacctcttaatatcatcacattgtccatgacatttcaacatctgagttttgtagaggtgacattcaaaccatagtacaaggcttttctcagttttatgactgttctgcttcacatttttgttaaatcatcatcttctatgcctgttcttccaaaggcaaatgagcaaacaagtagcaaaataatcttaactaaaattctcaaagcagctaatcatgcccactttgacaatgtgttgtatgtctgggtacatggtgcttgtggttgtgatttttgtaccacatataaattttatcaacaactggaataacattttttttggttcagataatggaataaaatatttacaaattttctagtgtttgattaagaactctaagggcgtcttttctaaccaggatagcaaaaacactgctaagacatgatccattgcttatacagaggtagggtttgaaccagccataattgagtctgtgggttggcaagatgttttaacatgtctttagctgtgagtgtctgaagaactgagaacaaagaagcctgcacttcatcaggtacttttttttttttttttttttttttgaggtcgtgtctcactctgttgcccaggctggagtgcgatggtgcgatctcggctcaatgcaacctctgccacccgaattcaagcgattcgcctgcctcagcctcctgagtagctggaattacaggcgcccaccaccacgcctggctaattttttttgtatttttagtagagatggggtttcaccacgttggccaggctggtcttgaactcctgacctcaggtgatccgcccacctcggcatccccatcaggtactttttaagcgatgttgattcatataattagagtgccttctatgtgctacttgcttctctcacatgaactcatttagtcctcccaacaacgctgcaattctatgaattatatgaaattatctaattataaatgaggaaaccgagacacagagaagttaaaggaagcaaccaaaggcaacaggtgcatggtaaaattgagactcaaactcagacattctggttccacaatccatgttcctaacctctgtgctattttgtgtgactaaagttttctgaaaaaaaggtaatttatcagacatttcaacatgatataggatgttaatggtgttacagctgtgggccaagcagggatcttcttcttagtatacatttgcctcttaaagcccttcttaccacagttttaaaaacaactctcacacctgtgctctctgttttccttttcctactagactgtgaattcctgaaaaggctggactgaatctaagtcaattttttttttattgtacagtggtgcccaacataaaaaagtttctcatgagttaacacgtgatacaatgctctattccaaatcattttatcctacccttccttgaaaccagccctggaaaataaaatgtgtgctcatattcaccaaaaaaaatgttcttttaaaaagttccatttttgcaatggaggaaaaaaaaaccatgtggcaaaaaaattgcacattttatttaaaggttattaaatttgtagatttctacttgttttgtataattaaatattttcatacatactttaattttctgattgcatcacccaggtggagagttttaagactaaatgtttaagattcttgacctttgaaataattatagtataatttagtatcatataatgttcaaattgccaagggttttcattagactcaaagacacttttcttataggaatggtaaatcttagtatgttttacatgtgccagttacatctatatatttttgtaaaaattaagttctaacaaaatgcttttaaagaaattttatactttttaggaatttttgcattaatttacaccccatacttgatattctgcatttagtatgcatagagaaatacatatccagtcctagtatatcattgaacataaatgctgaacaagacagtgaagagcgttatgtagatggaagtaactacaatcatctcatttttatttttaatcacatagaagcagtgtggtatagtaattagagcacagactctgaaactagcctggttgggatcaaatattggctttgctactcaccagtgatgtgtctttgggcaggttacttagcctctttttgcatcagcgtctcatctctaaaatggtgatattattagtacctacttcataggattgttatgaagaagacttgaattggtactgcttagtgcttagaatacagactggctcagatgaagtgttcgatatgtgttagctgctgttatgatcattagtattaaggttcatagaggggtcaggaatgttagcttcttggaaaagtcaatgcctggatggggacctgaaagacaagacaaagatagtttagggagttgagaatagagggaggcattcaaggccaaaggattttgtttttcttttttcttttctctctctctctctgtgtgtgtgtgctcttctttttgtttgtttgataagtaaggtttgttagataagtaaacatgtgtcatgggggtttgttgtacagattatttcatcccccaggtattaagcctagtgcctactggttatttttttctgatcctctcccatctctcaccacctccctctctgaaagttcccagtgtgtgttgctcccctctatgtaaattcatgaattcatatgttttattcagagaactacaaacagtttgctgttgttgaaaagctaaattattagagaagatactagatgagtaggaatgaaccagtctacggagcctgggatggcccgttcttctgaagctattaatatcacacaggtctatatgatttatctaaaggacatcatatcccatatatactttttttgaaaaattgtgttttcttttctctctgtaatacaaaaattccatggttggaattatatagaatcagggtgctttctcacctgtagccaatactgctatgtattaacctgccctaccatctgcaccgtgattacctttgcagttttttttttttttgtacattaataatgaacggttatcgaaaaggaaatgatgaattggttttagccatgttgagcttgggatgctaatgagctctacaggagacatttggacctatgggaggactgaaacccagtttatattgtacaggctttttctgctttctttttttaaaactattttttggtttctgaggtctatgacctttctttgttttctttttaggcttcgcttctttgtctttttggtgattttctcttgcatttataactgaggagtttttcagaatataccagagggataatgcatactccccaccagtaggagtacagccaagattctccaggagacagtctgggtagggcacacagctttaaaaagggattaagcagaattgggcagggcaattagaaaagcccataaagtgatttcccctccttccttgtgaatcactggtaaaatggtaaaaatatctttccttgaccttactatttccccttcctttcaccatctgcaaactccaggtctaactccttgcacctggaattttgcctccactgtaatgcatagacatgtctgtacacatggtcaggtgaaacactgctgaatgcctttgtttctcctctcccctcagcctggtatgttctcataactctctttgcattcttaatctctacacattttttcagaactcatcttagtcatcatctcctgatgccccattttgggcgaattgccccttttttgggtctcccacagcaggcttggttgatctattaatctattaatctattgatctgttaatctacctttctgtattaaaatgtaatctcactgaaagcagagtctgtcttactcatcttttaatgtttagcctacagcctagtgcctggcttatacaagttcagaaaaaagtgagttaggagtgtcaactggagaactagacttgttctttattactccatagacattgtggttgaaagggcaggaatggctgaaattcttaagggagagaatgtgaaggaataaaaggaagggcaaatatttgagctaaaagaaatgcaaaaagagacccagcagagggaggacagttactcagagatcctacttcccagccccatcaagttttctcactattccgtatgggtttcaaacaactacatattcttgaatcctgaaggtgggaaaagaaattagaaaggtaaaattgaaattgagttgtttgctgttacaatactgtttcaacagtattgtaaaatcttacattaattttttcccataaaaagcttttccgttttgcctataattgtagaagtactacagtagtattttagtggaaagataataataggagctcatgatatgaccataaagttataatcagagcttccagaaacaaattttctgtgactttggaaagatatgtcactgcattcctcaaaatacttaatttgcttggatgatgttttgttttgttatgttctgttttctcaggcgcagtgccttccatcccatgttacaataatggtgtgggcgaaaggtttagaattctgctttccaatgcaatatttgctagttctttggaaaataggacttcaagaaatgtcactgctcagccaacacattaaattgaaaaatagtaatacaatgaggagtgtgtgtatggagagtaggcatgatcagagttgactatatcaaagtataaatcattctgcacatataaatcattaatttttgtttacttgaaatatttaaattagctgtctttttttaaaaaataaagcaattatccatcagaagtatttataaatagtaagtgtttctgtagggccaaaagtaaacatttaagtgccttatcttaaagtttaggaaaataagttaactaggtagtttgttatcatacctatgtatttggtgaggagcaaagaaactattttacaaggttctgaaaaatatgtaacttaatattgaaacatagagataactcaaaatatgcctcaagcctcagagctcttcttttgtaataaccaataatttataggccatcttaaagaagaaatagaagctatcagctatgtatggacttcaccgttgtttttttgtgtttgtagacaagctatcttaggtcactgctttagcaaattaaattagctcagcattcactcaggagatgggtggggaggaaataaaacaatggagatacagatagattggccaggaagctttagggtgtggggtagttggatgcagaggctatttagaaaccaggcttcagaataatggaaagaattgaataaatcctatgactctactaatgcaccaaagttttgttttgttttgttttttagtacagtgatgaaatgttaggtgatttttttaggtcaaacataatatgtaggcacagcagccaggctggagatgaaagtttgttcgtgagggattcaacctcaagagctctgtcaagtgcaggtaatagaggaattgaagatttactttagagtttcaggattaaatgaggtccagagctaaatctgggtagatttggaagagcagtcagatatgtattattctgagcaggactgtcattaacattttagttcaattaatttggaaattgagtagaaattaggaaattaggaggaatagctgaatgtagtttggagatgatcatgagttgagttttagatctgttcagttttgtatgattatacgtaattcaagaggagaattccaaaatgcatttggaaatatacaaatggagctggagagaaggagttagaggcaaatatacttattcatatttgttctcatagaggagacacttcactataaatctggatgagattttaaagtagagatttcagagaaaaggtcagatggctgagaactgagtgactcagcgatcactggaggccagccagtttggtgggatgggagtgtgggttcagcttgtgtgcttgggagacaatcccaaggaaagttcagatttttctccagaggtaatatcagatagacagtaagtcagagtaaggccatactgataaaatagcctagaggagaggtcacagtgcaaagaaaagaggacgattatctggctgagaggaaacaagaaatgtgagggggagacagactggagataatgatatcatgaggcagggaaagaatgttttaaaaagaggaagagaactatatcaaggtgcaccagatattgatgacaggttcagtaaaatgagcactgaaatatttctgttggttgtgacaacatggacatcatttagtgaccttattaagagttgttttcatggagaagccacagtgatgtgggttgtagaatgtgtaaacagttctagaaaggccaaaattcagggcagaagtgcaagtccagaagggttgttttcttggtgtgtattattttgttttaagataggaacaatttcagtatgtttacattcagctggaaaagatccaggagagaaggaacatttgaagatatgagaaggcaataatgataccttcttgacaaaccagcatatagtgtatttagactttagatctatagtttaatacactgaactaaatgaatgcattgacattgtcaaagcaagagaattgagcaaccagagaagtatttaccgaattgttaacctcgatggctctgctctgtaagggttatgtggttgactaattttagaagacttctcagtaacctctattgaatgatttggtacaaggacacgtaacctttggtgactaaaaagcctttctcaaatccctactcctacgtcattccatgagcatttattgagtttgaatggaggggattgatagggccttaggattctgagttccaagtctctgacttgtgttttggatcacaaattgattaaaatcgatagcatcttatattttatgttcataaggcccttaattgaatttaatcatagcttttacacatagtatagtataagaagtaaaaacaaacatagctaagcaaacagctaaagagaagaaaatataagtaaagaaaccactgcataatgcagacaaatgggaaacagtaggttaattttaaaatatatttaaagtaaatttatgctttagtatgctctactcatcattgaattactatcacaaaggcttgaaaaggttaaagcttaatctataataaaaaggagttttgattaattgtgataatcttttacacagtgattctgatcatttttgatcacatgggcttctttgagaatctgacaagagttatttccacccgcaaagttttaaaaacagacaacaagatcctgttagcactgtgttattcttttttttttttctttatactttaagttctaggatacatgtgcacaacgtgcaggtttgttacatatgtctacatgtgccatgttggtgtgctgcacccattaactcatcatttacattaggtatatctcctaatgctatccctcccctctgcctgccccacgacaggccccagtgtgtgatgtttcccttcctgtgtccaagtgttctcattgttcaattcccacctatgagtgagaacatgcagtgtttggttttttgtccttgaaatagtttgctgaaaatgatggtttccagattcatccatgtccctacaaaggacatgaactcatccttttttatggctgcatagtattccatggtgtatatgtgccacattttcttaatctagtctgtcactgatgggcattgggttggttccaagtctttgctattgtgaatagtgccccaataaacatacatgtgcatgtgtctttatagcagcatgatttataatcctttgggtatatacccagtaatgggatggctgggtcaaatggtatttctagtactagatccttgaggaatcgccacactgttttccacaatggttgaactagtttacagtcccaccaacagtgtaaaagtgttcctatttctccacatcctctctagcacctgttgtttcctgactttttaatgatcaccattctaactggtgtgagatggtatctcattgtggttttgatttgcatttctctgatggccagtgatgatgagcattttttcatgtgtctgttggctgcataaatgtcttgttttgagaagtgtctgttcatctccttcgcccactttgtgatggggttgtttgtttttttcttgtaaatttgtttgggttctttgtagattctggatattagtcctttgtcagatgagtagattgcaaaaattttctccaattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtatttcctaggttttcttctagggtttttatggttttaggtctgacatttgagtctttgatccatcttgagttaatttttgtataaggtgtaaggaaggaatctagtttcagctttctacatgtggctagccagttttcccagcaccatgtattaaatagggaatcctttccccatttcttgtttttgtcaggtttgtcaaagatcacatggttgtagatgtgtggtattatttctgagggctctgttctgttccattggtctatatctctgttttggtaccagtaccatgctgttttggttactgtagccttgtagtatagtttgaactcaggtaacgtgatgcctccagctttgttcttttggcttaggattgtattggcaatgtgggctcttttttggttccatatgaactttaaagtagttttttccaattctgtgaagaaagtcattggtagcttgatggggatggcattgaatctataagttaccttaggcagtatggccattttcacaatattgattcttcctgtgcatgagcatgaaatgttcttccatttgtttgtgtcctcttttatttcgttgagcagtggtttgtagttctccttgaagaagtccttcacatcccttgtaagttggattcctaggtattttcttctctttgaagcaattgtgaatgggagttcactcatgatttggctctctgtttgtctattattggtgtataagaatgcttgtgatttttgcacattgatttttatcctgagactttgctgaagttgcttatcagcttaaggagattttgggctgagacgatggggttttctaaatatacaattacgtcatctgcaaacagggacaatttgacttcctcttttcctagttgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaatagctcttattattttgagatatgtcccagcaataccgaatttattgagagtttttagtatgaagggctgtttaatttttcaaaggccttttctgcatcttttgagataatcatgtggtttttgtctttggttctgtttatatgctggattatgtttattgatttgtgtatgttgaaccagccttgcatcccagggatgaagcccacttgatcatggtggataagctttttgatgtgcttctggattcggtttgccagtattttactgaggatttttgcataaatgttcatcagggatattggtctaaaattctcttttttcgttgtatctctgccaggctttggtatcaggataatgctggcctcataaaatgagttagggaggattccctctttttctattgattggaatagtttcagaaggaatggcagcagctcctccttgtgcctctagtagagggtagagctgtgaatccgtctggtcctggactttttttggctggtaggctattaattattgcctcaatttcagagcctgttattggtctattcagggattcaacttcttcctggtttagtgttgggagtgtgtatgtatccaggaatttatccatttcttctagattttctagtttatttgtgtagaggtgtttatagtattctctgatggtagtttgtatttctgtgggatcagtggtgatatcccctttatcattttttattgtgtctatttgattcttctctcttttcttctttattagtcttggtagcggtctatcaattttgttgatcttttcaaaaaaccagctcctggattcattgattttttgaagagttttttgtgtctctatctccttcagttctgatctgatcttagttatttcttgccttctgctggcttttaaatgtgtttgctcttgcttctctagttcttttaattgtgatgttagggtgtcaatttaaatctttcctgctttctcttgtgggcatttagtgttataaatttccctttacacactgctttaaacgtgtcccagagattctggtatgttgtgtctttgttctcattggtttcaaagaacatctttctgccttcatttaacaaaatgtacccagtagtcattcaggagcaggttgttcagtttccatgtagttgagtggttttgagtgagtttcttaatcctgagttctagtttgattgcgctgtggtctgagagacagtttgttataatttctgttcttttatatttgctgaggagtgctttacttccaactatgtggtcagttttggaataagtgcgatatggtgctgagaagaatgtatattctgttgatttggggtggagagttctgtagatgtctattaggtctgtttggtgcagagctgagttcagttcctgggtatccttgttaactttctgtctcgttgatctgtctaatgttgacagtggggtgttaaggtctcccattattattgtgtgggagtctaagtctctttgtaggtctctaaggagttgctttatgaatctgggtgctcctgtattgggtgcatatatatttaggatagttagctcttcttgttgaattgatccctttaccattatataatggccttctttgtctcttttggtctttgttggtttaaagtctgttttatcagagattaggtgtgcaacccctgcctttttttgttttctatttgcttggtagatcttcctccatccctttattttgagcctatgtgtgtctctgcatgtgagatggggctcctgaatacaacacactgttgggtcttgactctttatccaatttgccagtccgtgtcttttaattggagcatttagcccatttacatttaaggttaatattgttatgtgtgaatttgatcctgtcattatgacattagctggttattttgctccttagttgatgcagtttcttcctaccatcaatggtctttacaatttggcatgtttttgcagtggctggtaccagttgttcctttccatgtttagtgcttccttcaggagctcttttagggcaggcctggtggtgacaaaatctctcagcatttgcttatctgtaaagtattttatttctccttcacttatgaagcttaatttggctgtatatgaaattctgggttgaaaattcttttctttaagaatgttgaacattgccccccactctcttctggcttgtaaagtttctgcggagagatcagctgttagtctgatgggcttccctttgtgggtaaccagacctttctctctggctgcccttaacattttttccttcatttccactgtggtgaatctgacaattatgtcttggagttgctcttcttgaggagtatctttgtggcattctctgtatttcctgaatttgaacgttggcctgccttgctaggttggggatgttctcctggataatatcctgcagagtgttttccagcttggttccattctccctgtcactttcaggtacaccaatcagacgtagatttggtcttttcacatagccccatatttcttggagactttgttcgtttcttttactctattttctctaaacttctcttctcacttcatttcattcatttgatcttcagtcactgataccctttcttccagttgatcgaatcggctactgaagcttgtgcattcatcatgtagttcttgtgccacagtattcagctccatcaggtcatttaaggacttctctatgctggttattctagttagccatttgtctaatcttttttcaaggtttttatcttctttgtgatgggttcgaacttccccctttagcttggagaagtttggtcgtctgaagccttcttctctcaactcgtcaaagtcattctccatccagctttgttccattgctggcgaggagctgtgttcctttggagggggataggcactctgatttttagaattttgtttttctgctctgttttccccccatctttgtggttttatctacctttggtctttgatgatggtaatgtgcagatggggttttggtgtggatgtcctttctttttggtagttttccttctaacagtcaggaccctcagctgcaggtctgttggagtttgctggaggtccactccagaccctgtttgcctgggtatcagcagtggaggctgcagaacagcaaatattgctgaacagcaaatgttgctgcctgatcgttcctctggaagcttcatctcagaggggtactcagccgtgtgaggtgtcagtctgcccctactggggggtgcctcccagttaggctacttggggatcagggacccacttgaggaggcagtctgtccgttctcagatctcaaactctgtgctgggagaaccactacttcaaagctcagttggaaatgcagaaatcacctgtcttctgcgtcactcatgctgggagctgaagactgcagctgttcctattcggccatcttggaaccacccagcattgtgttattcttgaaggtaactgaagagattggataacttcagttctaaaatcaaacatctctaagaactgaccagataattaggtgcctactgagccattgtaatgtttttgattttgaggtaggaaaactgcatcaggctatggcagatggctgacatgatctgacttactatttttaaacatcactttgccttttgtgctgatagtggactacaggtacacaaggtcccaaaaagcgagacctgccatgacaccattgctgtgattcacatgggaggtaataggattggatcggggtgacagtgatggaggtgatgagatgttgttgcatttgggtttatttttaaggcagaacaagatttgctgaagaatgagattttggtgtgaaagacagggattaaggatgactccaagtttctgggcctgagcagttgaaagtaaggaatggccattaactgagatgagaagactataggaagaatggggtttggttcatggaggaaggtcatgtttggtttggaatatattgaatttgagatacccattatctgtacaagtggtgatgtggaggaagtgtttggataagggagttgggagttcaaaggaaaggtctgcagcttgagatatgttttgtgagttttcaaggtgcagaatgtatagtggatgaggtcactggcaactggggttctcaaccctggcctctggatatttggagaaagatctttagggcaaagggattaggaaataaaatacaaatcagcgattatgattcatttggaatggagtgggtccaaggtatcagcatcctttagaagctccctatatgattctaatttgaatgcaggattaagaactcttgcccagaacatagataaagtgcaaaagtactccaaaaactaagccctgggccattatgccactgtagaaaatgaagagaaactatcaaaaaagtgaggaagagtagctagtaatggagaagggataaagaggggcagcttggaaaccaaatgaaggaagtattttaaaacagagggagtgatcatgtgtcaaaagcaactgagaaatccagtaagatgaatgagaagtgaccattgaaattgtcacgtagaagtcactggtgaccttcacccttttagtgttgtgatcgggctagagtgtgattgagatggattccagagaaaatgagaaaagaaaaattgcaaattgcaaatctggattactctaccaaggagttttccgaaaggagaataagtaaaaatgttaggatataaaggcgaatgtttttagaatggggtacatggttgagtgctattggtaatgaactagtagaggagacactgatgatgcaggagcatgatgtttttgagaaggtgagaggggaggagattcattacaaagtaccctgtggtgttgtaggggagtgtatgtgcatgcgtgcatgtgtgtgtgtgtgtgtgcgcgcgtgtgttttatctctctcagattttaaagaaagggtcacctggggcagtggctcacatctgtaatcctggcactttgggaggccaaggcgggagaatggcttgaggttaggaatttgagaccagtctggacctcatctctacaggaaaaaaaaaaaaaaaaattaaccaggcgtggtgctgcgtgcctgtggtcctagctactttacttaggaggctgagacaggagcatcacttgaatccaggagcctgaggctgtggtgagctatggttgtgccactgcactccaggctgggcaacagagtgcatgaccctgcatctaaacagaaaaaaaaaaagaaaagaaaagaaaagaaagaaaaagaaagaaagagaaagaaagaaagaaaagaaaagaaaagagaaagagaaaagaaagggcccatgcctgcagagcactattttttacagtgacttctttagttctgtgtcttacacatatgaggcactttcagtttgttcaaatggagctctttcaaataaccggtaggatatggcatagtagatttacaagttttggagactttctacctaagaaaatattttatcatttgggacgatgaaaaatacactaaaagtttccattgattttagaagcatttcaaaaaattatttcttagttacaataatagcactagacactgcataatactacaattcagaggaggaagttttggggaaaaatacagattgtgcaggatgtttgaattttatgacaaaaactgtctgatgactcatgagtgtcttgtagtttataaagggtatacatagcgaaaaatagtatcaaagtgttattcattgaatatagctttcaacttcagttatttgagataaccacctatagtaaaaccttatctcagatgctcatgttaaataaaaatattttctttatattttgcattagtctaaactttactttagctaaaatattttacctttttgaaaaatgagttgcattgttgagggtggaagagtgagtatatttaaatcagctggactaaagaaacatactgatgtgtaatacatgccttaattcatgtccaaatgccacatgatttaccttttggaaatctagagaatggagagcattctaaattttaagcttagatggattatatttatattctttgtcattaactgaaagtacttcttataatactatattttatattttttattattgcctttggtggctttataaattacctgttttccccccaatgttttgttgctatattctttccatttctttttgtgtgcttccatctctgtatatacttaaaagatctgttgtttgcctggctgaattgacaccaaaatgtttaagaacagagtatgttaatattgggggaaaattaatttcggacattaagtttttaaaaaagaagatttcaaaggaataggaacaaaagggtaccacttatgtcgaggggtgtgactgttttatgctctagtaggaggagcatctatctttgcagatcaagcctgccacctccagagttttggttatctcattttggttgttactccaaagtacaccttccatatctctgtctgactgtctctgttccccatgtctctttctcatctctccttcctctcttctctcatttctctatttcatactttctctccctcccctccccttacctgtttcatttgcaaattttacatgatttcatttaattattgactaccatttatagaaacccaatggcagtgattaatgacactttccacaataatagtgtaatactttttcagatacttttattcttagcttatatgtttgtgagttatgggtacatagcttaaaagaaatagctccaaaaatctccatcaaacacccggaacttttcaacaatgattttttttttctagattgaattagattctcatggtatttgaattgattattattcttccaaaatacatacttgtttagctatttgctgtttttttttaaaattacattccaagatgacccaccctgactcccaaaactaactgaagcaacatagaaatactaatttctcttagaaatgcttttattttttaaattacttacatatagtgttaaactattgtggttttgagaatattttataattaatatatataattctcaactagtattttgtaaaatagtatggaaggaacctcatagtttaaagttgacatatttcttaaaaactcttgtaaggggaatttttttaaatatagatggtttaagttgaatataccaggaaggtattaggaagattcacttatgaacctccagctcaggggtccttagcattgggggagggtcacaatgtaagtctgagaaaagataaccaaattaatttcactaatttctaaactttaaattaaatttgttatttctctcaattatacatataggcaataaacttcagtggcattagtagtacctgtgtctttgttgatgacattttcatatattaaagttgttgcagaaatcataaagtattatatatactaatcactacttttaaaatagtatttatcagatcaccactagaacttgttattaatgtctttaaaaagaagcacatatttattctacctcaactttaatattatcaactatagtcatagggccacataacatttaattcaactatgaacgacatatagaacggtggtcccataaaataagaacactgtatttttactgtaccttttctatgtttacatatacaaatacttaccattgtgttgcaggtacctacagtactcagtacagtaacatgctgaaccactttgtagcctaagagtgataggccataccatatagcctaagtatgtcattgactataccatccagatttgtgtaagtgcactctctgatgttcatacgaggaaatcacctaatgaccccttcctcagaatgtgtccctgtatttaaacataattggtttccttcaaaatcctgggtattctatgttatggatttaaaaatactttatctccatggcacaccacagaaaactaaaaatgcctgctcttgtccctcggaatccaaggcattctttatagtaaaagtaatttattttgtaacatacatgttttataaatttgcatttctgtatgtaattttcataatgcagagaacacagattttttttgaacagcttctttttgcttacattaaattgaaatgataaaaaaggacatattcaatttctcaccttaaaaaactatgttaaatattaaattcctaagtaacttgttttcatgtttgcattttaatgtcatgcttttaccagtgcatagtcagcaacgccaggatgcagaagaatggagaaaatgaacttcttgggttttatatgccacaatttagatagtcttaatttaaatttccataaataagtgcaggagaaaacagaggaagtgcttcgaagtcaacaacctggtgacacatattttttagggttttcaggcaaatcttcccatgggattttaattgatatgcaacatagtgtggcctcaggcccccttccaagcacaggactctggtaatttgtacaagctttccttcctcctctatacttgactgaagggaaaaatggaagatggtagacatcctctcaagtggatgtaggaggtaattagaataataaaattgaataattattaagtagtttgctcaaggatattaatcattctgcccattttgaaggagaaaaaatattcctacaaataaatagtagttgtctcttagaagactgagaaatccaggagtttgggggaaatgtgactataattgaaagaaaagagcaaaatggattaatatactagttttccaaagaaatattaaacctgcctaaatttccactataacttctcttgggaaatcaaactggaggaactggacctcttgggaatactatcaccataacataacataatttgaagttgacactagaagttgaagtttatttttttcctaataattatgctcagggaaggatgcagaaattgcattttggaatgacagaagagtagttattttagaaggaacattttaacatctatggtagatatctcctagaaaatgtgttctgtggagtgacaggagaagctaaaaccaaaagccatcattaccttaggacataaaactgaattgcatggagtcaacaggtgtttattaagggtctgctgtatgcccaggccagtgtgctggagtttgtagagaagtcctgttttattttttaatcaagtgcctttgattttttgttcctgttgcttttaaaaattacacccttagttagaaataagtatgcacctactggctcttgaactctaattaaccatgaaaaaaatatatatgtatgtgtataaatatgtttaaaactggcctcctggcccggcacactgacttacaactgtaatcccagcactttgggaggccaatggggacagatcacctgaggtcgggagtttgagccgagcctggccaacatggctaaaccctgtctgtactaaaaatacaaaaattagccaggtgtggtggtacatgcctgtaatcctagctacttgggagactgaggcaggagacttgcttgagcccaggaggcagaggttgccgtgtgccgagattgtgccactgcactccagtctggatgacagagcaagcctctgtctcaaaaaacaaaaaacaaacaaacaaacaaacaaaaagaaactggcttcccgttatccagaattggatttcctgatgaaacattgaacttacttgtgactctgtcattctggcatactatcctttcagaaccaaaaatctggattctctgtcttttcaactcccctgtctatactagggagctaaacactcctgaagaaaccttgatgaccataaaaatcactgtcactatgcatgtgtggtctcaggtctcaaccagagcctcagaatccctccacagaacttcaatatgtcccaaattcctgcaacaaatcattcttgagcacttactctgtggcagataagtgccacactcttctaggtacagtttggggacacagcagtgaactacaaagacaagcagacctgccctcttccattttccacagtggccatctcattttggtgctgttctttttaaagaagcacttggcaactctccctccccctcaggggaagaagaggccatccagcttttcctcagggtctctccaccctgggccctacctacaaacttacctgattctgagcctgtttttaccttccattcaaaggaggagatacagctcttcctgttgcagcacacaccccatcactgcccatcttttcatacactcactccattgagtagccctttctgcattcggtttgaagtttcttctggagaacagtgaacatatgtcagtctttcctgtctaaaaatatatgtgtagtgagtgtgtgtaggtgggagtgtatctcttcatggactttgcatcctcagttttctccttctgtttacaaatagatgtcttggaaagatagctatgtgcggtccctgttccctcacttttcagtcactcctcacgtcactgctattcatttctagccctaacacatcgctaaaatttctctggccaaacagagtatctgacacaacctccttgaaatattgttctctctcacttccatgggatctccctttcctagagtttctacttccatgtttactcctctgtctcctctgccagctcctcccttccttaaatgcttttgttaccttgaatcccttgtcactgagtacattcttcctgggtggttgaataagcccattcactatgacagtttcagccacctttcaccccccagccccagactaactaccacgcaaactccagatcatggtctgcagctgccttttgaacattttcatttgagtatccccagacttagcaaggctcacactcaacatattttaaaccaaactgtttttcctcctggatttcttccttagtaaatggcttcagaaaccagggagtcacgcttgattcttctcatcactgcttcatcccaggtcttatcaactcatgctaatcctactttcttgatatttcctcaaagtcatcctgtctgaccccactggcactatattatcactgcatgtcgttcctgcttcctcatttctgacacggaaaattgaagatgttttacctggtttctttagatccaacaaaaatatggagccactggcatctctaaaactgtctgcttgcctctgtgtctttgcataacttccccactggctggaacaatctttgcttttatttcatctaacatatgcttcttctttaagacataactcaggaatcacccttactttctccttctaccctatgttctctcctcttccctttcagagctccatcttacaaatctgaattggatattggatattccatccatttgtgcctccgtttttcatctgtaaaatgaggttaataatagcatttatctcataaaattattctaagagtttagtgagtaaatatttataaactacttacagcagtgcctggactttagtaagcactatataaaaggttgctaaataaaaatttaaaaaatacaataaaatatggaaacactatatatactggtgatgagaacagcctttggaatcacatagatctaaatttgaatcccagacctccccttagtagctttgcacctcaagccactatataaagattttgaacctcaggttcctcatctataaaatgagccaaatgttcaccttatgagattgtctgtcatgcagaggtaatgcctgcgaggcacttactatgtaacactccttgctcattatttactccagttgggcgtggtgactcatgcctatactcctagtagctcatgcctgtaatcccagcacttagcctggcagaggcgaaaggatagtctgaacccaaggagttgaagacctgcctgggcaatatagtgagaagctgttctccacaaagagaaaagaaaaaaaggacaaaaaacgaaacaattgaactcattacttactctaccagcacgatgtgtttgtccaaatcacaacagttatggcactgtattgtaactatatttttatttacctacattttacattccttgatctttgtctctgaagtttggacagaatctgacatgtagtcaaatgctcaatgaagacttgttgaatgaacatttaaccatgaaggcattgtctccaggctcctatgctggttaggaatgaagactgtatttattccattttttttttccacttcctatgcactcactgctctcagagagtcttttgtggctaattccatgtgcctctaatgtctttaatggaccagagtacacagtttacactttgaccattggccattatttatatgaagcctactttccaggcccacattcagcatctacgacaaggcaggcaaggccctgtctttgtggggtttctgtacagtatggctatttgctcctggggcttagccaacttacagtcaacttatattccgcattaattaactttccattctgttttgaatattgcattaaacccagtaatggtcctgttcaaggccaagaaaataccctgtgctagatttaactatctattagttatagaaaatagattatatcttcctagaactttggagcttgaaacaaacttagcattttccctttccttgtatgtgtatcgacaccaaatgaaatgacctgttcaagatattcactcaggcaattagtgacagagccaagaccagaaagctggttttaagtttccagcatcacaatccttatacatacactaatacttggctgtctttgccacttatgaagatggaagggtgatcattaattgaaatacctttgtttttgtgcccccactatgttgtgtccctgttgctaatagccttatttaaaccaaacaaacagctgtaacaaccacagacacttacaaccctttctttttgtagttctggcattagcttgcccaaatggtaataggaggtaatgagctgtgacagtaataactcagttggggagtggctcagacgaaacacagggaattgggaagcacctcaggaagacggttttaattttaccttattttccccaatttaaagtaataatacactaggctacaaaatttttattgcataagaaaactaggtttatctgttttcagcaattttagagtatacttgcaaacaacatgttcatagatcgtttttagctctggaattgtttgtacactaaattaaggcggaggtatttataccttataatttcaatgtcatgctgtcctgttcatctgtggcttgcaatagtgccttaaaataatcaaatggtattaatagataacctgggtggagagggaggaatgtggaaagagtaacaatgtcatcattgattcacaaattaattccataaataataggatttacctcctgtgcactgctttgaaacgtgctttggtgtctcatttcgctgtaacatttcactctgcttgcttcgcttcatcttgcctggcctgttagaccgctgtgcttctttggttggggcctgtctcttctgtcagggctggggagtgcatcctgggtcttctcaggcgaggctcctcctgcctgtgtgaggtctgcacctcctgctagggatgctgcccttgcctccaggagtcctacaggaacagtcactgttggggacctctcagccctttggattgcaaaagtgccctttggactcttgctgagccctggctggtcaagtgcctggagaattgttgtgtatgatcccagtcctgtgaatattgtcagtatcagtcagccttcttttagtgtgtttgtttcctcccatgctgccataaagaccttatgtcctaggtgacctggccaaccctgtgcatctctgcagtaggctaatatcagtgactgaaaacactggatgtgaccaaggtgttattttactcatcatcatcatcatcatcatcatcttttacagaatcacccagtgggtacattatggtttaagttttgttagcaagacaaaactgatttattttcatttgttacttgcacaatgtataagccaaggacaaatgaaaagagatgaagctgaaatgtgaattgtgaaataaacacagttgggaaaataaaattagaaaatatattaagcatttgggagagattttttggattatttttaccccaatatgaattttcattaaaactagacgatttacttgcatgtatttttgtcctagccataaatggtattgttaccaacttgagtgaactgttgcacattgatcctttctgggaaaatgtgtttaagatctaaagtagattttattatccagaaattatattcacctttgttattatttaaacttcttatattagaaatatttcaactggccaactgaaaatagccagcactgaataggttcaagtaaagtatagttttactgtttttgctttctagcttctggagaaaataaatagataataattgaaatatggaaaaaataggttattatttttaaatcttctgctgtagccaaacacaaggttactaattctctctgggcagacttatgcttcactcctctgcaaattctgtttcttagagttgccttcttggttcattctttcaagtgtttgagctgtggtcagagccttttacaaacctccttaggttaaaatagaatggtccgatgtccgtgtggtaatcagagtaaatggaacataggtaggtggagaggtgtggttttcctagaataaatattttgctatcatcttcactgctgtcacagtaataatatttagtaagcacttgcatgttaaatcctttattaagtacttaatgtgcattatctcttttaatcttcatcataaccctatgaggacagtaatgttattaccagctattaaagcttgtgatcttaaaatgtagagattcagtatgtgaatgtaaatattatttgcaccattgatattttctagcctttctttccctcctttctgcccaaaaactgactttctgggtaaaaaattttaaataagcacttcaaataactaaacttttacccctcttcagatttctgtgttaagcttctaagaatcaaaatattttctgagatctatctatctatctagtgtgcgtgtgtgtgtatatatatatatttatatttcctggaatttgttttgttttgcttttggtatagagtctcaccctgacacccaggctggagtgcagtggcatgattatggctcactatagcctcgaccttctggggctcaggtgatcttcccagcttagcacccccaccccccgaccccctccccaaaatagctgggactacagatactcgccaccatactcagctaatttttttttttttttttggtagaaacagagttttgtcatgttgcccagggtagtcaaactcctgggctcaagggatccgcccaccttgggattctgcctgcctcgggattccaggaatgaactaccgcaccccagcctaacttcctagactttgtaaaatgcatctctttagaagggactacttgaccagtgctagagttaagtcatgaccaacaattactggattcgatgtctctgagaatttggaatatttaatgaatcaaccacagatcaggcaatggggtaaacaaatagaaggaaaaaatctatgctatcctctcgctgtcatttaaaatataaaagcaactcccataggatggagatggagtctaggatttgcacctgtagtaggaaacttattgaggagtcactttgtggggtgtgggagggcagtgctgtttttttttttttcctaggttcttttgactttgttgagaggaaagataatagtaaagattattgttcaatttcccaaagtatggtgttctttgtcctgcagtggaaaatgtagcttttctctaactttctttttacctcctgacccatctcactttgttccccactaggaaaatgttgactggattctggctaagatgtgtggcctcttgggagagtcttgtgccagagcgttctgtgtaggaggctcactttaggccaatttattcaggcagcaggtcaggctagggctgttggccagaagtgctgtgcgtcctctgtcttggagacatggagctacttggagctgagctaccgtgtggtattagtaaacatttcccgcccctacacacacttgaggagcagaactccccagagatgtctgtgtctggtccctcacagctgggttttcacagaggctagatgctcacttagcaatctcggctgtgattcaggataaccacagcctgcttctagcttgctctttgattttcctattgggaaagaacagtcacagtaaagcagtatctaggaagaggaaagccttcacccagtcagacttctgcacagagtcctgttataccgccactgggcaggtgatagtcgtagcagctaaagaatggggaacaactgggggtgctctgtggcgttgatgttaaagctacagagtcaggtttgacctcaaagcaatttcctaaattactaaatacacataactcttattgttcatgctttaatccatggtctttggcatattattggcctgttaaatgctaataaacctttgtttctcagcatgtagtttacatgatggggacttgattaagaaagtactttcaagcatcttatttcataggaaactttattagagataagataagacccattcaaatatgcattctcttaaaaatgggttgtgagttattctcagaattctctgctgtctgtcctttcctgtactccactttagctgtttggtatctctgttccaagaaattcagagcacctgccataccacatcttaaaaggaggaaatgaaagagataaaagaggctcgtttagaggcgagctgagtttattttgtaaatagttttctgatggctcaatcagggttcctttcactttaataaactgcattcctcatattccctagtgtaatttggccacatactgatcaggtatccgtatcaattgggataatttcattataaacttgtttttacaaagctaatcttcactctcattttaagcagcacagagttcctgggatcagtcacagacattttcaccagacttctaagatgctgtttaattcagttccaattgttactttaatgctgttgagatgctagaagctctccacataataggccagctgcctaagcgtaacactgatgacctttcgtaggactcaaagattttgtttgggattgtgtcttcagtaattcataacaggttttgttgctttttaaatcaaacatagtaaagatttccttttatgctctccttttagctacttggcttctggagtgttactctgttttcctaaatttacagtagctgccagtcttgtgctgagttctcctccaagtacactgaattgtgcaattcttgcttggcccagttttggacaggcatctttcccagaaccaagtggtcttctcagaggttaaacagttttggcaaaaactgtaaataatgactgaataaaaccataaaaactgaaatcttaagaacaggggaaaaagatgattcctgactgcaagccacatggatgcagaggacccatttttttaaaaaaagtttgtttctctattcaagccttcttaagtttgatcattcttatgatcttctctttgcctcaaataaaaccaccattattgtgccttttatgactcttgattcctgttggcagtggtaggaataggaactataactactgtttcttcttagtttattttaaccttttcattaccctgagtcacagtcaaactatgacttagaaatagaaggttacaaatagaagggttttataaaaagacccaccaaaaaaaaaattcatttttgacaaggaataacaatcagatcatttaaagatctggtagaatttaaggaaccttttttggctaattttttgttgtaatttctagatatttctctatttaaaaaaatacagaatatgaatgtgtttctggtagatacttctgtagatacatgttgtttaatatctctatgatcttgtaaatgcattttggtttgtggcttctctagatgcctgttaatagatttggtttttcagagtaacccaaagtgcttttctagtaaattataaaggactttgttttaaaacaatgtctccattttgtaagttttaatatttacataaatagctactgcatatggagctcttgatcatgtaactgcagtccttaacgtttatgttttaaatttatagatttgtttcttttgattgagacatcatctccttccacactgccttctctcttatgtctattttaacaatgcaactggcagtttattaattcttcaacttagtgatgacttgttcttacatattgaagggtaacatttactttcaactttttattaaaatgaaaattcagaataattttttaaaaagaaaaggaacacaaaccaaggctaaaaacagatagatgaacaaaacaaatcagcagaaagttttggatttgtaactgaccttcctccaaggaacatcaacccagtgttagaagtgacccactcctgtagcagcagcatagcttgctgactgagagcatggtctcaggaggttaactgcctgggtcctgatcctgtttctgctactcactccctctatgaccttgggaaaatttcctaaattttctgtgaatgagtctctgcattggtaaaataggcataataccggtatgacttcttaggagtattattagaataaaattaatcaatatttataaagaccttacaagagagtttagtacaaagtaattttctaatttttttcaaaaatgaaaaattgatgaaaacgtctctacttttaagataatatgtttctcaattttgaaaacagcaaataaatactttccctgcattgaagctagagctcccattctagtaaagcaaccacttacaccaattagttatagaaaacaggttttgttgaggaagataagttagcaaaggagtgttggatctatttagacctaagaacttaaaaaaaattctttgtctactaaaaataaaatgatattttaacaggcaaattaatttgtaaatcttatttactaaagtaggagttatgagagattcatttcttggcttaaggcttttaaaatcttaatgacatgtgtcattgtagtctaagatctggaagaaatattaattctcaaatgaatatatcctatgggaggcaactagtggtttagtttggaatgtcactcccatctctcttcatcctcagggctattgatctcacaccagtcacatccaatctctctctcctaattgcttattggtttcttccgcctttctgtcatcagcatagctgagttccttggtttgaatcagacactaaaacttttttatttcattctgctatcaaatcttattaacacctcttcttctttttgctaattatcagatttttctatctgtcacttaacttcctcagccatgtaatcccatatccagtgttatcaaacaagatttaatttggctttcccttcctcaccttaaactctctgagttcaaaagttaacttatctcccttttgttagtttattttaattaagacaagtcacattctgagagaagacaatcatttaacaaaggaccagtatctcgaatatctgaaaaacctttacaaattaataagaaaaaggaggcaacccaatataaaagttagggaaaaacatgaacatgctgaacactcatttcaaagaagagaaaacatgaatggccaatgaacatgaaaaaatgtccaaacctattaggaaacaaggaaaggcaaaataaaaccaccatgagacgccatttcacacacaacttgcacatgttaaattgtgacagtttcaaagattggtgagaatgtggagtaatgagcactctcatacttggtttgtgggagtaaattttggagcaacaatcttgggaacaaatttggcattatctaataagattaaagatgagcaagcctgtgacccaaccatcctactgctggttacttagcatgtatgttaggagacttggataagattgtttcaaactgcaatgttaagaacagcgatgttaggagcaccaaaaacactgatgatgaccaaaatatccataaatagtagaatgaggctgggcacaatggctcagacctgtaatcccagcacttcgggaggccaaggcaggtgggtcacctgaggtcaggagtccgagaccagcttgtccaacaaggtaaaacctcatctctactaaaaatacaaaaaattaaccaggcatggtggccggcacctgtagtcccagctactggggaggctgaggcaggaaaatcgcttgaacccaggaggcggaggttgcaatgagccaagatcgcgccactgcactccagcctgggtgacagagtaagactctgtctcaaaaaagaaaaataaaaaatagtagaatggatacatcaatcattgtatgttaattcaatggaatactaagcacctggaaaatgagtgaactacagctacacgaatcaacatagataaatctcaaatacaggatgttgagccgaagatgctactcacagcaatttgcggagtatagtttccattctgatatattttttaggggtgtgtacacatgtactgctgtgaaaaatacaataaaaaacaagggaaagatcatttaatatttaatacttaagacagtggttacttctatggagaggaagatggattcaggaaaggactaaaggaggcttcaaaaatattgtaaccgtctatttctaaggctggacgagacattctttcccctttaaaatggatagatccattatatatagttctatgtctgataaattttacgactagtatataaataatttacataatcaataactactcttaggcttttaaaaatattcagttaaaggttcttcaatgtcaggtgggtttttgtagagtccctctctcaatcttgatatttaagcattgcatagtggaatagaaagttaaggtttcagtgaggtattgttggaattagataatatggatattcacttgaaggtacattgaataaaactggcttgctgccagttaaacactatcttctaagtaataatgaagctggctgtttataacattacaaatattttacaaatcatgacgataatgtaattctggaaaaactcaactgaagagagtcatataagacagatgctgagatgaaagtatggaaacagtgttgatagagggaaaccacggacactgtctagaaatccagaacgttgtaaggtcatgggcctttattcatgtaggtggattttagagatcccctgaaatgattggttactaccagaaatcaatattaggggaagacggagagacctgaaaactctcacaactctgtttttgtttttgtttttccagtcgctgcatggaccatcatatgtaaaagtgggcttggcactaaaaagaaaggaaagaacagtgtgtccttctacaaacacaactctggaatttcccttttgagtactctctgacccttcctccttttcaccatctgccaagtggagtgtatgactttgtgtttccacattttctcctttcatcctctgaattctctacaaagttagagactgcagagaaacagaggggtgttcaaggagttagggagtttaggatgggatgcttagggataggcctgcagagttaagagactgccgtaggtaccctggtgtttgtttttctttacctgaagcatttgtagccaaggaagttatagtagagggattctgtcaattcacatctacttgcagttatatggcattctatagagaagcgcatgattttttattatagcatggctgccaagcaacaagctggttttctttcctacatctttggttttcagtttgctgacactccatcgaaggcacttaattttaatgccaaatacagaaacacaaaggacatgtgacaatggtaagagggtggggttgttgtgtcttatcgctattgtaggttgtggaatcttcttattaaaacttacattatacaaagtacaaaaacaaaaaaacaaggaacccacacaaaacaacccagaattaattctggtaaaaattcacaactatttctgatatgaggcaaatgttttataacattggttttaaatgatgttattacatgtgttaaagttatctagaaatagaaatttccttccattacccctctcacttgccccagaattataaaggaatggacattagaacattagaatctaaatttattaaattataatttgtttgatttctcaattttttaaatcagtttttgaagtttaatgaacattgttgtttagagaggcattacattattagagatgtgtcaggagataacagagatgttaaagttctttgccaccaaaggaagtgggaaagcaatgttactgtgtcattattcacatttgctaaggtacaaattcctttgttagaagtaggcagaagaaccgttctagaaatgatagttggacccaaccagagagtctcactgtttttatttaatatttgtgaaataaaaagactaaaaccatgaaattgaatcatttgtattggaaagtgaagtcttaatggattctggtttaactattgaattaatttttcaataatatataaaacatttcttatttaagtttgttcttttccaattttagagcaggtgggtggagcaattgaaggaaatttctatttctgaaggactttaataactataatgcagttgttttagcccagtgttataaagagcaataggatatagaaagatgagtaagaaggatagagaagtggtatctaggaccaagggtcattgcacagtttgtgagagtaataatctaatacatgtgaacacatgtgcgtacacacaatactttttttttttcgaactaagtatctacttctaaagatcactcatctagagtttaacttaagctcctttttgagcttccagctcacaaagcaaacttcatttgggttgtggattacttaactattttgctcaattcttattgagtcaattgataacacgtattttgtgttcctcctttttctcactatatggtctcctcatcactgaaaatgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaatgacttctttattttgctttaccgtatgtttatatctaattgacatattgactaatgtttgaaagaattcaaccataagttaaaatctgaaggttatctttatcatgtttcatccctgtctgaagatttcctagtcttcttatgtaaatcacatgactcatgtccgtaaatgaactatgaaagatatcgatcagtttatgatcattgacatgtgatttcaaaacacagtgttcttttaaaaatctataatatgtcaaaatacaagttttttttttttacatcgttttagtaagttaatttcatttatttactttggagctatatttccacttagaaaaactaaggtaattttacaatatatgctgagattaaaaaccaaggtaaaaatgatcaaacatatatgaaattgagtcttagatttaatgaatttcactcgaaaataaatgatcagaagaattttcatctaaggcatagagtggcgaaatttttgtaaatgctcgcagttagcatctaactaaaacaatacagtatgactttatttaggagaaggctttttatttagaaaattattttttcatttttacagtgtatcaactgtatccattttcctcacctggatagtcaatgttatctgagcagttcaaggagtaaccaaggcaaccttatgtaataactttccattctttatccatacaaactctttcagtgccctagattctaatgttataaacgtcaaacatcactgcccaacataaataagactcgagacttattaacataaataagtatcttgccttcttgaatgctagttaaatgcttagatttacctaactgcctaatgaatcaggttatttgttaataagattatttttcaaattatttaagacctttatgccccttccaattacttgtgatttgtaggcctgtaggattgttgcatctaatctgactggcaacagaaaatgtcatcaaatactataatatccattttgttttcttttgcactaatacaacagaacatatcatttttgttttaaacaatggttaatatattaatagggtttgttccacacttactatttatagtttttataatcaagcattgggtattaaaagagaatcctttcaacccttcatcttcgtatgcttatacaataaattgcagtgagtgttttctttgtgcttggattgatactagacacctcaagaaagtcacataaccctcaagaagtttcaacccagggaataagtttggcacctcccatgagaaaacagtttcaacggtgaacctgccagtatttacttccttatttaagattgcttttagagtttgtttaaaatagaagaagttgtggagaggggatactattgtaatgcagccctaacatggagggtgggtgttgcaaaaactgtcattggtgactaaatcttctacatacattgcaaaattctcagtggacaatgactgccccttttaaaacactgtaactcaaaatatcatatttatgaccaaatttttatgaagacaatagacaatctggaaatgaaataaagccgcagcggagccccacctggaaagcaatgtctctatgcaaacagaatctgcaccacctattcttcaccaagctgtcataatagcatgacactttccactagagcctcagctataacacttaagcagctagatgtcaagttaagtagcttcctgccttctgactgaactgtggctagtagttctgcttccattgtttgtttgtttgtctgcttatgccctcaattccttaccacattccatttagtgctcactgaaaaggaagcattaatttagttgtgaggtgaccatgaagaaatcatttcagataaccatcctttgacacattaccaacatggggtatagatatatgtgttaaagacaaagtatagctctgcaattaggtgttcacttccaggcaggtctttgtgtgaggtttagttgagaatgtaattattaggaaaatggtgaaaagcaaattcaaacaaattctaagtttagcttgaaaaatggaaaaggttcttaagttctgtctgatgcataaaggggtagaagcaaaggaattatgctccaaagccaagaaagagggtgtacaaaagcagctgatccacttgacatagttcatagccttttgcaaaggaataaaagcctgttgagcagggaaccaaaagatctcattataggatgaagccaagccatattaaagcttgtgcactagtaactatgtctaaaaacagcctgctgttttatattgaaccaatacatttcttaacttggtaggttgcagtgtaaagatgtacagagcctgtctgctggatgctatgccaattacagatgtggcagagtggtgtcaaacacctacaaacagttagatcgcaagcaatcttagagtgaaacaaaagaagttttaaaatgtcacctcaaaacctagttaatcgtgtgtgtttgacttttagagtcttgaaatcacctttattatataatttcatgtggacgtcatatgctccctcaatcagaatgcacaattctttcaaggacatgaatagtgcctgagagataaggagaatatcttttaaaagtaacatctttagatgacaaggtgtctctgatcagctctgcagaaactgtgttttattggtgctgaggtgaaggaggagtaaaatactcatgaatacatattatattagattttgttagatcatcaaaaagaataattgggcatatttacacaattacattttagtaaactgttatgccagcctaactataatacatattctggtaaaagtacattaaatcgcaatccaaaagcaatttagcagctgaggacattattttttatctaattattcacaaattaatgaataaaattaaattccaatcactgaagaaaatgaagcaatggcgagaatcagaagtacagattagttaaagcaaagatatgcaatgcataacagaattaaagcatttcttttattcaaactcagtgcttaaaaaagaacaaatccatcatcttgaaatttgacttgtagcttgacattaaaaataatatgagtagaattttcagtggggtaagcacaaaactagttcaagttgtgtcactctcaattactgtactcaggtggtgtacccattaaaattcccacttgtgggttccgctcgctatgcaaatggggtcattacccggagaatttaattggttatgacactgggagtaggacttttcctttcaaaataaacctacttacacacatttttgctagaaatttgattgttatatgtagtttgcattgttttgctctataaatatttacaacaattagactgcccttacttattttttacaaataattaaaaatgggtccaaattaatctgatatggtttatttgtctgtaagactagttaaaatgaatcttttgtaagtcatattgcttatcaaaacattattttaaaaagcctttgtatcttcccaaccatacatcagatgtgggtacatttccagcaatgtttttcatcatttaatagtaacattttctcttttataatagttctaaatatttaatttgaaaggtttcttctatttttctccttttttgtcactttaaaaaatacgcagctaaagagttaacctacccttagattatatataaaacatataatatgtaatattgctgaggagccatgtctataacatttccaaggtctttatattcactgatagcactggatggggtcgttatgttgtcagagtcagtcctagagatgcttccactgttagccatgagactactaaatttaaagcaaaaaaacaccaaattggtgtgaaaagcacagggctccatacaattttaatttattgtggcgacttcaactagagaacgctgtttattagccacctatcaaaaatcttgataatggcctgaattgacaaggaacactgaaattacagtgtggtttaatggatatgatattaaaatgaacatccaagaattgagttcctggacactgactctaagagcagttcccagagtgaacataaagtaggaacagagttgcttaagtattaatgggataatctcagggaagcactaacagtttcttgaaagagacgggttacacagtctaaatttttattactacatcaagctgtacaacaagccaaggttttatcactagtttatctggacctaaagggaatatgtttcctttaatgtaaaaaggaaatcagagaaaaataattccaaggatatagaaaaggaaatactataaatttataactggaccattgggcaggatttttaacatctgtaactgtggggaatttcccatagaatatcaaatatggatccaagtctctgacattcatttttctatgatatttctaattgtgcccagaggataagaaagagttggcgcatccaataaatataatcatttacatgcacggagctccctttgaagttaataggacctatggaaaggggagttatgcaccacaaaaacgaagttcaacgtgaatctagttcttttttttaacatgcagtggtattgccaatgcatttggattttcttgctgcttatctttcctttgtgtgtgatgtttaagttggagttgagggaagtgctccatgtgtagaggaaagatagcccaaaaaagaggatgtggtgattggcagcttacactcagggacagctttaggagatagcaaaagtgatagggctgacatttgtagagcttgtttaacttttcagaagaaaaccgtatccgttttctcatttgatcttcacaaaactgtgattcttctaggatagacgttttaacttccattttacagaggaaaaaactgggacagattgcttaagtttactttttaaagtaacattgttagttaccaatagacctaggaaacctaatttctatttctggatctttccattagacgggtatatttcttatgtaattttacatattaccaaatataataaatagattcaatcaaaacagcttggcttgaagctgggatggaaacacgcggatctgaagtcttgcctgtcttgtttcttgtctcccatctttcctaccttgagtgggtatcatgacttgggctctaagggcgaataaaattcatagctactgtactacttatctttcatggcatgcattgacccaaaagtcaatgaactcacaatgtgttactgttctgtgcctacttatcaatgatgtccattgtttttgggtggatgaagaatcaagagttagatgttcttcataagattaggtgtcattcattttccatttaccaccctcagatcagttttctctttctgcctgattttgtgccagggtgtcttgctttctgatttccagttggctttggctgatggtaggcactggtgggaaatcaaaagatgggagagaagtcaaggtattaattcccaccccacccttgcccctgttccttccagacagtgtttgatagtagctctgttcctccacattagggtttcctgtgcaacggcccctctcccacagctacagctctctcctggtacctcttcaggcttggagaagcagaggttttccaatgttgttagttcctggaactttaaactcctttgctggtcttcttacaactgattgtttctctgctaacagtcccttttattaatctcccttcaattaaaccctatgagggagccatctgtttcctgtcagtactttgaataatgaggtagtgagaaaaagcgatcttgtttgtgtgcagacgcacatgtctgagttcaatcttgttatcatgtatttctaagatttatgaaaatataaatcctggggtatcttgtatatttgtgtctgtttaacattgacagttactcaaatataataatacaataatacaagaactacactagacactccagaaacttaatagttttagttcaatgcctacatatcctccttgttaacatttgacaatgtaacaatctgggggtaggggacagggaaagaaagagggtatcattaccatgggtgatacaaagcttatggtcgagttacaaggctttaggatccccaaaggtgatgacattttcctttatttcccacaacctaaaatgactcagtatcactatcaacataaatatacccatagagaaatcttagcttacagcttacagatccacccagaaatgccatatttggggattctatataaatgtacccaattgttaaaagttaacatggcatctatatgcctttggcaccaaacatttctaaagtaaggtgggtctgttatcagatctttattattattattattattattattattattatactttaagttttagggtacatgtgcacattgtgcaggtaagttacatatgtatacatgtgccgtgctggtgtgctgcacccactaacttgtcatctagcattaggtatatctcccaatgctatccctcccccctccccccacgaccacaacagtccccagagtgtgatattccccttcctgtgtccatgtgatctcattgttcaatccccacctatgagtgagaatatgcggtttggttttttgttcttgcgatagtttactgagaatgatgatttccaatttcatccatgtccctacaaaggacatgaactcatcattttttatggctgcatagtattccatggtgtatatgtgccacatttttttaatccagtctatcattgttagacatttgggttggttccaagtctttgctattgtgaataatgccgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccacaaacagtgtaaaagtgttcctatttctccacatcctctccagcatctgttgtttcctgacattttaatgattgccattctaactggtgtggatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcaaaaattttctcccattttgtaggttgtctgttcactctgatggtagtttcttttgctgtgcagaagctctttagtttaattagatcccatttgtcaattttgtcttttgttgccattgcttttggtgttttagacatgaagtccttgcccatgtctatgtcctgaatggtaatgcctaggttttctttagggtttttaggttttaggtctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattggagcatttagtccatttacatttaaagttaatattgttatgtgtgaatttgatcctgtcattatgatgttagctggttattttgcttgttagttgatgcagtttcttcctagtcttgatggtctttacattttggcatgattttgcagcagctggtactggttgttcctttccatgtttagcgcttccttcaggagctcttttagggcaggtctggtggtgacaaaatctctcagcatttgcttttctgtaaagtattttatttctcctttgcttatgaagtttagtttggctggatatgaaattctgggttgaaaatttttttctttaagaatgttgaatattggcccccactctcttctggcttgtagggtttctgccgagagatcc

SEQ ID NO: 1091 - DNA, 4304 bp, Homo sapiens
cccaaagcctccgtcggtctgggggcaggagtagggagaagggatgaggtgactttttgggcggggtggggggaacgtctgggcagccagggacctgcccattcactcccctttcccagccccgggagggcgcagcgcccgggtggggagcccgagccagcccaggccggctctggcctcctgacccagacagcgcagggcgcgagggatcgcgcggccgagcccgggtcgcgccgctcccagcatcggggccgctagccaagagttcgaggccttcccgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagaggaggaggaggaggaggaaggggcttggagcgactacggggggatgcggagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggaaaatgtgataaagacaatactgagaaagatataactcaagctaccaatagccacttcacacatggagagatgcaagaccagtccatttggggaaatccttcggatggtgaactcattagaacccaacctcagcgcttgcctcagcttcagacttcagcacaggtgccaagtggtgaggaaataggcaagataaagaacggccacacaggtctgagcaatggaaatggaattcaccacggggccaaacacggatccgcagataatcgcaaactttcagcacctgtttctcaaaaaatgcatagaaaaattcagtccagcttgtctgtaaacagcgatatcagtaagaagagcaaagtaaatgctgtcttttcccaaaagacaggctcttcacctgaagattgttgtgtccactgtatcctggcttgcttgttctgcgaattcctgaccctttgcaacattgtcctgggacaagcgtcatgtggcatctgcacctcagaagcctgctgctgttgctgtggtgacgagatgggggatgattgtaactgcccttgtgatatggactgtggcatcatggatgcctgttgtgaatcatcagactgcttggaaatctgtatggaatgctgtggaatttgttttccttcataaatatttatcttttgtttgtgttaaaactggagagtgtttaaaaatttccttttggggggaagaaaagcacattgtaagattctcatgaaacaacatggaatttgcactgttaactcattattgtaagtaatctctgaaagcctttttactttaaccaaatctacatggtttaatatgtgaaattttaactactttaactagttttataaatttcttaatatgttacaataacttagggacattttgacaccccccttcccaaatgttaaatgccttctcctttttaccgatatttctgtttcttttaaccgttctcaggagcactttgctccaaatatattatttttcagtgtgtatttaaacgaggcagtttattttgatatgtatctattcatgattgaaaggaagcagtcttggccaggcacggtggcttacacctgtaaccctggcattttgggaggccaaggtgggcagattgcctgagctcaggagttcgagaccagccagggcaacatggtgaaaccccatctctactaaaatacaaaaagttagctgggcttggcggtgtgcgcctgtagtcccagctactcaggaggctgaggcaggagaattgcttgaacccgagaggcggaagttgcagtgagccgagattgtgccactgaactccaacctgcactccagcctgggcaacagagcgagactccatctctaaataaataaataaataaataaataaataaataaataaataaataaacaaaccagtctttattttaaaagaaactttaggaaacaaacccacataatagttgggaaccagtgttgatctctctcccttaccttctccacttgttcaacagactctgaatgccgactgtgtggactctcttcctcagactgtggggacagatacaattccactcctgtccacaggaacatgagatttagcagactaaggagatctgtaaagaatgaaccataccacaaggcatactgaagtgaggattataagagaaataaactcaaaatgctgttggaatatgcagagaattgctaccagaatattcagtaaggtttcagggagaatgtggcatttgaggactctcttagaatgagtgattcacctgctatttaaatgaattatttagatttttgacaaagatttaggtggacaccctaaactgtgtgtgcctttaaccagttaaaagaacagtgccttcagcatacttttttattagttgtaggaatacagctttttgaaaaagctataaagtttaaattaactaaaaatatgcattttcttacacataatttaaatgttatcatacttttttgatgaaaacataatgccttagtaaaatagctctatttaataaagaagattgagtactctgacacatttcatttaaattaggaaatttttaatattaaaatcccagtgttctgagttattgaaaggctttcttttattttgagagctttaggtctttttgggatgagaacattttagttgtttagtttgtttcttaagcagtgctattttttgtaaacacagataaatggaaaccattcttttcaatgcagaagaaatctagatatcccctactgtgaccaaatttctgtattacgattttatgttaaattaaactaatatggcaggttataatgatccttaagtgtaaagaaatcagtcaattacaagagtaattgtatagttattgagacctatagtgtgtggcttagatgaaagggagagtaaattttcataccatgctctctcctactcagtttgatctctctaaaattgtagtttggtttgatttaatataattcttagtagaaattttgaaagtatgctttgggattaataattatttttaatttttctggctgaatatcaaattgatagtaacaacagaagcataattttaggaaggctttcgcaaacctagccttttaagagaggtttttaacctgaagcatgagaatatatcacctgtggtttttcctttgagatgaaacgtagtttctagttatatcattacttaaagggcttaaaaagaaaaaacttagcaaacttttgaatctttcttttattgctatttacacatacatacacacatacaaaacctttaaattttgggatctgaatataattctggtaaacagctgtcttcatttttctcctctaaagaacttaattcatttgttacataaaatataaggaaatctttatactattttacagtaaccacaatctaaatatttacatatacccaaaattaacttatgctcatatattaggatgtgagaatatcatctgtttatggacacatgaaacctcctaatgacctggaattgttagaatatttgactttttatatgcaaagtttttcaaccaagtggtttgtctaatatttaaacatgtactggcacaatttgtgatgaaaatattagcacatttgcaataatgtttctccataacagagaatgttaatggataccagaattttatttttgtatttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacactattttgaaaatttttaaaaa

SEQ ID NO: 1092 - protein, 385 aa, Homo sapiens
EWKRGKRGREGEGPLAGEPAGVSWLERGGGVRGVRAATAAAVAATAASGLSRREAGGRAGAAAAVVRPPGRKCGRCRRLANFPGRKRRRRRRKGLGATTGGCGEAVSSLHPAPHSPSSVRPAGRRARRQRRGAGSAERPMSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 1093 - DNA, 22885 bp, Mus musculus
  misc_feature (1)...(22885): n = A,T,C or G
tcagcaggcagatagcagttgagagccttgggctgagaaaggaaacgaccgacttcgtgtttgcctaatgagtggttctttttagttcaggccgtgtgacttttttttttttttttgtccagttcacttaaagacatgaagtagttccaatgcaacctacttattttaatggtagaatatacaaaacaaaatgtagcaatttcagcatataattcagaggcactaagcttatactgatactgtgcatcgacaccatttcccagaaccagaatgttctcatcccaagaggaaaggctatacccataaaggataactccccatcttgctctcccgaccccctagctacctttgctgtatgtccatgtatgttagcctagtctagggaccttatgtaagtgaaataaggcagggtccatctgtttgtgaccagctgtttatccgtatgtcctcaaagttcgtctatattataacttaagtcagaatttccttgcttctgtgatcgacagatattgctttgtatgagcacgcagccttttgtttatcctttatctatcaatggacattagattctttatacccaaatgatctattttatgggctttgtcaagtcagtaaatgaagaaacttataaagtctggacctcttgtaacagtcttagaccctggatcctatggctgcactgggcttccatagcctctgggaacagctctgatgtctgcctagtactctcaagatagacgagcaggatctgtggaggactcagaccacaaggcctcaaatgctttcactctgccaccttagcactgactagccatgttagctattactttacagtgttgagaagtaatccataatgtgcctgctatgcaagtgtgaggacgcaagtatgagtgcccaggactcagaaaagccaagcacgtacctcgtcttgtgactccagagtcagggtcactgtagagaaaggagggtccctggagtggctcagccagcctagctaaagagaagtgtgccggggttaagtgagagactgtctcaaaaagtaaggtagagatgacatcaacctctggcctccatattcacacacataagcacacagattcatgtgtgcacaccccacaccaagaatcacacatacctgctacacgtgcacatatttgcaacactggaaaacttatttggcagctataattttaacaataccagtgaagaagcaaaacaatcccagtattaataaattaataaaggcaaatttttgataactaatccattaagtcaaatatgctcttaaagaggccctatttttttttaataactagaagtgaacagctcaacgtaaaagaaatacagaaaatagaagtccctagaagaactgagtttctgtcaaattaatttcagtgttttgatttttagataaatgacacaaagttataagtagcaccaaacggtgtaataatccagaaagataaggaacacagcagccactggactcagcaatcacgagttagaggatcatctcacccctggggctggagaccaaacccagggccttgagcatggtaggcaagcattccaccactgaactacaaaccatctccagcctgattatcaacattcccaatggtccagttttagtacggctgaggtagaggttgcaatcagaggtaagaaagcacaggcacaacatacaatcacattcccaggaggcttggtaaagcgacagttaggaccatagcttaaaagaggtcattacctggtcaacagaagacctgagcatattatagaatacagagaaggcaccaatgaagaagggttcactcctactaaataaacatatattcaccagtaccaatgactcagccatcgtggtagaaagacagcccctggttgccccagccaggaagtacaatatagtaataaacagatatatataggagccatgtaccataaagtgagcggctatagtaaatgtaaatttctgctgccccagtgaggccgggagagggatttccagaggtgaataagcattctcaggcaggaagtgtggagtccagacatggcacagtcctgagccgtgtgcaagggatagtgagagccaagtaccagccccatcctggcattagccagaacagcctcatggggatgtgtcttctacaatgaagctctttgtgctgtttagtgttatggaaagagagctgctggctcaccaccaactggttaggaaaacactgaatggatcaggcgtggtagcacaggcctgcactttcagctatcccagaggctaaggcaggaggattgcaaattcaaggctagccgaggttacacagtgagttcagggaaagctcagacaattcagtgtaccctgtctcaaaaaacaaaacaaaacaaaacaaaacaaaacaaaacaaacaaacaaaaaaaccactttttaaaaagagtaggacacagagactgtggcagcacgcacagagcctgcacaggtctgggccagctggagtcccagtgctgagagaagtgggcttgagcctctatctggaaccttgaagctatccaattgataactactcacaaatgaagaattagttttctccaacagagtctcatggggtgtacaaactactacgaaggctaggccttgcacgcagcaatagatggccagcacagaaccaagtgaatagtgtttttgagagatttttgtcttttgacatgaagctttgtaggtagcagcagctgctactgcttcttcctctcctcctcttcttttttctcctcctcttctccctcctcttctctttctcctcttccttacaagtcctttgtatatgtattatggtttccagttttgtggttttatgggatttctgtatgtgtgcacatgtgtgtcactgcatctatgtacacatgtgtgtcactgcatctatgtgcacatctgttgccacagaccctctgggtccctttgtctgcgtggaatgggtctctggttgcaggtgggcaaagagttggcggaaatgacaaacagatgcacacaggagattgggtaaaaatctgaatgtattgtcacaaagtgaacaccagtcttatatagtacagaaaataaaaggggtaggaagtcacagcaggcaaagtacattgaagttccctgacacaaaacaaaggaatgacttcaaagggacttacaggaaccaggtaaatgtttacagtaatgataaagcagtcctgcctagggttagctaatgacagctaaggatttcacaccctagtcagaatttgtgctactcctttgagccttgtgaaggctagtaccagggagttctgctctagcagaccttctcacgaataatgcaataccacaacccccctatttcctaggccttagtaaattcttgtatcttggctgttcttttaagtatctgtgtagaatctccatttgtcagaagaatttaccaacttgcttctaatatgtaataaagcctgctacacctggctgtagagaagatccctgtctcagtgggattccctagctctttcatggcattcccttgtttgggtgagactggctactgtccttagtaaacactctgcagaccagccctgagctgctggctctgtcttttggaatgcttaattagttactgaataggtaactttattactgcattcccaccagattccaagcttgttggcttctggaacattggaacactggtgggaggctttagctatgtcagaattcaatcttaaaagacacttataataaaataatactaaaagagagcacgtggatccatacactagactaactcggggatagggtatgagtgtacaggttaatgagaacgccaaagctccaggaggtgagttccttttgaaactctctgcctcgtgagtgctcccaggcctctcagcctgtcaagcagacttcactggagtgtgcgtggcaatgtgtgtcactgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatcagaatatattgtatgaaaaaatctatttcaatataaataaataaacaaataaataagaaggggtagggtcagtttttgcaagtctccaaaggggtcttccagccccaatactccagattaaattactttaattctagggaggcaacatagctgtacttaggaatcaagatgaggctgcccactgatgcttacactgttagacatgttcctgtgaaaccatttgctcctttgtgggtttcctgtagcttttcatctgtatacacacgcaccacatccccgttagccacacatccctgaggctaggtcttctcatcttctccctttccacatcctacaggctgctacacagtggccctagactcagctttgctctcccctcagggctgactggacaggcagtgaaccgccaccctaccaacccacattctacgatggctggcagattccacagccccgctccatggtaagggttgcttagctctgagatctatgaaaagcatttccagtccagatcaaaatcacaactacgaggtgggttatatgggtacctgttggggaggtgagcaatggacaaaaggcagctgttgcaggcctgtactgggctggttagttagcccctccctgccactgtgctggctgcctcccattctaactcattctggttttcttgcttacagatgcccataacaaaccaggattcgatttccctccggtatgtcagtcacatgcttagtggattctcgaggtcccagggagggagggtcaggacagaacctttgcacctgtgaatcccagagaccattggccgggggcacaattcctattctccatccatcctgaatctgtctctcatgtcagaggttctaggatgaggagcagcctacatttccctcgggatgagccatacaaccataaccctgaatacgaggactcaaacctcccactctccagccccagccctggcagagcagccctgaaaatgcaagtcctgtacgagtttgaagcaaggaatgcccaggaactgactgtggcacagggggagattctggaggtgaggcccatgcttgaagccaaaaaagaggcaatgggtgggaagtacaattagcctggagtgggtggcttacagatagagaaggaaagtgggaaaggtcaggcggggaaagacacggtcttgggggcagaggggatgggaggatggaggctctgggggctaatgtggtgattctcggtaggttctggatcagagcaagcgatggtggctggtgaagaacgaagcaggactgactggttacattcccagcaatatcctggagcccctgccagctggagccccgagaggccaccgacaaccatcctttagggtacttcccacgctggggtacccagaagccctgagtcctaagtcagaagtcagaagtggtagtagggaggattaggtgacaaacagagacaatcttagttcagtttaatcaatatcattgcatgcttcctcggtgccaagttcattatagggtctgaacaaagattaggtgagcgtccctgccgaactaggaaaccagaaggtgagataagcatcctgatgggatctcagtagaagggacccaatacaggaggctgtgtatgtttgtaagatgggatgacctctgacttctagtgctccttgattccaggccccaatgcttcgcctgagctcaaagcctgaggaggtcacagcctggctacaagcagagaacttctccactgtgtgagtgaccagtcccctgggggatgaggggcggtgagccctgtaaatgggagaaccacaggctccattcactctcagagttagagagtgtgacctagcttccactgtacttgatgactccatcttaggctttctctgctgaatgaaagctgcttgtctgagcctagggtaggtcacccagtgcagaggccatatgtagtgaaagagaaagagtcaagggtagcaaattctggaagaacttgggctgcccaccttagccacccttcccttccagaccagtcttttttaaagtgtttctgccctcaaatctcggagttctgtggttcactgagaccaaaccactaggtgtatccctgtacctgcagatacctaattcctgtaaccccaactttccttctctacacaaatactaagacctagaatctgcccaccctacttctggtggattctaccattgttatttacagcactgtaaggaccctcgggtccctaatgggaagccagctacttcacatgagacctggggagctgcagatgctgtgtccacaggaggctccacggatccaggcccggctggacgctgtcagaaggatgctgggggtgaggaagctctgggatcctgactcctattcagaggaatttaattctcctggggtgagaaagggagagctggggacactaggcatgggctattcctctggggactcagctccatccgttcaggtgtgtcttgaagttctaatcgcattggtgatataaactctggggagtccctcactaggaaccagccccatctgaattgttttctcccttcagatgactcattagagaccagctcgaatacctctaagaccaaggacctctcatgtgcaagatggagtatttggtacccagttagagcccctggaagtcctctttcagttagtggcaagccacatatcctggatcacaaagcaaagaagatgaacaggtccagacactgaggcaaatggtacctcattgggttggagaccctcaccggttactatttattttaccccacaccctaagttggcatacttattcccagtcttactcctgatctctttagtcccaatcctgccaataaaaagcatcgtttaacttgttctatgaccctctccttgccatttattctggacctgatgggaaccaaagccaagagagagcagggagttgggatgcaaagcatgaaagagcaacaactctgcaactgaaccgaactgaaccgaacagaacagaacggaacagaacggaaccacagctaaccaaaccaagctaaactaaactataactgaactaaagagaattcactgtaacctagagcctttggggactatggtacattctttctcctctctaaataaactccaaaatgaggctacatgcaccacctctgtcctatggggcacgactcacaccctaatccaaagtttctagtccaactgtaggcacagcgtgtcaccgagacaaagaatactctgctgacagctgcaggctttcttcacactggttggtgatgcagaggagtctcgagtgaggtattttgtgctctccttgggagctttgtctttcaagcaatggttgttaggcaagtcaaccttgagctccctcccacctgtctcttcagtggcagtacacaggaacattgcactgggaggtgacggtcctcaggtccactgtgtaaactcaggcatgttggtccactccttggctctctgtcctagggttaaatgaagagttagggctgtctatggcttgtactctctattggtgtatatagtttacttccggctcaaagctcatggaatgaattcttctccatggaagagaagctatgcttcaattgagataccctgttgttaaggtttgctgttctcatggattcaagagcccctaacaggttcttaagattgtccaggaaatctcttttggctgaatttatccaagactgtaacatcatcccgagctaaataccttattttcagatggactctatcattcactctcaacttcctggcctcacaaaatcctcagtaacactgagtatgaaagcaaaacttttacctcaaaggaagggggtggggggagagggagggaaaggccttcagagttgttaggggcaaggtagccaattcagaaaagttaaggtcttcgaatggaaggagccactatcccattggccttggcccatcttaaagctgaaaaccaggggaaatctataggattaggaaaaaaaatgtgctctaccccagtgttcacctaccttcatagaaaagactgtggcaaggtaagaggctctaaagttagccaagcacagggagccagcaaaactaatgttttaggccatcctcagtctgcatcctggaccatccagggaacttgagtggtccatcaatcttctccaagcttcaattccttgttctataaactgggcagaacacctaatcacaaagttatttagcctgaattgggatatatcatgaaacaagtagaatacttagactactctagaagttttagactcgtggctcaagttaatttgttgctggcttttgttttcttgggaggaatcaacccaggcattatacagtcacatgtctctgtaccatttcttctttattttagaaaaatgtccttttacaaagtctgaagtttgagtcagttaaactaacggggagacataatttcccacacccagacttggggctccgggaggcctggtgtcttagtcaggatttctattcctgcacaaacatcatgaccaagaagcagtttgggggnnnnnnnnnnnnnnnnnnnntttattcagcttacatttccacattgctgttcatcactgaaagaagtcaggactggaactcaagcaggtcaggaagcaggagctgatgaagaggccatgaagggctgttccttactggcttgcttcccctggcttgctcagcctgccctcttatagaacccaagacacccagcccagggatggtcccacccgcaaggggcctttccccttttgtgctgttttactccacaatatgcttatcattttccgactaacttgtggatcctgagcatcagaatgaggttacctggggctggagagatgactcagcagttaagagcaccaactgctcttccagaggtcctgagttcaattcccagcaaccacaaggtggctcacaacagtctatagtgggatccaatgccctcttctggtgtgactgaagagagagagcgacagtatactcacatatataaaatgaataaataaatcttttttaaaagatgaggttacccttagtggagttgtgttttaaatgtaaggtactaaaacaaaaaaatagaagacatctcaataattttcatactacattctgaaacagtatatattgggctacgtaagtatactatggattcattgcctccttaaaaaaaaaaaaactagaagcaaaccatttaaaaacaatcatatgtctgtcttgcattatactgctagtgaacattatgatctagatcctatacactccccacagagcagagagaaaacactcacaccctctgtctgtctggctgtccataccctttgcaacctgccccaaatgcttaatgttttgactcctcccataaaccagcctaactcgacagcacctgctgtttatcttgcatagctatttgtcacctttcggtgtttgctctaccctcctctttcctggagtgtcctttgaggcatttccaatgtgcatgacctatcctttttcacagtggacctgtttagtgtccccagcctccctcagtcttcacagagccatttgtatcttacatagaaaatgtttctatccccaaagtaccttatacctgaatcgtttcctacctcgtagttttatgtgccagctcaactgtgcaacatgactcacgcttcccgggtaactaaggtccaggcccccactgccagaagagtagatgaagcatcaacagccctgggagaagttcacaccggaggatttcaggagccgcagcagctgcgcctgcgcaccgcccactgaccacgcggagggcgggtggagcatagagcgagagaggaggagacagttcggtcgcgtcagcccggcccacagcgtccagtataaagttagccgcccacagtccatcgctgtatccccgaaggggctaagatcgcccaaaatgtcatccaagtctatggttctgggttactgggatatccgcggggtgagtggtccctcgccagcccagcctctgggacagagaggtgcaggcggccgggcgggggtcaggggccggtgggccgatctccagcctacctatggggtccccaggactgtgggtagaggaataaggtactggaagttcccgggcgtgagcgaaggggctgcctaaggacaatttccctggacaggacgcaggagcttggcagcgttgggttggggacattgacggagggggcctgcgagcaagtgggcactgcgcaggcgcgctgaccggggtctttctccatcccctgcttttagctggctcatgctatccgcatgcttctggagtttactgataccagctatgaggagaaacggtacatctgtggggaaggtaatgaatgtctgtgggtgcgctacagttgttttttacccagagggttgtaccacaccaagatggtgtgggaccccctgctcctgtaagctgggaactttgccaagagaggcccatagagttatctcttgctgttcaggcccatctttgcagaaactcaagggttagtttttggggattgggaacttgagataacaggtctaagtctcagctaggtcggtaacgggcttgggtcccacttctctcttacagctcctgactatgatagaagccaatggctggacgtgaaattcaagctagatctggactttcctaacgtaggtggttttggaggagtgggcagaagggaaggccttcaagtgtatctgttttcacttcatctctggcttgggagcatctagatagagactcttcacgtttatagaatggatagaattcaagggtcattgaacagaactgagaataacattttatttcctactaacgtctgagaaacactaatattctcctcttaaaggcaggctataagagacatgagttgatagccaggtctgtgactttatcactgatagattccaggtattttcatggtatcctaaatgtatcctcatgtgtcctggttgttaaaacacctattttttttttaaatgtatccataatcaccctacttttacatactttaaggtataaaatatttacattttgctttttaaacgtctatatgccacacatacattcacagtgacacacaggattaagcacccttgtctagagtcaggtgaggacccagtgctactttctatttatttagttatttctcctggcttctactctcacacaccttgcaagtcttctcttttccagaggagtggcggtcctggaggactaggttcacattaactttccccttctagctgccctacctcatggacgggaagaacaagatcacccagagtaacgccatcctgagatacatcgcacgcaagcacaacatgtgtgagtgggctgaaggggataggagggaggaggcagttggctcacctggaggttggcaatcctgagggtgatttgttgccatctggctgcaggtggtgacactgaagaagaaaagatacgagtagacatcatggagaaccagatcatggacttccgcatgcagctggttcgcctctgctacaattctaaccacgtaagtttcctcatctggaatcacctttgttgggtttcaggccaaagtgctaaggattattctgctcgcttctatggttgccatctttctatcaacccaaactggaaggattagaaacagactctattttttggtgtggtttgtcctgtaagtctggtgttagctcctcctcctttccaaagccccagctctccatcctgccttctccaattaaaggcagaaagaagctgcctagagtgtgtccatcactggtccaggccctgactatagctattgggggaaggggccagtgtgtgtagaagtccaaagacttctacattaatgtgggacctgggaatcaaactctattcacccccattgagccatgtgttgacccaacaatagctattgcttttctttcctaggaaaacctgaagcctcagtacttggaacagctacctgcacagctgaaacaattctcattgttcctggggaaattcacatggtttgcaggagaaaaggtagggagaaggcacagggagaggctgcctgcctgcctgtctatctctgcaggtattggtggagttccttaggcatgacacttcattgtcctcattnnnnnnnnnnnnnnnnnnnntccttaggcatgacacttcattgtcctcattctttctagctgacctttgtggattttctcacctatgatgtcttggatcagaaccgtatatttgagcccaagtgtctggatgagttcccaaacctgaaggctttcatgtgccgttttgaggtgatgttcactacccctttctcaaagcactatgcacaggctcccctatggcctgtaggccccattgtgcttgcccaacagcagcagagatcagtggagtcagacagcatgtttgctgtgagtctgctgggctgggtcagggtcctaataagacctggtatgctttttcttcaggctttggagaagattgctgcattcctgcagtctgaccgcttcttcaagatgccaatcaataacaagatggccaagtggggtaacaagtgcttatgctgagccagagctcgctgctgctgagccatcttgccctgaggggcccacactcttagctcactgtcagtcttgttccatcctgtcctgagggcccccactctgtctcctctgctctttctaataaacagcagttgcattaactggtgtctagatggatttcttggcgtaaaggccaaagaagaatgaggagatgttgagagaaagagctgtgaatccatgcgtaactgcgtggacattctttactctttactcctcggccgagttccagggcttgaagtcctccccgagcctgagcgggcactggaaggagaggtattgcccattttgggtggcaggtgcttttgaacagacgtggaacctctgtgaagccatgaagaaagccaagcaaaactgcgtagtgctgacgaatgcaacagaactggagcttaccaacgacccgtgttgagcagggcagagagcttaatgtggtaaaggtggcatttcaaactggccggcttgtcagtaagttgaaacagttggttactaattaaaacttagagagccctgtacctcatgctaggcaaggtacacctgctggcgaccctgaagactgatacaggtccctgagggaataatctcacttttaaaattcaaatcatatcccgtggcccagccactcttcctatgttagtgtactaaaaccacgtgcacccaagaaggtaaattgtggtttcatataagaacaagtagatgctgaataaaagctagggaatatcatggcaggaagggcacgaaatgatgtgagtgcatggtgattgtggagacacacattcagaatgccagtgttagggaggcggggacaagcaggttcctggaggtgcactgcccaacatctagccaaatagtttctggccagtaagacaccctgtccagatggagaggctggggatggagggaggcatgacccctgaggttgtcctccagcttccgtgtggatgtgaacacgcacatgggtgtacaggtggacgcacagtgtgcagttgagggcacacacagaataagctgtatgaaccaacatggcttcatctgaagacatcatcaacgtgcagtgaggatcaagatcccctctcaaggcccggttggataaggatctgcttccaagctagtggttgttggtacaactcaatgtctgccattttgctggacagagatctcggcttcttgatgggtaacaaggtagatggctatcttctcttccttgtaaacaaggccttgccagaacacttcaatcaagagtctcatgagagagatgttattgtaacacagccatggcacttccatcccttgtctctgccctaactgttacagtttggatactgaatgccctccagtggccaatatgctcaagattcctccagctgatggtgttttggggagatggtagaacctttaggagaaagggtccatgggggaacatggggttctggctccttcctctttctctgtctccctcccttcctctgccttatttcctggatgccacaaggttcaaagttctcctcagccacatgctcctatcatgaggtactgggccactacatgcccaaagtaacagggccaagtgaccagagattgagatctctgaaactttaaggcaaaaataacccttctacctttaaagttgatttattccaggtatttgtctcagtggcagaaacctgacacatcattgaaggtaaatcagccattcaagggaagggcattacacaagggcctaagttgggggtatagaaaccatctccgagtctgctcaccacagggcagaaagcaaggaaataggaaattggtcttgtagcttctgagtagcaattctaagaaaggtggtggaaaagagcatacaacacagcaagcagctgtaagaaagagcatataacacagcaagcagctgtaaggtaaaatatttaagagcacatgcctagttttgtggggttttttgttttggtttggatttgttttttgagggaagttgtttttggtttggtttggtttgattttctggttttttttttggtggtggttttttttttttttttttttttttttgtcctggctgtcctggagctcaccttgtagaccaggctagcctcaaactcacagagctccaccatcctctgcctcccaagtgctagaattgtaccttctattttttttttttcttgacattatgttgatggccaactatatggcccaaaatgcaatgaaagacaatgaaggaagagaggtggctctccagtccccagtcagtcttgaactcttaatctaacatggctcaagaaaatagtcctgataaatggccaccttttggttgcttctggtgaagatagcctattgtctcataaggacagaggggtgaaaatgctgttaaattagtggtgtgtttactcaagtcacatctgtaggtaaagaaagaccttgttctcaatgcttcccatttggtggagcagttccccgaaagtgttaggaagatggatggttttgttgttgcagcttgagtacaggcttaaagcatttcccaatctcggagaaaatagcttacatgattaaaagacaattcatggtggagttgtttcctgattcggtgggtggagcagggacactgatacccaagcttagaactgcctggaaagccagcttaggagggtttatgagaacacctggcctctgtatagaaattatgcctccctatgccctccagtgcagggcagagcctttaaatgaccgtgctgataaaaaatgccagagctgggtggcgaaggggaggaggaaggagttgaaatttagccagtgctttttctaatgtgcccatcagctcccagcactttgctgctgagctatctagtagcttctgaggtctctggctaaccttcataatgacctctgctgctgcgacagctgtatttttttcccgtgccctccccacctaccctggagggctggctaattcccggtggaccaagcgcaggttggactctagatactcacagcatggattcctgccctgaatcttccaggcctcaccagcggtagccttctgtgtctgttctaatgagcaaactgctcccccgacttgttctgagcactgtatttctagaatatgtggcaattgatattataaatattatacagacttaaagatctaatcccatgtcttctgctttttctttttcttttttccttgttttttgttttgttttgttttgtttttttgtttttgtttgtttttcaagacggggtttgtctatgtagcccaggctggcctcgaactcagaaatcctcctgcctctacctcccaagtgctgggattaaaggctgccaccacgcccggttcttttgctttttcatgtttctgacctgctccgttgcccttggctttttctgcagcccctttgttctcccctccccccatttactttctcctccaagacttctgctgaagcctgtggaagccatcacttccccgtgagaaacctccacaaacctctatcctaaatgcagactcagcatggctttggcctgttaaccactatagaaattctacacatttcccgtggagaaacttaaagagtttccacataggcctcctactcctgcactgcaaagctctctgtcctacttggagacagaacacaggatagaaaaacaccttgttcctaaaacaaatggaggtaattcagacagaaatgtttagagttggggcagaagctcagcttcagggagacccacgaggacagacaagagccccgggccagggagtaggttatttgataccaaagcctagctcactctctgcttgggacaaatggaatgaggtacttttgaaacagtcggggatgggcttatagtgtacttgtgagattttcagtggaaataattataggtcacttgtatgcgggacttaaatcaagaaaaagggattaggcaggtgtgtgtgtattttcctcttaattaaatatatgctgctgtgttagaccggctaatacagataatacagagctgctatattagaagggggtctctgcaataaaacaggaatagaacaaacagtataattttcatattgttacaagtttgaagtgaattagaattattaggtatccatgtcttattaaagtgtaatgagccaattatattaacagatattcctttgttgttgctgctgttgttttagataaggcctcatacatggccaaggccacctcaaattcatgacgaccctgctgcccttctcagtgctgggattgcaggtgtgtgccaccactcttttataaaagtgaaatcaaaatcctccatggtttcctgccagatcctgtttcaggtgagaggagaactctgggggtgtaggtaatgtaacagaccctaaggccactctggcagacttatactttattggggagacggtggagccaactcataatgtgacttggttgagaaaagcctgttccgttttgaagggtaatgttagaaatctgtggatcagttggtaaagtaattgcatgcaagtgtaaggacttgggttcaaatcctcgggaagcatgtaaaagaacttcccagcaaggcattgtggggcatagaaacaagtgcatccctggggttgctggccagccagtctcagagagattccctgtctcaagaaaatagggtggagagcaataggatgtcaagcatccatcccccactggaccctaggagttgtgagcttctgtgagtgtgctgagaacaaacccaggacctctggaagagcagccagtgctcttctgagccacctttccagtcctgaccaagagacctcttactgatggttcaatggtgttacttattactgctctgctgaaatgttctatttttgtggtttatttttggtaagatatatgtcaaggtatttatcgatttattctatgttatcaaaaatgttggtatatacttgctcatgaatgtagcgtatagtttaaaaatttttttttcacactaaactgggcgtggcactggcaagggcgatctcacccacctccatggccagccccaagtggcgatcttgctctggttcccagctgctgccaagccatcttcaaggccatcaaccccctgtggctagcctgcagaaagccaactacccctccctcagatcccctgagccccgtgaaatgctaactctagagacttgtaatataccagccagattgataagggtaaatctccgaccccaaaatgcccgtgaaaagaacacaaaactcacctgatataagtacaagctgcacgcctagactgggcacatgaaccctatattactttattgctcatctattaagttcctagcttcttgtggcttgtccaggccacatggttctggttcatctttttcctccatcttctctccatcctatatctcatctctccgtctcgtctctccatctctcttcttcctctttctctaaaactttcagctctgccttttccttccactgcccaatcacagactctagccttatctgaccaattaagatttcacctgacatcacctgagtatgggcaccctcttgagggagcagaaaatacaaacagcaatccttaacattttcccctttttgtccaaaccctttgtggttaagtggtttactttagtggtatgctttgattctttgcttattcttttgagtttctctagtgtagttttttttgtctgtaactacatgagccttataaaaccacctttaaaaaatatacctgttttgaaatgatatcaacatgatatgaccatacagacaagaaaagaaaccacaaagagaaaacagagaacttttaaaagttaggactttccctccattcatcctgcactttgaatttttgtcaccttgttctgcatctttttatatttctggcatatgggtgtaatgtaattattgttttggtttttacatttcatatcgaagatacgattttcacaccaggtttatcatgagcttctgagtttgtatagttattcttttttaaattttgttgctgttgttgttaaggttttatttatttttatattatgtgcatgggtgcatacacatatgtgtttcatgtgctttcctggtgcccacagaattcagacgagctaattagatcttctaaaacttaagttctaggcagttgtgggcagccatgtgagtgctggagactgaacacaggtactgtgtaagatcagcaagtgtgcctaaccattgagccatctctctagtcctcatgccattttatcagtgaggtgctttgtcttgtttaacttttgacttagttagggttactactgctatgatgaggcagcataaacacaagcaagttggggaagaaaaggttgatttcactgacagttccatatgacatcatcaccatccaaagcagtgaggacagggactgaagcagggcagaaacctggaggcaggagccgatgcagaggccatggaggggtgctgcttactgtcttgctcctcaggaccaccagtccaggggtggcacccccacaatgggctgctccacccccacccttatcaatcactaattaagaaaataccctgcaagtttgcctgcagcctgatcatatggaggtattttctcaggtgaggctcccttctctcagctgactctagcttgggtcaagttgacatgaacattccagcacaattttctcatattttcctctcactccttaacatgtctttcttttcatttgaagcattccatttggaatttttggttagacaaatctgggcaaactctctcaggctttgcctgccagacaggaaaagtctaacaagacctgcatctttccgttgatcagcttaggacagagtagggtaaaacacaccagacacaaactgcaaacagtgggggctatttatggggaaacatcctgggaatagagaaggagagatgtttattttagggaaagcagctgaaagaaggaaacaaaagatacttagcctaatggagcctctccattagccctctctgtccatgtagaatcccagggtgggcaacacagaattaatggcaaggaccattaaggactgtaagcgatcccacacacacatccctgcccttctgtggataacagagcaaagaccacccaagcaagtcaacatggtctatcctgagaggcacagagagcaagacacagagcaaatgtggttcagatttcactgggaatcagatagagctggatagtctcatattggggaccaaggtctgcacactagaggctggtctttctggcagttcagggcagactcgcacggatgatgggtacctacgcatacatggattggtttctctggcggtgccggggaaccacagagtcaagtgcatcccccttcatccccccagcaaaactgagggctactggatccaggtcaaaggcaagaaaggaaaggaagagactctgaaggaacggggagctgggctgagcagaggcttggcttggggagaggtgtcgcatgtagtttttaaaacaccctactgccttttcgccagtgaccacaccctgcgctctggcccctccagacttccttttgttccacacggcttagctatgggagggattgtgttaccagcccatgcctgagacccttgaatccaaagataaaagatacacagccagctttattactttagaacttgccttctagacacaattgctaggcacagataactcctgcctggaaagacacgcctttaccaatttattatctccatctctccctcttccctaaacctagtggcttgtatcagccaacatctttagccatccacctgtagcaaaagccaaaggtcctagctgccctaagaccttacatggatgctgccttcctgttccaaagtatggcagaaaaagcccctctatctttccctgcatctccttttcctcttgggacccagaagtcccacctgtatcttctgcccagcaattggctcccagccttctttattgacaaatcaaggaccaattagggaactagatctttagtatcagacccttcccttacagagaggctgggtagaaaggggagtcactaaagcctttcagaggaggatggagatgggaatgaatgggaagactgatgcagagatgcagggacccagatgggccccagaccaaaggccagcaagcatagtggtagatctcctcctggccctggtattaaggtgctctacttactaccccacagggccatcttcaaatacatggggcctgtaaggaagcggctggacttgatgtaggcagagatcttctccagagcctgtgagtggaagggaggcagcaaagctttggcttgtagcaccactgggctgagcagctcaaccctgtgaactccacgtgggcccaagacctggagcagagcagtcaggctcagcttcaagttccttttcctagttttccaccttaaggagaacattagatggagaaaccaccattgtgagggcttggtgtcctttagatagtataccacaggtttggaaaaacaaaacaaaaaacactcaatgattcttcaagctaagtcctaactgatcatttaccaagagaacacctgaaaaccagagaggttaagcaacttcttcctattcacacagccttgtcactgtctgcacaggcatattctttttccacagggaagcgcctgcctgtatttgcacatagaggaaggagcaggcaggaaaaaagaaaaaaagagttctcagaacatgcttgaaaaagagcccagatcccacccaatgacttagcagatcctgggttgaagcatctaggctagagggagtcagggcagggttctatctgttcccagagaacagaaagtctacatttctccacctgctatccaagtccaatattactatacctcaatcaagcgtaactctagctttaatataggaactatgctgaattcactcagcctgcgtgaattcttaccaagatgcgattcccaggttaactaactgctgagggattctaagctctaggactagctgtttgcaccaagccagaaccccaagcctcgggatataacttccaggtctccctcctccgtttctctacagtgataccagcccttgcagaatccccaaaactcttcaacttggaccagaagcagagctaaggagaactagctgagaaagcatatctcttgacagggagtggggaaggaaaatagattctgggcttagaaacaaaacattaagttaatggttcaaattacaaagtttctagtaaagtaggtttttagaggtgtcaaacccaggagcctggatgccaaatgagcagctgtgaggtgactttcaggcttggatctctggccccaggtgacactgggtacacctcacaatctattgtgaccaccactatgtgctatacttagtcccaggatgagagttcagggcctgtccactgagatctgacaatgtgcctcacatgaaagatgttgaaatagatgtatgatttcatctcacagatggaaaccggggcattagaagacaggagatggaggcaaagtttatccaccctaaaaaagataaccctccaaccagggctctgcttgtctaagtctaagcacggtctccggccctaagctcccacagtggggatgtgagaagcaaagtgttctgcaggtcagctgcaaagactcactgggtcgtaatgcttcacacgaaccctcaccttcctaatagctaaagccagcgagctgcttgcacgcttctgctacgctctgcttctcagaagggtcccagacaggaatccctggttgaataaacacttcagctttttatttcggcacaaagagaaagagccgttcaagtgccacctacacagaacaggcccctatgggtgggagctgagcccttgagcaagtgacacacccataactctctctaccttgtaggaatcctgtagtgacaaatttgctcttataatgtaagatgctgagtgcaggtcctcacagaaagccagtgttcaatacatgataatcagtctcttaatttaaagattaagaaatcatcctggaaaggggaaagggaagtaggtaatccaagaggaagtgagatcaaggcatcacctcaaagcggcccat

SEQ ID NO: 1094 - DNA, 912 bp, Mus musculus
ggagacagttcggtcgcgtcagcccggcccacagcgtccagtataaagttagccgcccacagtccatcgctgtatccccgaaggggctaagatcgcccaaaatgtcatccaagtctatggttctgggttactgggatatccgcgggctggctcatgctatccgcatgcttctggagtttactgataccagctatgaggagaaacggtacatctgtggggaagctcctgactatgatagaagccaatggctggacgtgaaattcaagctagatctggactttcctaacctgccctacctcatggacgggaagaacaagatcacccagagtaacgccatcctgagatacatcgcacgcaagcacaacatgtgtggtgacactgaagaagaaaagatacgagtagacatcatggagaaccagatcatggacttccgcatgcagctggttcgcctctgctacaattctaaccacgaaaacctgaagcctcagtacttggaacagctacctgcacagctgaaacaattctcattgttcctggggaaattcacatggtttgcaggagaaaagctgacctttgtggattttctcacctatgatgtcttggatcagaaccgtatatttgagcccaagtgtctggatgagttcccaaacctgaaggctttcatgtgccgttttgaggctttggagaagattgctgcattcctgcagtctgaccgcttcttcaagatgccaatcaataacaagatggccaagtggggtaacaagtgcttatgctgagccagagctcgctgctgctgagccatcttgccctgaggggcccacactcttagctcactgtcagtcttgttccatcctgtcctgagggcccccactctgtctcctctgctctttctaataaacagcagttgcatta

SEQ ID NO: 1095 - protein, 257 aa, Mus musculus
RQFGRVSPAHSVQYKVSRPQSIAVSPKGLRSPKMSSKSMVLGYWDIRGLAHAIRMLLEFTDTSYEEKRYICGEAPDYDRSQWLDVKFKLDLDFPNLPYLMDGKNKITQSNAILRYIARKHNMCGDTEEEKIRVDIMENQIMDFRMQLVRLCYNSNHENLKPQYLEQLPAQLKQFSLFLGKFTWFAGEKLTFVDFLTYDVLDQNRIFEPKCLDEFPNLKAFMCRFEALEKIAAFLQSDRFFKMPINNKMAKWGNKCLC

SEQ ID NO: 1096 - DNA, 26015 bp, Homo sapiens
  misc_feature (1)...(26015): n = A,T,C or G
aactcccacaatttagcctaaatacttgccctggcatgcttatactgatccaaacaagcatgaggtcatagcctgttcctcttccttatttgaaggtgtttttacctttctcagcattccacaagtgagttcccccttcctttgttctcctctgcctctgcctcttttaaaaagttctaagttgctagccaatcaggacaaatacagaatgtgaggtcccgttccagccagtggaaactggacacagcagtagggtggacacatcaagttataaatgaccctttctcctttgttcagtgtactctcgtggtaaaactgctggcgagtgtaccctttctgcagaaagtaaaaatggcctttgttgcaggaagtcagggaccccgaatggagggaccggctggagctgcagcagaggaacataaattgcaaatatttcattttaatatggacatttatcagttcccaaattaatacttttataatttcttatgcctgccttactttaatctcttaatcctgttatcttcttaagctgaggatataggtcacctcaggaccactgtgataattgtgttaactgtacaaattgattgtaaaacatgtgtgtttgaacaatatgaaatcagtgcaccttgaaaaagaacagaataacagcgatatttagggaacaagagaagacaaccataaggtctgactgtccgcagggtcaggcaaaatagagccatatttttcttcttgcagagagcctataaatggacatgcaagtagggaagatattgctaaattcttttcctagcaaggaatattaatattaatactctgggaaaggaaagcattcctggggggaggtctataaatggtcgctttgggaatgaatgtctgtcctatgcagttgagataaggactgaaatacaccctggtctcctgcagtaccctcaggcttactagggtggggaaaaacctggccctggcaaatttgtggtcagactggttctctgctcttgaaccctgtgttctgttgtttaagatgtttatcaagacaatacatgcaccgctgaacatagacccttatcaggagttctattttgcccttgtcctgtttcctcagaagcatgtgatctttgttctgctttttgccctttaaagcatgtgatcttcgtacctaccccctgttcgtacaccccctccccttttgcaatccttaataaaaacttgctggttttgaggctcgggcgggcattacggtcccactgatatgtgatgtcacctccagcagcccagctgtaaaattcctctctttgtactctttctctttatttctcagccagccgacacttatggaaagtagaaagaacctacattgaaatactgggggcaggttcccccaatatctggtgcaccaacatggttttctttttcctaagtgcatgtgggaacctgattccctttggtaggtgtggagaaacgatcatcagtccagtcctcagaaacgcttgttcggctccctgatgattggtgaattttctatgtattgtctcgggtaactatgggtcacatggagtctaaatattatgcttatctctgctatattaaactcctgttaaaacagggtggagtttgggtgcccatggaaaatatggtcaccctattcagggtgttggaagaacactgtccttggtttcctgaaaagggaaaattagatgtggaactatgggatcgcgttggtgcaaaattccaggaactgatcccatcaggaaattatgttcccttcactgtttggggtgattgggccttggtatgtgccatcctaacgacataccaatcccgtgaccccctgcagttaccacagttttctgaatctggcgaccttctacctcttccacagctttcctctcccactcgggcttcattatctgctcagcctctcccttcgcctactcctcccccacctaacgatattgaggattcaatatctaactccggtgactttggcttaatgtcacccccgatggtcttatttcttttcatgaagacctgatacttgtagctcccatggccctgactcggacagctctgcaccatatctatgctaactcttcccttttcaaatctttgcaggctttgcctccagagccatctaatggctccagaccaaactacaatttacctgtaattctgcaggccctcccccaccgcagcccctcaccctcctgtcatttcggtccctcaaccagtcactttgccattcactcaacctgcttctctgtacccttcttcacacatggacgcccctgccactctggttgcacaggatttcccaataatcaccagtatgcttctgtctcttctgctcccccaatgcccctttctcacactctcatactggtctgacctcctgaacctcagtttcccttatctacacatacttttactgtcacttctatgccaactccatctcatgtgcctgctcttgaaacttccatgcaatgcttattacgccagaacaaagaaacaagtggattagaggtgtgggcttatccggtcacgctggaacctcccaatgctcaaggggtacaaatgcgttgatatgcactgctcaatcttaccttttcaaaagaattcaaggatgcttgtgctcagtatggtcctgcttctccatatgttaaaatggcattacagactctttgtactgaggtcattttgcttccttcagaatgggaccttttggcgaaagctgttctaactccatctcagcatttacaattctgtacctggtggtcagaggaggcccgtctgcaggctcagctaaattgggttgatggcattctaattactcaggctcagctcacaggctctgataatcactctgacactaccgcccaattagactttgacgctctcaccacggaacaagtaacaaagttgtgtatgagagtttgggataaactaggtgccccaggccaagctcctgtttcttttactactgttaaacagggtcgcagtgaattacatcctgattttttggctaaattacaagatgctgttcaaaatctgtctctgatgattacgctcaaggtattctccttcatatgttagcttttgagaatgcgaaccatgagtgtaaagtggtcatgcgttctgtctaatgacaaaatttacctgatcacgaggtgtgcctgcatatattaaagcttgtgaaagcattggatcagagacccacaaagctattctgtgggcacgggccatgaaggatggcaatcaaactggcttgactgaattcttttcttggagcctgctataattgtggtcaacttcatcatacccaaaaaaattgcactgttaaaagcggccaagccagctcaacaaacatggccaaatgctcctgctactgtttgccctcattgtcgtaaaggtaaacactgggcaagtacttgccactctaagtctgatatagatggcaatcccttgccacagaaccagggaaatgggaagcagggccagtcccaggccccagtatcaaatgggacacctcagactcagaccaatattgtgtttctgcttcaagcggtcccaatacagcccccagcacaggcaaatttacctacagccaacccagatgggtcccagtcgcttcttctgtctcagtacaatgcttgtctacctccacagtagggggcagggcggtcaatctctgtagtaccactcctctaaatttactaccgaattctttgcctttaattgtccccacgggggccactggccctttacctcaaggtttggtgggcctggtgttaggtagggcatccacctctgctaaaggtatcatagttcatactggtctcattaattctgattcctctgatgagattaaaataatcgtgtctgccaaggttcctgtttccattccggccagtgagtcaattgctcaactacttttactacctaatattgttttaaacaaaggagataagacagggggccctgggatgggctctggcggtgaaaaagccgcttattggattaaagtaatttctaaacaacagcccacctgcaccatacatattaaaggaaaaaagtttgagggcctagtagatactggggctgatgtttctattatttcctctaatttatggccttcttcctggcttaaacatcccactaacatgggactagtaagggttggaaaagctgatgaagttcaccaaagcacatttatcttgccttgcactgggcctgatggtcaaaagggaacaattcagccttatatcatgccaatccccattaatctttggggtagatatttgctggaacaatggggggctgaaattaatattccacataactcttctcgtgctcccagtcaacatataatggaaaacgtggggactgttcctggactcagtctcggtccaaaacatgaaggaattactaaattcctttatggtttaaaagcataatttaaccactccccactcccaattccatttagcattgtttactttaaactttctaaatgttcctaaagacaatactctgactgcagccgaacaccattatacaggcaaaaaattctccctaaatgaaagcaagccagtgttatggaaaaactcccagacaaatacctgggaacctggaacaattataatgtggggaagagggtatgcttgtgtttcaccaggagatcatcaatcccctgtctgggtgcccactagaagactttaacttcgtgtgaatactgacaatgaaaaacacagggaagagatgtccacgtcagagactgccctcatacctggtgagatctgtgccaactcctcaaaaactggcacaccaaatcaaaatggatctcattcaatcctccctaatggcaacagagacccctctaactaatcccacttctcctaattacctttctttttctccttacaaacctgaaaatctcaccatttctattagcctgaaaataacatccctctgttcttctcttcctccttcagcactggatctcgcttacaataggttttatttaataattctactccttatactttctgtctcaccagtttcccctcacactgatttgcctgctacacaaaattattcttattgggcttatgtgccttttcctccacttattcgacctctcacctggatgaatgctcctgcggaaatctacactaacgatagtgtgtagatgcctggagctatagatgaccattgccctgctcaaccaggagaagaaggcactgcatttaatgttactatgggttataaataccctcctctgtgcctcggacatgcaactcgttgtatccatctagaaactcaagtctgggctgcttatcttctggagagattagctacaggaaaatggggacatttggtctccggcctctccctttgtcctttaagacaaatgaaaaggggagtaataggagataccccatactttcaatataaacctgtaggaaaactatgtcctaaaaattttgagggcccatctaaaactttaatttggggagattgtgttaactcacatgcagtagtattaaaaaatgactcatatgctttagtaatagactgggcaccaaagggctatttaaaaaacacttgctcctctgggggaggggaattcctggaggctacttattttatttcttattgggaggacgaggatcatcatcctactttgcataggtggttcggctcattctttaccttaaaatgggaagataaggacattaccctccacccccaaggccttgtatgatattccccattctgagcccagaacacccagaactttcgaaattggctattgtcatgtctggactgccagtatctgtgattctgaaccccatgataaatcccctttgaacctttttcctctttttgatgccgatcctcctttacgggactccaattggcattacgataattcttatcgacccaggtatgcccctctacttcttcagcatccccaggcacctcggtttgcttctttatggtggagaacatcgggcattgccaccgccgctcctctccctcagtatcaacatagattcaagcattctgctttgtttacctccaacctgactattcctatacagagttgtgttaagcttccttacatgctgttagtggcaaatatcaaaatttggacaaacaatcaaactgtccaatgcattgtcatttatacacttgtgttgactcccgttttgactccaggaaaagtgtaatgttggttggagctcgagaaggaatctggatactgtgtgccggaccagccaaagaatcctgtgtcaaaaccgagagaacgaataagccttcatcaccatggcacatttatataaaaagaaagggagagatgttgcgggaagtcagggaccccgaatggagggactgactggagccgcggcagaggaacataaattgcaaatatttcattttaatatggacatttatcagttcccaaattattactttttacatttcttacgcctgtcttactttaatctcttaatcctgttatcttcataagctgaggatatatgtcacctcaggaccactgtgataattgtgttaactgtacaaattgattgtaaaacatgtgtgtttgcacaatatgaaatcagtgcaccttgaagaagaacagaataacagtgatttttaggcaacaagagaagacaaccataaggtctgactgcgtgcagggtcaggcaaaatagagccatatttttcttcttgcagggagcctataaatggacatggaagtagggaagatattgctaaattcttttcctagcaaggaatattactattaatactctgggaaaggaatgcattcctggggggaggtctataaacggccgctctgggaatgtctgtcctatgcagttgagacaaggactgaagtacaccctggtctcctgcagtaccctcaggcttactagggtggggaaaaacctggccctggcaaatctgtggtcagactggttctctgctcttgaaccctgtgttctgttgtttaagatgtttatcaagacaatacgtgcactgctgaacatagacccttatcaggagttctacttttgcccttgtcctgtttcctcagaagcatgtgatctctgttctgctttttgccccttaaagcatgtgatctttgtacctaccccccgttcgtacaccccctccccttttgcaatccttaataaaagcttgctggttttgaggctcgggccggcatcacggtcctactgatatgtgatgtcacccctggcggcccagctgtaaaattcctctctttgtactctttctctttatttctcagccagctgacacttatggaaaatagaacctatgttgaaatactgggggcagtttccccgatagccttgctgaggaaattaaatttatgttcaagtgctatttctttatggaaccaaggaacaagtatttcaaacaatactaatgtaacagtactggttctatgtgtttcaaaattattattctcatgagtgttagctttcttaaaaaatcgtttttatcaattggatctagacatcttatctttcacagctcaagacccattaactcaaaatcataaactcttaatgcataatgagaaatataatgattcctagggccaggcacttgtgtctgtgctggtgctattgcctcaatgcaggaaaatctatgtgagaattcactgtgaggccaaaactgcttcctaaacatggatacctgccaggtatctgagctgggagtactgcccagtctggatgggtggggagtgtttgcaacaaggactgtgccttgccagcctcagtgacacagtgtccaagtgccccaacttagcagccacctgctgaccacctgatttctgtggcctaatagggatgtgatgaagtctacctgtttactcaaccccaaaccacacattatccaggtggtttgaaacttttttgatatactgggttcatcctctggagtcctaacaatgttttagctaatttacaaaaaaacaaaaacaaaaacaaaaaacaaaaaactactttttttgcagcacaacagcctggtttacattgcaaaatgatttctcattaaaggtctatcatctatttccatatatccattattatttgtaatatcctttaaaaaaagcagtcaaccccaggctaatccattgcacaactcttttgaaagtcttccttctaccttgaaagaagaaagttggcaggttggacattgttcttgcggaggttgtaccatgggtcacatatcacggtgtgacttcaaaggccactggagccaccgtctcatactgaagaacacacatgggtcaggagccaggtccaggtccggcatggtggatctggagaggggagagtccctgcctgtgatcctgtggggagccctcaggctcctctctggccaccatcctctgacctccctcctcagcaggacagggttctggcttctctgagggacaggttctgtggcaggccaggtgtcactaacacaggcctccataacaactgtttcagtactgactgagtgatgaaattaaatattaaaagctgaaaaaagccagtacctttatacagaggctggatgtaacaaaagcccaccaagagttttgcttaggcctttcctgggccttaaagcatgacaaaacaatgaaggaattcttaacaggacctatttagaattaaacaagttttattgtgagtctgaagaaactccccaggcctccacaaacaagtttactgggcatctgaaggaactccccaaacctccgtgatttagcaggagacaagataagggcaatcatcccccgcacctggacccatttagattaagtaaatagactgaggctccagaataaggtcctcaggacccagacctcagttacagattaaagaagttaatcacttatgtctttagatgaatgcacacttacttgtagacatataccttagaaggtatatatgctctggaaaactttgtaattttgagttggtctggtagtaatttctaggccttctccctgtaactggttgcagaaataaaacctctcttcctccccatttgatctgcatctcgttattgggcctagagaaatagcagccggaccctcagtttggtccgggaagttcttccatcctccctcgcctgctctctgtggccactgcactcactgttgctgttgctgttccggtctctgtgaggttcacctagtggactggctggacatttctagggggcacctcagatacctcaccaacttgctggatctgatccttggatttcgattcataaattgtgccaaaatacgaagtggctaatttacatagtacttagccagatgaccgaaggactcagtatccaaaggcccctaacagaaaacacagaccacatttcctttactctggcccttttcctgggggtccttcctataccactgacactgttcctgtgtaggcggggctagaggggagactaagccctcggagtagctttcggatcagaggaagttctgctcttacagtgacaggggctgaattaaattcccaggttggggccaccactttttagtctgacccctgcagccggagtctcccagagcccttgggaactcggcagcggagagaaggctgagggattccgcgggcagggaggagaagggagaagagctttgctccattaggatctggctggtgtctcaagcgcacagccaagtcgctgtggacctagcaagggctggatggactcatggagcctcagggcgggttggggaagctgtcgaggccgagccccgctttgggcttctgggcgccctgacctcgctcccggaaccctggggactgggaggcgggagggggcttattgattccagccccgggcgctcgctcgggggcctacagaatggcgtgtttcggggttgtggcgggccgaggggcggggtcgcagcaaggccccgcctgtcccctcctgggcctctcaaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctggcctggtgcagagaaagtcaccaagtcagggaccctccatctctgacccgagccgcgggccatctctcccagctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaaggcagaatgctggggcgggatgctggacaccctgtctaattgggttgggtgtccctcagagcttccctaaaccctggaagccttagccgttgtggggtccagagccctcagtgggattctttctccctgaaccctgggatgtgggactgagtggtcagattctagatccacctgtctcagggatcttgccactggctccttgggagggtccccgggaaggagggctgggctttggggaggtttgttttcacttcatcttccccaccacagctcctgattatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctttgcccttgcatatgggaaggggatgctggggagcctggtggcccaactgagcttccccggtttcccatctatccagctgccctacttgattgatggggctcacaagatcacccagagcaatgccatcctgcgctacattgcccgcaagcacaacctgtgtgagtgtgggtggctgcaatgtgcggggggaaggtgacctcctccttggctgggctgtgatgctgagattgagtctgtgttttgtgggtggcaggtggggagacagaagaggagaagattcgtgtggacattttggagaaccaggttatggataaccacatggagctggtcagactgtgctatgacccagattttgtgagtcccacaccccactcccagtcacccatttccctgccttttggcccagaccagggagggacttccaaagtcaggtctgtagcagactccggccagctgactggagacgtctataacctggttctccaaaatgtccacacgaatcttctcctcttctgaagattcttgtggacattttggagaaccagaccacggacaactggatgcaactggtcatgatctgctaccacccagagtttgtgagtctccccagtgagctgcacctggcagagtttggatttggggccaggactcttgcattcctgcacgcactggtcttttcttaagtccttggtaccactcatcctccaagtgctttcccatactatcagcagttattctcacgactccaatgtcatgtcaacaaaagcagaggcaattcccaccaatcttaggacacgatccaggcatcccacggtggaaattcaattcctagatggtaaaatttgtgttcagaatctccttcatctcctctggcctctggcctctgtcatgggtcatttctgtcagttgatttatatcacctacctgctcctagaatatacagactcaagtacaagaccaaggaatgtaatggcaccctcaaattgcatcttctcctcaaagttttccaagtgctgtcattgacatgcaccgggatctgcgcattttcataacagacagctcagaggcagccagagggcctttattcctctccctccttcctttcaacttgaacttctcatctccctggaaactagtcaatgttcattgttttcttctgtcaccccattagaaggaactttctacttctttccctgagctcctttagttctttgcatccttgattctgcccctgtctggatccagaggctgccaggtgctcgggcgctcatgcggctgacccagaggctattgggaggccagtgaggacagattcaggaagagcatctcattctgatcacttcagatagggtctggcacccagtcagagtctaataaatgctgatgtatccaattgaagcctgggcactgccccggttttagttgtggggaagatggctgcttgcctgtggccagcctgggccatctacagccctggggaggccacgtctgtgcagggagcttttgtctgagggtggtgacagctgttttctgcctcaggagaaactgaagccaaaatacttggaggaactccctgaaaagctaaagctctactcagagtttctggggaagcggccatggtttgcaggagacaaggtaaaggaggagtgatatggggaatgagatctgttttacttcatgtgtttcggggttttcagcccacacattcttggccttcttcagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaactgagaatgagagggtcagtcctttgctcagggtcccagagccagtggaggctgtgctgggctccctgtgagcctctggatctatgggtggcagtcagggctctcccatttgtgacaaaaggagaagcctcaggcctcatccagcctgggtttcacagcccagaacactttgaaagaggcagagcacttcaggaccacggatgcagctggcaatagtaggactgacacacagtggcattgatgttgagtactaaacctgcaggcagtattcatagccacccccagaagctttgcatgatcggacccccatgtggaaaatcctgagatccggagctgtggctggagctggattagggtacatatgtgggtgcccctgttgaagcagtgtgtgttgaagtgctctgtgctggggcactctccttctttatctttcttcctctctttttttccctccaatgttccacgtcttccccctgtgagatgagtagcacactgattttactcctattcaccgaccttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgaccatggagggtagtcgagtggattttctaagcctgtgttgtaatttctgttggatataaagcacccagcacagtgtagatctttcgtaaatggtagctgttattatggtataacattacttaaaggaagttggaagagttaacttagaagagctggggacctaagagaccgtgtgatgctccagcacttgagcccacatggaaaggctgtggccagggccctgacctgctgtgcctgcagcaaagctacttgagcccttctagacagcagacctggctctggccccttcttcccgccctcagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgtaatcatggtacttgtttttcacccaaactcaatcataaatttattgaagagaaaagccatgtcttactgaactttttacctcgagtatcattcacagttcctgaaatacagtaaatgtttaacacatgtgaaaatttgaaagaattccctcaagggaagattctgccaacctgtacagtcattattgggatttagagctctggatatagttgtattaaccagagaagatataggataacgttcagaagattttacatgtacgtgtcttagagaatgagccagcagctctctgtaacttcagctttaatagctgctagctgtcctttgaatagcttaacctgagatggggcagcctggtttgttgggtcacacagtagcaatctgtgtggtcagcaggtgtcagtattttatatgaagtcatctgcaaaggagcaggactcattggataaccatctgatgagcaggttcctccaacagtggctggatagtggagttgggccttggtaaggcccagccttgagatgtagcccagaacagggagattttgaggagagtcttgtggggccattgtccagatgatcactgcctgcagctgcacttgaaaagggagcaataggtgtaatgttaaggacattaagaagtaaatgactaatttgctgggcacaatggctcactcctgtaatcaatcccagcactttgggaggcccatgctggtggatcgctttagtctaggagttcaagaccagcccaggccacatggcgaaaccctatctctacaaaaaatacaaaaattagctgggcatggtggtgctcacccagttaggaggctgaggtaggaggatcgcttgaccccgggaagtcaaggctgcagtgagccaagatcgcaccactgcactccagcctgggcgacagtgagcccttgtctcaaaaaaaaaaaaaaaaaaaaaatttgagcaaagttagaatcttatgaaactggtaagaaaaattagttgagccaaatatttatgaatgcttaacttcaatacagaagggataaaaataaaaaggaaaaagtaatagaagttaggagttaatactatgataaaagataagtagacagtatgaaaatattagacgagtaaaatagacatagatctagaacagatgtcagcaaacactttttgcaaagggctggtagtgaacattttaggctttgcaggccaatgggctctgtcataatgactcagcgttattatcatagtgtaaaagcagtcatagacaatacataaatgaatggtgggacactgcattccaatggaactttatttacaaacacagatgactgcaacaaaacaaaaaccgaacaacctgattcaaaagtgggcaaaggatttgaatagacatttctccagagaagatataaaaatgtccactaagcacatgaaaaaatgctcactatgactcatcattagagaaatgcaaatccaaactataacgagatgccacctcacaccggttaggatggtattgaaaagcagaaaatcacaagtgctggtgagagtatggagatactggtgcactgttgtgcactgtcggtaagaatgcaaaatggtacagccacagtggaaaacagtatggcagttcctcaaaaaattaaacataaaattactatatgatgcagcaattcaatttctgagtatacacccaaaagaactgaaagcaagctcttagagagatacttgtacacccatgttcacaatagtattacacagctaaaatgtggaagcaatccaagtgtgcatcaacagatgaatgaataaatgaaatatcatgtatacatacaaaggagcattattcagccttcacaaagaaaggaaattctgacatatgctacaacacgggtgagccttgaggacataatgcaaggtgaaagaatccagtcacaaaaggacaaaaactttatgatctcacttatgttacatagtcaaaaaacatctaaagagaaagtaggaagctgattgtcagtggctgagagaataggaaaatattattttaggtgtatagaattccagttttataagatgaaaggagttatggagctagatagcggggatagttgcataacactatgaatgcatttaatgtcagtgaattgttaacacggttaagatggtaattttgtgttatgtgtatattaccacaatataaaataatacaaccaaaacagaacaaaaaacagcaggtggtggtagttttctgattcctgatttagaagctcaaattaaaagtgcatagttatattaaaggtaaaatattacatttaagatttgaaatgtgattatcaaaaacattaactcaatcctttaaaaagggggaagatgtggtaaacaaagagaattgcaaatgaaaatgattttctaaacattgtggtcaaaattataaaagataaaaacatacatacattctaaagtcagagacagaagtagtataacctatatacctcacactgagccaccaaaaaggataatgtaatggtggctagtacctagcagaagtcctggaccgtgagattgttcggtgcctcgtggcagtgctcatacggtgttcagtgcgtctcccccttctattaacagaatagaatcagaaaatgagatgtgctcagaaaacacagcagcctgtgttggcggcttctgcattcatctgtaatcatctgttgttaattacaacttctatgccttatatgtacccattacccttgtattagcagaaaaagatgaagctgaaagagaccccaagacagcagcttatagaaaacagtttattctccttttgtgtaacagttctacagggaagactctaggttgttgggaagccgtcctgctccatgaagttactcagggactcgagctccttccatctcgtgcctctgtcattccttagggtgcttccttatctccttggttagagctgtattgcccaagccaaggaagcgacttcctattatgcaagtgaggccgaagttgcccacatcacaaccattcacattccattggtgagattcagttgtgtggctatatctagttgcaaggatagatgcatattataatggaacaatggattttggtagccagttacatctctcccacatccagaaaagtagagataaaggttaattaaacccaagtttaggagaaaccttgggtttgagacagtgtttcaaagcaggtaggatagaggctaaggtattaaagataagatctttatcttctgctagacctgaggtgggtggcatatcacttagagttccttgttgctaaaacagcaaaagaatttattagctatatcaggtagttcactgaatccccgggagggccagggagttggccttggaacctgggtagccaggaaatatgcctaatcatatgtgggattattctagagaaggcaacacagccattgctgggcaccaacaccagaacccctacccatgacatgtggcactggataccagtctcaccactgctgtctccaaaatcctgatccctccacctctgcccttctcataagaaaacaaagaagcagggcttgcttctttaaaactgaagtcttccacaactgtgtgcaattaacagagtctggggcagaggacttcgcctcagccacaagggaggctggaagatcaagtggattagttcacattaagttctgctatatatagccaaataatagcagtggcttaagtaggacagacttctatttctcatgtaaaaaggttttttgaggcagacagttaagtgctggtaatgtcagcttcacaatggccttagtgacttagcttgttaactttatcttcagcatgtggtttcccttctccatgtcacctctttgtccaaagtggttgctagagtccaaccatcacagctgcattccaaacaacaggagggaaaaagaggaatgggagttgctccttcccttttaaagaaacttcctagaaataacatacatcatttgtgcttatcatcattggttagaacttagtcacattggaaatgacatcttttgtctgggaagtaatgtgcccgggagaaatgaagattctatgacaaaagaagatagggagaatggatattgggaaagcagtcttctacctcaggaaggtgagacttctaatgtgagaaattccccacctataggaagagtgttaaaaagacgcagatgagagatacctgacaaaagcattatttttctatatgtacatttccatttattaccgtaacagtcactactataaaatgctcctgcttaacatatgcaaccatgccttgtacaaatgaaaacacattcaccctctttctcctaaaacagaaattaagcaaagtgtcatttcctgcatccacttccaagtttggaatctgtgggtaatgttcatattgatattttgaaaacgagagactaaagtgtaaagttaataacccccaatttgggcagggtgtggtggtacaggcctgcagtcctaactatcctagaggttaaggtgggaggatcgcttgaggacagaagtttgcagtgagctatgattgcacctgtgtataatcagtgcactctagcctgggcaacatagtgagacctcatctctgaaaaaaaaaaataataataaaggacgaaagaaagagtaaaaacaaaccccaattcaccctctataaaataacaaatgaaatgggaagtggaaaaaagggaaaaattaggtaagcctatatgatacagtagaaaacaggctgcactcagatttgcaaataagctgttttgcatttatttacaatgcttatagaatgcacttctttggtgaagggactctgaagagatattgcgtaataagacttatatactaagcattgatatgaacaacccaaagtcactccttggattggctcttgtctccatccctctgtgaccccactcaggtttactgtcatcccactttgttaccctacattttttaggctcatgtggcttgtgtggaatggtgagggaaactcttactgatgacagagacacagagacagactggccactaccacatggtaacctgagacttggaagcagtgagcgagagtggtccattctgatgggttccggaccaactctctctgcaaatgttaattgtcatactccttgtaaacagatctggttttccacagaggactccgccttttggaatagccccaacaaatcctctcaaagcatattctgtccaaaaggcccaacagacaccctacattccctgcatacctttagttctcttccagttgaaacataatttttttttttttttttagacaaggtcttgctctgtcgcccaagctggagtgcagtagtgcaatcatggctcactgcagccttgacttccttgggctcaggtgatccttccacgtcagcctcctgggttgctgggactacaggcacatgccaccatgcctggctaattttttttcctgtattttgtagagatggggttttgccatgttgcccaggctggtcttgaactcctgggctcaagtgatttgcctgcctctgcctccctccacctcccaaaatgctgggattacatgcataagccactgcgtgcggcctgaaacataattttggaaagaagcagatagggtcttggtcacagttcaaaaagagtatctgttaatataattgaaagtgttgtactacagaagataaagtacaggcctatttaataattctaattttccttcaaacttccaatacaacatgaacattattagctggtgtgttctattcctattattttgcatcatggaaaacatctcctgcgaacactaggttggcccgctgtctccaagtcaggccacacagaagcacctattcatttaaaattcaaatatacccacacccatttaatcttttcttccagatttaagtctcacgtgtcagttatctgtaattatttccattgtaaaccccataagaacattaagagccaatccctgttagttttcagaaatgtttcatttcaatttggcctaagcaaggaagaaataagccagaccatgaacttgtaaacccagaaaatctgggagaggtccaagttaaatcagaaagtttattttgccaaggtggaggatgtggccatgacacggtctcagaaagtccttgacaacatgtccccaagatggtcggggcacagcttggtttgtaaatatatataaaagctatggcttatcaatatatgtaaaaagcacattggttccatccagaaaggctggacaactcgaagcaggtgggtgcttcaagttgtcccacctttccagaccaaaccaatgtagttctttatacatattaattgatgtttcatgtctgtctaaaatgtataaaatcaagctgtgccctgaacacctgcggcacatgttgtcaggacatcctgaggctgtgccaccggtattcatcctcaaccttggcaaaacaaactttctaaattaactgagacctggctgggcacggtggctcacgcctgtaatcccagcactttgaaaggctgaggcaggcggatcacccgagatgaggagtccaagactagcctggccaacatggcgaaacctcgtctctactaaaaatacaaaacttagctgggcatggtggcagatgcctgtaatcccagctacttgcttggtaggccgaggcaggagaatcgcttgaacctgggaggtggagattacagtgagcggagattgtgccattgcactccagtctgggcgacagagcaaaactccctctaaaaatgaaagaaaggaagggaagggaagggaagggaacggaggggagcgggaggaagtgctgcatcattgtaggaagttcctccaagtattctggcttcagtttctcctgaggcagaaaacagctgtaaccaccctcagacacaagctccctgcacagatgtggccnnnnnnnnnnnnnnnnnnnnnnnnnnnnnnnnnnnnnnnnnnnnnnnnnnnnggaagggaagggaagggaagggaagggaaaggcaagggaagggaagggaaggggaaagaaaggaagaaagaaagaaagaaagacagcacctgtctcggattttctggaacttgtctcacattttctgggttcacaggaggaatctcagataagactgttttaaagctgagctcagccatggcatttgtgccattaaatacctatgagttgggtgatcctctccccttgaggttccaaagtaaacttggggctcctgggcctgtcagaaagtgacattctttacctaccacaggtggacaaaactatgagtccagtttcccaagtggctttattggctccataaatcaagtttgattccttaaaggaaagcataccattcaagttaaagctttggtaaaataaccagtttctccaactgtgtcctgttacaaatgaaaacagattattattgtgttgggaaccgaaagcctgagggttgtgacccactcagcattccactgaaggctatatgatcaaacagcaaactgtttatcatgaatacagaatgtgagcaaacttgcatctgtgcctgccgccagaaggtatgctgagagtaatcactccctggtgccgtgctccttgaggttatctactgggacatctggagcctactgttcaaataatgcagtcatgcagacctgcactaagtcaagcagctgaccacaaccatccccttctccctatctcctttactcaataaatatgaaggactctaaaagctcagggcccttgttcactagaagcaaggagtcccctgacccccttcttcaaaacatactcttcagtctttgtctttattcccgccttggtcctcctttgttcagtccagcaaggtccacagcaaagtgctgcccgaaaacagggtcttgaggacatgaacaaagaaggtctgctggagcagaggaagtgaaattgaccagatgaacagggaccctgggatgaatctgctggcagtggatataaggtcagtgctctaaagaagtactgggaatgggaattttctgaatcagggtaacatggggcagaatttgtctcttgaagaaaaacattatgtgcagttgcttaaagttctgttgaaatagcctggggctcaagttaattcgcaaacattaactaagcttctgcaggaggttattatgcataacccatggtttctgcaggcaggcaatcttgatgtggaaaattgggacagaataggagaaggattgaaacgggctcatcaaaaaggtcttaaagtagacccttctgttttttctgcctggggtttggtttgcacaatcctactgctgctgtctccttctaattctgtcggacaacaggagtcaggttctgagtctcaagaattaaaaagattatttattcctctgacagcgcctattgaaaataatgagcaggagaaaggggaggagatttggccacttgctacgcaggaaaaaggagaggagaactggcctccgccaccccctccaataacagaagcagaaacccccatataaaaaatgttgcgtgctgctgctatggctggtgaacctttaggaccttgcgcttttcctattactgtaaggcctgatctgaatgacctacaacatcttttacatgaacacactcttgtagagtttaaattataaaagaattaaaagctagcgtggttaataatagagggcaaagcccatttactatagggctgttagaatcagtgtttggagccatgtgccttccaccctttgatataaaacatttggctcacactcgcttatccgccagtgcgtatctgacatggagtttaaattggcaagaaatgtgagcagaccaggctaggcagaattgcaccgctggtcaaggacacattacagaggaaatgctaacatgtagtggccccttttcagatctggtataacaattaacactcccagaggccacttaccaccagtctgccttagccaccaaatgtgtctggagcacaattcctgaagagagagttccagtgcagacttttccacatgttatgcagggatcacgggagccttatgcacaatttatcgcgtggctgcaagaggcagtgcagtgtcagaacaggaggacaggggattgatctcccaagggaggtcccccgatccaagtcacggcacctaatgtcatgcgcatccatgtgaggagaccactaaacaggctttgtgtgagcaataaagctttttaatcgcctgggtgcaggtgggctgagtctgaaaagagagtcagcaaagggagttttggggggggcagttttataggatttgggtaggtagtggaaaattacagtcaaagggggttgttcgcctgtaggcaggggcgggagtcacaaggtgctcagtgggggagcttctgagacaggaaaaggaatttcacaaggtaatgtcatcagttgaggcaggaaccagccattttcacttcttttatggttcttcagttgcctcaggccctctggatgtatatgtgcaggcttgggctcagaggcctgacagtttagataactaaatgtatatcataaggtacaaatagaatgtctggtgagctagagggaaattaaaaatggatttatttgccaattgaacataaaattatagaaatttatcattggattgtctaaggagaccaattttatttagataggaactacctatttttttaactggatctctgagttctgggtagaacccacaatgaatcctgggtctccaaaaatggagaattattatgaggctagaacatatgatgcttttacagtgcacttaaaattttttttttaaacaaagacatgtctaagtgtctaaactacattcttccttaactcaagagtagcctctgttgcaataaatattttagttaaaaaatcaggtgaaaacagaattcagtcaactcagaagaaaaaaaacttttgctcaaaaaaatacaaggttctagaagagaaaaacaaaaacaa

SEQ ID NO: 1097 - DNA, 1555 bp, Homo sapiens
caaagtctgagccccgctccgctgatgcctgtctgcagaatccgcaccaaccagcaccatgcccatgactctggggtactgggacatccgtgggctggcccacgccatccgcttgctcctggaatacacagactcaagctatgtggaaaagaagtacacgctgggggacgctcctgattatgacagaagccagtggctgaatgaaaaattcaagctgggcctggactttcccaatctgccctacttgattgatggggctcacaagatcacccagagcaatgccatcctgcgctacattgcccgcaagcacaacctgtgtggggagacagaagaggagaagattcgtgtggacattttggagaaccaggttatggataaccacatggagctggtcagactgtgctatgacccagattttgagaaactgaagccaaaatacttggaggaactccctgaaaagctaaagctctactcagagtttctggggaagcggccatggtttgcaggagacaagatcacctttgtggatttccttgcctatgatgtccttgacatgaagcgtatatttgagcccaagtgcttggacgccttcctaaacttgaaggacttcatctcccgctttgagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgt

SEQ ID NO: 1098 - protein, 218 aa, Homo sapiens
MPMTLGYWDIRGLAHAIRLLLEYTDSSYVEKKYTLGDAPDYDRSQWLNEKFKLGLDFPNLPYLIDGAHKITQSNAILRYIARKHNLCGETEEEKIRVDILENQVMDNHMELVRLCYDPDFEKLKPKYLEELPEKLKLYSEFLGKRPWFAGDKITFVDFLAYDVLDMKRIFEPKCLDAFLNLKDFISRFEGLKKISAYMKSSQFLRGLLFGKSATWNSK

SEQ ID NO: 1099 - DNA, 49502 bp, Mus musculus
  misc_feature (1)...(49502): n = A,T,C or G
ccaacactatcacacctgtagtaagaaagtgactaaagccttgtaggcggggccctgacctagcagggctagtgcctttgtgagaagagatgccctcacacactccggtggcctctcctctttttttttttccttgtggtgctgggggttgaactcatggtttttcacactctggatctgcccaaccagtaggcagtctgtccctcccctcctgtcctttgtcccatgcaactcaaaggaaagatcacaaagaggaccataccagaaggtagcaggcagccattggcaagtcctgttggcacctcaatctcagaggtgaaagtttcaacttctgttgtttaagccgggcactgtgtggcgtcttgtgatgccagccggagctggcaaatatgcctgccaggccaccaggatcatgcttactcaccatggtcaatcgtctggaaagctacacattctacaagatgcaatgcgattacaaaccggcggctctttggaagttgaaaactccttcagtggaaggaaggtgcctttgacgtatttggtatctgaagattagcgcccctcctctcccgccttagacaccccaaagcgcgtgcattagcctgtggctgagcaaaatcgtgcaacacaacctattttatagcaaagggcagaatttcttacataggtagtgagtacttccttctaagtggaaaagtaaaccatttgtacattttcacagtattgtaaagtaagcgcgtgtgcacgcacacacacgacttttatgataagtcatatgcttttattatttaaaagacaatgaggattgccttttaaccctatcatctaagaaggtgtgtgaatctattctaagaccggtattagttaccaagagcagattcactagatgtggctctctagaaaaagatattgagcctggaaagcggttggaaaagttacacccaatagttggacttcggcttttgaatccctcagtgggaaagcatttactgctattcaagtggaagatttggcgacgctgggtttaccctcctgaacttatcacacttcaaaagcatgagggagtttcatttgtcctgtgaataaaaaataaaattaggtcaggtgatgtttgaaggcttggcttccttcacaagtgcatttagtcaccgagcagtcactcagaggggaggtatggccccgtgagtgacctgggagacatttttcttttctttttcttcttcttctggaaataccctgaggtgccatctggattctgaccattttccttcttccacatggtgttggctggtctcttcctcagctctccttgcaaagttagcccatccatagactccaggactctggccaagacactggtaattgtggctgttcttagatctacctgtgcctgctgcccatccaggtccaagttttcctctcaggtggagcacagatgctccatgtgcaacgagcccaacgcttccctccatccttcatcattctgttcaccggtcatcttgtgacagagttttagcatgtagccttgacgggcctggaattccctacatagaggatggcctcacacttacagtaatcctcctgcctcagtctcctgagcagctgggattgcaggtgtacaccaccatgccagggcttgctttctcttcatgaaaggcttccatttggtccagtggcttcagccattttctacaatcacggtagactatctgaagacaatttggacaatgcaaaggatagatagacagacagtctcgactataattgccaccattgggtcctacttttctatcactgtaataaaacactattaccaaggcaacttataggaagaaaggatttatttggacttatggtcccagagggataatgttccatgatggtggaacagaaacttagtggtaagagcaggaagctgagggttcctatctcgaactaaatcaaggagagagagagagagagagagagagagagagagagagagagagagagagagagaacctgaaacgctgcttcaaagcctgcccaagtgacatatgccctctatcaagaccacatcatccaaacagtgccaccgtcagggtctcaaatgcccgaagctacagaggacatccccttcaaaccaccacatacagcaaacatagtaaaagcccagcttcctttttatgtgctgtgtgcttatagatgcaatttagttaacagacctgcctgggatcagatcaaggaattcacgtttcacttgtgtatgctacaggtgtctgcttgcagatggtgtgctatccttggataatacacttactgaaagtgctgaccccaatagcaagtggctacgctatggattgcagtgtgtgtctgcatgatctaattgtcaaggtctttgacgaacgccgaagaaaacctgtctgggtttgggatttctgtgccccatgagcaggacaggatggatccacaggatgagccgactcgtgtggatgaacccgaactctgaagaggttcttttagggaggtctgaggtgcttatgaagataactctgatctgcccttcccatcccagactcccacatttactctggctactctttgaggatttgaaatgagagtcagggagatggctcagtaaagtgctcacctttgcaaacacaagggcctgagttccacatccaggacccacataaaacaaatgacaaaacccagcacttgcaattctagaactggagagatggagactggtctgagactcattagcccaggctgtttagacagttccaggccagtgagagaccctcaaaaaagaagatgctcagtgcctggggggtgccatgaaaggttgtcctctgttccccccccccagatgccctccacctgtacatagcacatttataagcatgcacacaaacatacagacatgcaaacagaattggagacttatgcgaacttcctcataaacaatggggttcaaacgtgattacattgttcaatgacataaaatatagtagttcccatgaagctcaagaggaaggaagaccaaagagtggatgcttcagtcctacttagaagggggaacaagataatcaagggaagtagagggagggagggacttgggaggaagagtgaagggagaggggaaaaagaggggcagaatcaggtataggaggagatggtggagatgtacagagggccaggaaattgaacagaggtgtgtagcaatggggaatggggaactgggggtagctaccagaaagtcccagatgcctggaaagcaagagcctcccaggaccccatggggatggcattagctgaaataccccataaagaggagggaaaacctgttgagaccacatctagaggttaggcatggccccctggttgacagatggggccacccaccaatctgcaaaattttaactcagaattgctcctgattaaaggaaatacagggacaaagagtagaacagagactgaagggaagaccatccagagactgccccccccccccccgggatccatcccacatgcagacaccaaacccagacactattgctgatgccaagaagtgcttgctgacaggagcttgatatagctgtctcctcagaggctctgccagatcctgaccaatacaaatgtgaatgctcgcagccaaccattggaccgagtccaaggaccccaatggaggagttaggggaaggactgaaagagctgaaggggccttacctggcatcaatgggagggaaggcccttggtcctgtgaaggcttgatggcctagtgtagaggaatgctagggtgatgaggaaggagtgggtaggtgggtgggtgagcaccctcatagaagcaggatggggggttgggatagggggttttcagaggggaaaatgggaaaggggataacatttgaaatgtaaacaagtaaaatatccaattaaaaagaagaaaaaaaattagtggtttccttttttggtatttttagcttagtaaatatccagatatctagagttctttcttcctacaaaacacctcaaattgttgaattaaatataaaactgagcaagagatagcttggctggtaagaagataatattcagaggctaaaaataatgaaaatttctcacacaggggacaaatgagtgacagagtcagccccagccatgggcgtgtctggatctacctcacacttgcctgggaatgcagagtctgggagaccatcggactaagggccccagatcaagaccaactccttaggaagtgaactgggatagcctgctccattgaaagaacatccaaagctgttctggtttgttttctattgctgtgataaacaccatgactaagtctttcctgtttgggttgtgactcgtggtagaatgtaagttaaaaaaaaaaggaaaggcagccttcaggtgcacaaaccagtctctgttgtgtgatatctacctatcgtctatctacatatcatctatatctattctctgtcatctatctatctatctatctatctatctatctatctatcatctatatctattctgtcatctatccatttgtcacttatatctgcctacctaatcatggggtcattctcatctacctacttatcatctatatctatgtatctatcatttatcatctatctgttatctatctacccatcatctatatctgttatctgtaatctatctatcattatatatgtctactatctatcatctatctagcattatatctgtctactacctatcatctatcactatatctgtctactatcaatctctcaatcaatcacctatcatctatatctgtttatccatctatccgtcatctatctatcatctatatctgttatctgtcttctatctatcactatatatgtctactgtctattatctatctctctatcatctatgtctgtgtactatctatcatctatatctatttatcatctatctatctatctatcactatactatctactagctcatctacctccttacctattcatccacctacctattatctatcatctatctacctatgatcatctatcacttatctgtcatctacctatcagtccctatataaaccagacattaggccacagcacaggtagatcagaagtgcccaggccagtcccagaaaaaagcacaatttgtctatggaaaaatatattccaaacaaagataaaattccaaggaacatgaatttgcaaccaaagcttacaaaacttatggaaataagctacacggagagagagcaaacaggggctgcaacgtccacatacctatgtgatcaaagccatattaaccacaaacctaaaggaagcaaccagagtgtggtgaggagctggacatggcggccaaatgtgaagtcacagcgtccggggcggggcagaaggagtcgtgagagttcagggtcatctgggttatgtagcaaggctttgtcagtactagtaaagacagagacgataacaagattgaatgggatgcggctcacagatgaatatgtgcttaggtgtgcaaagatcctggattaatcccaacacagaaacacaaggaccacacacagctcttcagttaacagtgaacaggctggcagctcccaccccacgcgcacacacacacacacacacacacacacacacacacacacggctcttccctctcaaatttgtatgcttctctataaagccactaagttcactatatgctcctcctctgtgtatagggacaactgctagagcctgggcatcctatccagggtcaccagtctgaagaaaatgaactccctcctccagtggccagctgctgccaatagctcctcagctaggggtggagattgtaagcccctcctccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgacttgtgagtctctattaaccaccatctattgcaaaaggaagcttttaagatgagaacggccttaatctatgggtgcaaagggagaggaacactgagttgtcttcttggacaaaaggtgcagtttctaaaaaggcatagcgccaagaagtcaatctgtctcccatgtgggaaggtttgaaaagaatgcttcccctgtgtttctcatctacatcctcaactggatgggtctcattggagtcaccaaggagacctaccgatagacatgtctgcgtccagggaggtttggctggggtgaatgtggccagtaccatcctataggctgggattcaagagtaataaactaaaagggggaaaggaaagccagctgagaggtgttatagcccatccctgctgtgtgtcccagctgtgtgcttctgaggacgcaagccatgcccaccctcctacctccctcccctgctgtgatgggctttgcactcagaaccgagagtgacagtcaatgcttctccctctgagagtcacagacgcaccatcacaccatcgctgtcgttagacagaaaagcttgttccgacaggcaggaaaccgagctcactgctggctgctgctgtccgataacacgaataactaatcaccatcctaccttacaatttctaaaatgctgccaacagttcatcggtgtgtttcaaaggcttgccagtttgttagcatcatcttcgcgctgacttacgacaggacaactggtcagacctggaaagtaactccatgtgttttatctcagagtctatggctttcctgccataatgtcacatgaccagaaccacaatacagattgggggtctctttcccaggggcagggcttcgtaatctcctgatgcttaacaaacgattgctgggccttaccccttagtgaacccaacccagctcactgcttgtgaatttatagttttatttattttacttttaggtagttccctggaactggagttaccaatggttatgggacactgtgggtttggaattgaacctgggtccccgacaagagcaccacacactcttagtggttgagccagtgtctctagacccaaatctgtttttttaatccctggattctgatgtatggccatgtttagaaacccctgaaatgaaaggccaatacaacagtttgtgtgtgtgtgtgttttttaaaccagtataactttgatgtttagtttaaagactgtaattggtgtgttttagaccaacagacctgaaactcttttaaagattcacttatttttattttaagtgtatcattgtttgcctgcatatgtgtatgggcacagcatgcatctagtgcctgggaaggccagaagaggacataggatcttctggggctgaagtcacagatggttgtgaaccaatatgtaggcgctgagagtcgaactcaggtcctctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctatgccatatataaagctagccgtgcatggcgggggggggggggggtgaggagcaagccagcgtgaagagcatagttctttcatgatttctccctcagctctggcatggcttcctgccccatctctctcccgtgagactaacctgtgagctgggatacttcctttcctgccccgtctctctcccgtgagactaacctgtaatggcttcctgccccgtctctctcctgtgagactaacctgtgagctgggatacttcctttcctgccccaagttgctctggatcagagtgttgctttacagcccaggaagtaaactaagacaggtggatatagcacttatgctgtgtagttttgtatcaacatggcacaaactaaggtcatttgagaggagggagcattgcttgtgaaaatgcttccctccacaagatcttaattggtgattgatgagggagggcccagcccagtgtgggttgtgccattcctaactgtgatagtcctgggttctacaagaaagcaggctgagcaaaccatggggaacaagccagtaagcagcacccctccatggcccctgcaccagctcctgcctccagattcctgccctgttttgagttcctgtcctgactcccttccatgatgaacagtacaagctgaatcaaccccttcctctgaaacttgcttttggacatggtgtttcattgcagcaatactgaccacaagtaagacagcagtagtgcatccgagctatgcaaattacctgactgcagtggtttaagacagcaacattgatcatctaacaatgctggacaggtcatgggtctcgctggcctgcgttcctggaaggggtagaggagaagacatttctctgtccccagtttttgaagctgcctggcttctttacctcatggacccttccctccagctcccaagctagcggtgatctggcttcctttgtcacagcccttctgatgacagctggaagaggctcttcacctgtaaagatccccgtgtttagactgctggcgagtggataactctggaatgtgcacccccccccccaccccaccttgcctaccctaggctttgactgttgttgtaaggataagcctgattagaaagaaaaagataaaggcgtcgtgtgtgtttagtatgaatgagactttggaagtggagagggtgggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaccggcgccggagggctccgcgcgctgctgctggcgctggtggccgcgggggtcccggccggcgcctacaacctggacgcgcagcgcccggtacgcttccagggcccctcaggctccttcttcggctacgcggtgctggagcacttccacgacaacacgcgctggtaagtgtctcccgcggatcctcgaccctggcgtgggcaccccgtggtcccccaagttggccgccgcctttccggcctcttccactccacctcccgcggggccgatttaaatgtccgggcggccacgctgacatcctggcctgctctccgaggcccggggcgtccctggggtccctgtcctccctgggcagtcagacgcagcttcgctctcgccaaagcaaagttacttggctgtctgccttccaggggccaccgcgggctggccatctgccccagatccccggggggcccctaggaggccaggctgctcttggggaccacttcatgtaactctagggcagcagcatgcaggaagcagagaaacaaggggtgtggtgggagtgggtcctggtggcttaggaatctccagaagaggtacccaggggccccacaaagttctgagaggatctgggatgcagagaggacccccaaggagcagactgtgtggctggtgggcagcctggagctctcccacgtgtctagagacaagatttaggaagctgaagtttttaatcaaggggtacagttttgaaccagcgagatgggtgggcctgcagaaaagaataagtctctccctcattaagcatcaatagtgaagttaactgaccccacagcaggagcgcttagagaaggcggatagaccacttccttggaatgaacgagccacaccatgcaccacgcccacctattcaaggcagctagagttcagtagctccccagcctcattttagatgatgttactgtggacccaggagatggctggttcacgttgagggtgctatcccgtgagcgagcatctttagaagcagcaggccgggagatggagactggcagtgtgtgtgcttggacatgtaacttactgggagtctctgctcggaattggacaggggccgaggcaatcgggggcttgtggatgcgggtctttcagaaccctggagaaagagaactttgtgactggctttattaacactttcgtgtatttaggagagcggcctccaagagaaccagctttcaaagtccttgtgtgtagctctcctctgcatcccttcctgacattgattctagtcacagttaccagccaaggctgcttcctgcagttgccaaacccttccttttcagacagcagggcagaacactttcctatgttccaaaggctccaggtctgccatgggctctgggcttggtacagatagattatggctgaatagaaagagtttgtagagctgggtgtggtggcgcacgcctttaatcccaacacttgggaggcagaggcaggtggatttctgagttcgaagccagcctggtctacagagtgagttccaggacagccaggctacacagagaaaccctgtctcaaaaaaccaaaaaaaaaaaaaaaaaaaaaaaaaaaaaagagtttgtagaatacacccagaaccccacacagtgtgatcccggcacaaagcacatgggaggaactttcagaaattgaatggctgttctgggtggggggctactaatgaaagggcaggcagctgtgggagccagtgggaactgctggctatggctggcctctgtgccctgcaacaatctggttccagggacaggagccaggcttctgtcacctgggtttggatgaaccccaggtcacagcctctctgtctgttgttaactatataggagcagagacgaggtgctcagcttgctttgttatgcacgaggttgtgaacagattttgcagtgacaaagggtttgacctgatgctcaggcacccaggaccgcactgtaagggtggccattctgggacttgaccttgtcaggagagggtcaggcatttctgtggtgacaagcagctggcctcagaagtacctctcctgcccaccaaccactccctgcactggagtgctgctggtccctcagatttttagcagccctctgggggaaaaaaaaaaaaaatatatatatatgtatatgtatatgtatatatatatatatatatatgtatatatataaagcgtgtgtatgtgttttacatatattataataaaccatatacatatattacacgtaatatataatataactatatgaatatattatatatattatatatatatattctctttgaagcagattgtattctcactacagtgctgcagtctcttgttgaattctcttgctgcttaagaaaacctgtcctccataccctttcttccttcctttcccctacatttccctcttggctcctaaataaacctcttctgatgtgactcccagtgggggcttgtggagtttaaagcaggagaaactcccatttcttctcttctccttttccctggagtgtgaggtcaatggagccccgactgaagccccgggcttactcttatttctgtacgttgagaataatcttagaggtagccgctggcctagttttgtgaaatatgcatctaccctaaatctttgcctttacttacaactctggggttggttgattgacttaatgactgaatgaaagtctctcagtattaggtagtcccggagcccattgtcctctaaacttaccgggtcatttccagttgtttataattgtaacaacatatgtaagcattctcacagtgaaacactgtggacgttcttaattatttccttccaatcaattcctggaatcagaattccccagtcagctaggatgacagttttacagtattctgtattgtattacaaaggttcccgtgaaatgggaaacatgggggggattcaggacttggggtttggtagctgcttagccagaggctggtgtggtgcgggggaagagcagaaaaaattcgtggagaaacttggaaagtttagagtccaaaggtggggaatgaaaggggtttctataggagaaaggacactgaaacctgggcaggaaaggatgaccgatgttaagtaacattgcatcgtctgtccctcggccagatgagatggtctttagcttctcagttgtgatgtgacttgggaccttcgtttcatgttaactggctcctggttgtgttgtgcacagggcagagaatctgctggaaagaacagggagaacccagacaccaggtggcagagctgaggagtccgggtttgttaccggtttctgtcactggaacaaatacccctagtaaactgacaaagagaggaggttcgttttggctcacagtgtggattctgactggagtccgtggttgttggccctggtgcttcttagctctgtcaggattggggacacatcgtggtggaagttctcgaagggcaaaaatgagaaagagacaggggtcgggctgtcctttttaagagtaagacttcccacagacctaaccccataaaggtttaccaccacccagcagtgacaagctgggtctgagcctggtctacagggttttctataagacccacaggtgcatgtgtgtcacagagcacacaaagtgtctctgcagtgaagctgtcagctcttgggtctgtaactaagttcttcatggtctcaaattattccttcttgagggaagtcaatgcctgcatgagaacacgagtgaccttgcctctcagaacccccgtgttaagtctggctcctgaaaccgtatccccactcatgacacaaccaggcccagctttgttcaaagtactattgatcagactcttgtcaccataccctggacagcaagaattgtccccgtggataaaccgtaataacccggtggcatcggtaacagttttgatgcagacatgaaagtgactgagctgctgctgctgctgctgcttcttcttcttcttcttcttcttcttcttcttcttcttcttcttcttcttcttcttcttcttcttcttcttcttcttctcttcttcttccccttccctcccctcctcctcctcctcctccccttcctcnnnnnnnnnnnnnnnnnnnncccgtctctagcagtttctcagctgcagaaccaacaactgtaacactctgagttataaataaatggagcctggctgccccggcaccccccccccccccccatgctctagagtccaaagtggttgggtgcgcttgcttcctctctggcgacgtgcttcctgcttctcctgggacagcaaaactgctgtgctcaggcacggagggagctcgcggaagcggcaggctggcagagcatcattgagcgaggaatcggagcagctccaacatgcggttcgcatttagagctgagaatccaaagtgccgatgtgctgcctgccaggtgatgttgacacctgccagagtattgtgatttacataaaaatggactgaaactagacaaaatcaagaattcagtctcccagtcacgtatgagtagtcacatggctatgtctgggagagcccgaatagggaaatgtttatcaggcccagaaggctctaatgactaaagtcttaaagacctaggaaagacttgaaggaaactcaaaagcaacaacaaaaaggttaatccttagcatatttaactattaaagcctcaggaagatgtgtttatcaaaaacttgtggagcatggatggggacaagctgtcttttcaactgtgaaattttgaagcgcctgtcgtgtaccgagagctaatggaaacatcatccgctgctttctggggttctcacctgcgcctcaggcaaaatatcagctgtatcataggctccaactgaggggaggcaggcgtggggtgtttattctgagggaagagggagattcctaagatgaaggatttagaaggggaccttgggatttggggctccgttctccaatcccacctggccttgtcaatctctgcgaggaacaccggaactggtggtgttaatcctgccggtctcataaactctccgaccaatgtaggctcattgcgcatgctcgaagagctcatctactcacctcggagcttgcaggggaaggcatgcaatcacttccccagaggctctcctgggcacttgtgctcaaactgagccccccttgctccactttctcaaccaggggtccctgttcaaagggaaccccaaaagtagcttcagaagtatttccccgaagatcccgaggaacaggcaagggtgctgtttccccggctagtgctgaatcaccttattacccaagggagaacctgccagggcggaagtctcctcagccgtcaggaacagctgtgagtgtgagagagcaaagggctgtccccagcccgctcctgttccctgtgatatgcggctgtccagaagcgagcgccttctgataatgtgtgtgacctgtctttggaaaaccgttctcgtgtttatttaaagcagacaaagtgttcttcggaaccgtttacctctaatggagttgagtgtaactttaaaaggcaaactgagttctatcagagtgttgctgggtaaggccaacaggtcagccgcatctataggcataattgaattttgttaaatgtgtgtgtgtgttgcgtgtgcacatgtgtcagcacatactagaggccagaggacaacctgagttgtccctcctcagacactgcccactttgctttacctgtcagggtctctcactggcctggagctggccaagcaggctagactggctgaccagcaagctctaggaatcccagagccatgattataagtataatgtcactacacctggctttttaatgtgggttttgggggccgaactcagggcctcagagttgtaaggcaaacacttggccaactgagtcggctccccaggccattagctgagtgttatgccctgctccttccagacagccctggagatgtaagaattgatgattggcttttgggagtgactcagcagagcctgcattatccttgccaccagttggctcttgagggtctctgttcctgatacgaggggcctcgggagaggggctttggaggcccagcaggcttcctgactttatatcactgaggtctatgaactgtaaatctttttaagcaagtggatttggctgaccaccaaggcagaataaatcgttttatcccacctttctctgtgccagaggaagtcttagagagcgagagcaaggactaagcctggaagtagagagtgtgagactgaaacaaagggctcactgtgttgtgggttgaaattagcaacaatcgctacaccaacagggaggagaaggacccctgggtggcctggaaggcatcagaggaggcaacagtcaccttcacgcaggtgtcaccagtctcaggagcactgtgtgctattcagacaggagggagcttcctcgttccatggagggagctgggagacccaggatggatgtggatgggcaaacaaggtaggaagcgagggcaacatcctggagtatcccatcttttcaagaacacttaactgaatgccagaaagacttgatgtgacagtagggaccttgaattagagacctatgggattgggggtcctagatattggagtgtcctccctattcatggtcttgcatggctgggagcaggtagttcctacagccacaggaattgtggctcctgccccgggctctgcacaagtatagaaagtaagctgtcactagtcagtttttaaaaatcacccctgtgaccaaatacctgacagaaaccacgtgagggaggagacatttcctttggtaatgtccacacctcctttgtccagtgcacatgggtagagtgttgtggtgatggaggggtgtggctcaggcacctttttaaaaaaagatatcatgtaggggatctacttccctggatagctgggtagctcaacaatggctttctgtattcaggagaggcggagaggttggtagctgcttagtctgtgaagtgccatgccttatcaggcccaggcccaagctggtgatctggaagattctcagagaggcggacacatgtcttcatttggctatgcaaggctgtaggagctggtttctgatatcagcagaggttagtgccagcagcagtgggtacagcaggacagaacctactgcaggacagacattcaccaacaggaatgaaagcggggcaggcaagcagctcaggggagcttactgcacctcacagtgacagggagcatactgggagacaaaaggggccgagcaaaatgtgtcttccaaagacacgtctggtctccaaccaggccctgcctcctgccttccccccagtggtgccatagagagtctgaaaggatggagccatccattaggtcagagctctcagtgtccagccatctctgtaaatgttatcagcgacaccccagacggagttttactaatttatacattggcatttaagctaacagttgagagtaacctctgtggatggcaagtatgctgctggccacataggcacagggacctgggttccacaaaaagcaggacatggtgccatgtcatttgtcatggctgccactgagaagccagagacaagcagatccctggggcctgagtgagttccaggccagtgagaacaaacatctcacacaaagatgcacagtgcctgagaaatgagtgaatctaagtgtgtcctctggcctttacacacctgtgtatatgtgcacacacacaggcactaacaatcacagctgtctggcctttacacacctgcgaatatgtgcgcacacacacaagcactaaccatcacagctgtctggcctttacacacctgtgtatacacacacacacacacacacacacacacacagaggcactaaccatcacagctgtctggcctttacacacctgtgtatatgtgcacacacacaagcactaaccatcactgctgcttggcctttacacacctgtgtatatgtgcacacacacaggcactaaccatcacagctgcttggcctttacacacctgtgtatatgtgcacacacacaagcactaaccatcacagctgtctgcctttacacacctgtgtatatgtacacacacacacacacagaggcactaaccatcacagctgtctggcctttacacacctgtgtatatgtgcacacacacaagcactaaccatcactgctgcttggcctttacacacctgtgtatatgtgcacacacacaggcactaaccatcacagctgcttggcctttacacacctgtgtatatgtgcacacacacaagcactaaccatcacagctgtctgcctttacacacctgtgtatatgtacacacacacacacacagaggcactaaccatcacagctgtctggcctttacacacctgtgtatatgtgcacacacacaagcactaaccattacagctgcttggcctttacacacctgcttacatgtacacacacacacacacacacacacacacacacacgcatgcacgcactaaacaccacactgcctgcagccccgaggggctgtagagatgttgaggattgtatagttttaccatgtgtagctgttagaatgtgaaagcctttctctgctttccttggagaaagaaaggatcggaaacaacaggaggatatgtctgcccccactttgatctccaggggtctaagcttgctgtatgggacctgacatgggaccacagcctgtgtcccaagccaggctcagtcacccatcctccattagccaattaaaactgccaaactagtagtgaaaagcagaaagatgtttgttcaatgtgaacagactggggagggtggcagacgatccaggaacgctccctctgcccaagtctgtcttcaggtcttgaagtgaggttactgtttaaatggagggccgagctatgcatgtcaaggaggtcctggctaaggtatgttcctgcctatcattccccccccccccccaggaagatgggtccccaggatgtcaccacaggatgtcaccactgaaatctctttctgagagacaagttcttcccctggctgagccataccttagcctttttttttttcatgtcaatttgacatatacttgtatctctttatgtccacgtgaaaacgatagccaggtaataataatgcctaacatgatacagttctcctctgtacaactgcaaatccataagtcgccatttaataccatttaatatacttacttgatcacaacatttagcttcattcatcttcctggtggggcttttttctttgaaccttacattttatatatttcctttcttgaaattcctaggggaattccagtttctggtgtgtgtgtgtgtgtgtgtgtgtgtgtgtgtgtgttagttcaatagccaacttctgggatacaaatgtcactcagcatatcttcaaccctgccaggttcctttggaacttgacagtctcagccgtctgagaacacagtccttggctgtgactcctcctttatctgaccccctgagcacatctgttaagagcagtggcctctgaggtccctccatccttgcatgacccacctcactccatgccttcttcccgtcagctggactcagaactctatcagcttcactgactgatggctctgcttcccttcgtttaccccaagccatttttaccacctttgatggatgcttttgtgtgctggaggcctactactgtggctgaggcacagagacaccaagccacctgtccaagattacacagcaagtacatgtgtggcgttcctacttgaacccaagctgccctactgctttgtagatcaccatacctcctactctcccttcaccccaaccaagcccttatttaaggaggtatgctcccaagcaggaaagagatggtacaatacctctaacgggaacaattttgtgagtctttacaaaagaggctctaattcacccactttgtggtgtggggtcgccaaacactttgacatctgctgtttccctttgtggctcatcatattgctatgctagggagacaccatgaaatctctctattctagaggtaaagaaaagaaaggccagggaacccatcaaggtcacacggctggagaaaccagtcagtttctgggacagagcagtagttatttttcttgtggttgcaactgagcacctgacaagaagcaattaaggaaggaagtgtaaaataatatgaattacgtgtatctacgtctagcttcaaaggattgagactcaaactatgattcatttactagactctgcaattactgtgggatgacccctagtctaattctctaacgctagactggctacttccccaactgtgctctctggatacttgctgtttgagtcttcctgggttattattgctccagcagtctggggttctggggaggcatttcacacaggcacgtgctgctggtccatcatgactaacggagacctcctgctctctccatttccccctcctccatgctcccctccctccccctctcttcctctctcctttctccttcttctgtgtgtgacccttacctgtgacccccaaccccgaaactcaaaactccacctctctctcttctctccagtaattagttgtaggcatttttatttaaccaatggttttaaattggggagtaaggtttacaaaacatagactggtgtacatgtgaatttgttcatcgtggggcaaccagatcttggggtgcagaatttatcatatgagtacaagcaacaccagaccaaccccaagaaggaagcatttgattttgctcatatttcaaggatgtacagtccaccatggtgggaaaggcacggtagtcacactgtatccacagcctggaagtggttggtcacactgtatccacagcctggaagtggctggtcacactgtatccacagcctggaagtggctggtcacactgtatccacagcctggaagtggctgcctcacactgtatccacagcctggaagtggctggtcacactgtaaccacagcctggaagtggctggtcacactgtatccacagcctggaagtggctggtcacactgtatccacagcctggaagtggctggtcacactgtaaccacagcctggaagtggctggtcacactgtagcccagcctggaagcagggagatggatgctggtacacagttcacctttaacttcagtctttagtcttagggatggtcctgctcacatgtgggataggtcttccctcctcagttaattctttctggaaacatcttcatggtcatacccagaagtgtgtctccatggtgaacctaaacctagccaagttgacagtcaagactaaccggcaaatgaagggatttcccagcacctacatttctcccagccctcagtaatggatctgtggtcctggctggggatgagagtcctttggaggaaggaaaggacagcaggaagcaagagggacagaaatctttctcagcagccgaccacgatgaccagattagactcaggggcaaatgatgagggatagggttactgaagctcagagcccttaaaaaataaaccattgtttccaatgaccctgaaacccaatggctgtcagcagttaccatcctgaggctcaggattccatggctgtcaggttaggctgggatcagcaagtattctgttctgagcctggctccctcatgtctctcatgttggctggttggccagttggtgcaggatagacttcagctgggtggcccttctctgctctccatgactctcatcatccagcaggctaacctgagctggacacaaggtggctgggcagggtgccaggagagtcagtagaaacacacccaggcccaggagtcagcccttcatctcccctcacatcttagtggctaatgcaagtgtcaggaagaaggaagcagacatcacctttcagtgggaggagctgtagggttctgtggaacaggacaagggtacaggaagggtggagggcagtggctgcttccctaatgtgaatggtggtgaaatcactcgaatcgtccctggatttctgggatgtcagcggaaagtctgaagtgatgctgcccagtgagcagaaaatggagctgaggtctaagggcctgcaaattcttaggggtgcagccaaggacagcttagaactagcacaagggaggtgtctaagtgcttgccctggtactgcctggtatctaagcccttcactgagtccctgctctgtcccaggcaccacactctataacattctcttgaccaaacctcacaagagtcccattgcgtctattttcatcccccctttccatagcagaggaaaactgaggctcagagtgatcaagaaacacattggaggccacaaagcttgtcagtggtagggggagaatttggtcagtgcatcttaaacattatcgagagtaactgggccacaaagcgtagaatacagggagaaggctagggatacagttgatatggtaggatgcccctgtcatttcagcactgcctataccaggtatggtgctcctctactgtaatctcaccattcaggaggtagaggcatgcagatcaggagttcaaggtcatccttggctagataggaagctcaagaaccaggctaatgtacaaaagactctatctccaaaaatggagagagcggggaagatgattcaatccatgaaatgcttgctgtgcaatcatgagaacctgagtttgattcctaacacttaaaagaagtaacatagtatggcataggcctgcaatcccagggctgagaagccacacataagggatactgggactcactggccagccagtctaataaatcagtgatctccagattcagcgagagaccttgtctcaaaaacaagattgaggaagacaccggcattgacctctgatgtatacatgcatactcacagtgtgtgtgctgcctacacatagacacacacaaatgatcacacatgtatgtacacttacctccatacacagacacactatcatgtacacacatatgtgcatgcttctctgaacacacagatgaacaccaaaatgaacacatacatatgcatgcttacctgtacacacagacaccccccacatgtgcatgcttacctgcacacacagacacacacatgtgcatgcttacctgcacacacagacaccccacacacacatgtgcatgcttacctgtacacagagacacactcccacacatgtgcatgcttacctgcacacacagacaccccatactcacatgtgcatgcttacctgcacacacagacacactcccacacatgtgcatgcttacctgcacacatagacaccccatactcacatgtgcatacttacctgtacacacagacacacacacatgtgcatgcttacctgcacacacagacatatctccacacatgtggatgcttacctgcacacacagacacacacacatgtgcatgcttacctgcacacacagacaccccatactcacatgtgcatgcttacctgcacacacagacacactcccacacatgtgcatgcttacctgcacacatagacaccccatactcacatgtgcatacttacctgtacacacagacacacacacatgtgcatgcttacctgcacacacagacatatctccacacatgtggatgcttacctgcacacacagacacacacacatgtgcatgcttacctgcacacacagacaccccacacacacatgtgcatgcttacctgcacacacagacacactcccacatatgtacatgcttatctgcacacacagatacacaccatgtacacacaaccacaaacagcccgggtggagctgttagtttgaagtgcccagcaagcccactgctaaaccacctgcaaccttggtttcctgagacttaaagaggaacttcctgaggcatttctggtccacggctcctggtggtgagcacttgccttctccctctgagacgaagcctgcagtatggttgcaagggtccagcacggttctccactctgcttagctgtcttgtgtccagtgagaggcaggcagtggttcctgggggttctctgcagtacatacacactgactaagctgcgttcctgtaactggaacatagatccctgggggagcattggtttggaatcagatgcatgaaaacaaacttaacggggttggaagtttgtaatccccactcattgttctcgaactggctgtaattttgccctgtggtatggccgctgtggcgtctgtggggagggagggagcctcaaggcactgctgctcccaggcattctctaggaaggcagctctgcctcagcctagcccctgatacctgctctccaaggaactgacctgtgagaggagagtcaaccttggtctgcacaggcacgcacgctccggtccacatacacaaacctcagcctattttaagtaagtttacgcttttgtattgggtctcattcatagctaggctgggaagcacgtctctggctattaggaaacagctgcagggataggagaaagagtgcttccggacgtgggttctgggctcggaagcctctactactgggtacagcaccttaacccagcctccccgagtggaatacgcacaagaagctgcctgggtggatttgccttaatctggagccaggctcccatgatccttgatgttgccagtggctaagcagacaggcatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccctggcatggtcatacactagcatagcagaagggtactgaataccagctggcttccttttcctccctcctactgagcagaagcagggttggtacccgatgctatggggcacgtgctgcatccaggcagttagggtctagggcaagtttcaggagcagccttgactgcctgcatcttcatctgtgaaatggggataatgttagcagttcctataggtgctctcacaggaccacagttgaaggaacaagcaggggtgggaacaccttgatgtttatttgatgggagctggggacatataggtcctttgatagggtacatggtcttctctggggtaccacaaggatgtttcaactacttggaatatggcttttgtaacccagaggacaaagaatgaaaacgaaggtggcatcttttcagtagcgcaccctgaactctgagctgtcgcggtctccgtctctcagggtccagttggccagcagccagctgaatggacttcagaggagccgcactccaaggctggcctgctgctggagttgtcttgctggactgtggcctaggtaaagcgccagcaccgggctgccaaggaagccacaatgttctgtaaacacggaggcaagcacactctccagtatgccattctgtgtgtgtcaggcacgtgcacagacacgcgtgtctctttagctcacatcacaggatctgagaaaacctttcctgtggggatgctggttagagggatgaacaggggatgctagcagggtttgaatcacagctgttgttagaactatttagaactttgggcttggaagagcattggagtctaccgggtcccttctctgctttagattctgacagacattttacccccaagtcttggttctgcgttggaagaagcagatctgagaattctgctgtccaggctcctcccagcctggcacgctaggactgtgtctgagctggaaggagtggaaccacggacggttccagggttgtggtgttaatgctggggacatggtggacccacagcctgcttcttcctgtagctgcttcccgactcctgtgggccatgggcttctctctcttctttacttattgtgactttaaagttattctttctgggagaattcttctctacaacctgtttggtcatatccacccctcacttctcctggatcccttctccccatttccctcctccttcccatctccccctcctttcccattcccctctccctcaacttcattttcttttcttaaaaaaaaaaccttttaattaaatttacttatatttattttgagacaggttctttacatagctgatggtcctggaagtaaaccagactggcttcaaacttacagagatccccctgcctctgtttcctctgtgctgagattaaatgtgtgtgccacagtgtctaactcctttttgtcttaaaaaaaaaaaattacccgctgagtcgggtgcttcccatatgttcagcgagggtgtaggtctatccactggatcatgggcaaccaaccaagggtcagctctttgaaggaaaatgattctctgcctccactcctcggtagccatccttggccaaccgctcctcatggagaagtgtggccttgtgagcccctcccccaccgaggcaggcaggctgactggcttgttcctgtgcactgtgcaggcagtgacaggtgctctgagttcatgggcgtaaggtttccctcgttttcagaatattctttttcccagcagccccctgaccgcctcttacactctttccagcctgcttccttgatgtcccctgggccttggggagtgggggtgtgataaagacatccatttctgactgagcacctcagtcactccctctctgcactctgaccagacgtgcgtctctgtatctgtcaccaccgcagacacttctttggtgagacctaacttatctatgggtggaaggataggtgtgcagaaggcagctggacacaacggtagcttctctattttatctttggcgtgtggggctggagatgctaccctgggcctcgggcaggagctctgccactgagtgacaccccagcccctagtgtaaaatgacttacaaatggttgtttactggggctgatgggagacttgagtctgtgggaggcttgggacgcagcacaaggattttacatttatactcctcgccctcagggctggacatggcaggctgtagatgctttagccgttttaagttgtcaatctgataattcttttcacctgtgaaaacaacgggttctctgagggaggctctttgactcgctccagtggctcaaactcagccccagaggaaagggggtggggaattatcccttagtgtggctttcctctcgggtttgattcccagtgccattatggatttgagttagagcatccacaggctggccaaacctccttgtgtggctgagccaggtggtgaatgtggcctgcttgggaaaggacttctgtagttcccatggacatagcctgctcggggacgcttcatttgaggcatatcatggaggggctgaaggagtgtgaactgccctagcagaggtcctgcagggacacatggtaaggctgctggatggtgggggtggagatgtgggtggggagctggctcattgtaagctcttctcatacgccagcaagaagcaactctctataggagctaacatatactttccagggttaatgtgggaagagagatttctttgcaaggatggtgtgtgtgtgtgtgtgtgtgtgtgtgtgtgtgtgtgtgtgtgtctggggtcctcagggctcccccaggttctggggtaggaattaagacagaacctacccatggggcctgacaccaggtctctggtgtttaattagtgacagtgtccatgagcctttgttgaagtctgctgaggatttcagacatcagttgtaacatccgtcagccctctttgccaatctctctgcctcactaaagcattggcagggaaggtgccagacaccatgacacccgagtagcggggagctgactggatgaatgagaccccaagaagaaggtggcccctggaacagagcaaggggatctggggccagctttctctaccccagggaggctcctaactctactccgcagagaagcctaacagtggtgtcttatatcccaaggcctgctgtatttaatatcctggggtggtcagatttgtcctgcttcctgggtgctagaaacaaaggccagcccaagtccccactgcgcaggcactaggaatccacagctcttggagcggcagggtggaatttgtcctaagtgtcctgccctcgagcagtgccttttcctagtggctcactgctcagcacacattgtgcccagttgttatttagtcttctgcactgtagatcttttgtgatggacccccgcagtggggaggtggagacaggctcccttgggtctcattggatttgtgagggccaggccaggaagagaccctgttttgaaacaaaagatggatagaacccaaagaatgacaaccagaggtgacctctgctcacatatacacatgaatgcacacacatgggggcacatgcgtgtatacatacacatgtacacttacaactcacgaatgaatgcacacacttaaagtttagggcagatttatttctgtaactcaaagtgaacttaatgttgcttccctctttgtgtttggcacccaccaggcccagactgatccgactcctccctagcctatcctccctcccctcccccccttacttatccctctggtaaccggtaactagtaaaagtgagagcctgttcagttacctaccgatggccttagtcagggtgatgacaggctatgaccacaggcaacctattgagggaagggtttgtttggcttgtatttcacatcattgtccattattgatgcaagtcggcaggaattcagaaagggcaggaatctggaggcaggagctgatgcagaggccatggaggggtgctgcttactagctcacttctcatcctttgttctgattgctttcttataaaacccaggaccaccagctcaggggcggccctgcccacagtgggctggacctacccccatcaatcactaattaataaattagcctgtaggcttgcctacaccccactcttacagaagcattttcttaattggggctccttccccctctgatgactctggctgtgtcaagtttacaaaggtttgcgtttcttttagttggttgttttacttaagctgtgtgtgtgtgtgtgtctgtgtgtgtgtgtgtgtgtgtgtgtgtgtgtttcctgatgcctattcagattgctcactcttgcctagacaaagatgtaaccccctgccttttcttctccagcactggtttgtgaccacacgctctttctttttgatgtgcagggtcctcgtgggtgcaccgaaggcagattctaaatatagcacttcagtaaagtctcctggagctgtgtttaagtgtcgtgtccataccaaccctgaccggagatgcaccgagctggacatggctcgaggtgggtggacatgcttgtcagggtagaaatgggagcaacaccttcatgctttgttctttttctacttaggacagcctcatcacttgccggcctaccctctctccctcttttcctccctccatcttacagatgtgtattgagatgctataagctattaggcactgaacaaagcaaagaaggagcctgtcaccccgggcctggaaaaccagtagtcagaatagacattaaaataaacaatagactaagagaaatccagagggaaggtgtgcgccggggaagctctatattggaggttggaaacggcttccttggggatcttgctgtgtatggaaggtagctagctgggaagtccaggaagtgcagtctccagcaaggacagtgttgtcacaggagaggtgagcaggggagggagaaagttggaaaggacaactgccaggtaggagggactacaccacacagggcctcactggacaggttaaatgacagatttcactctctgtgtgctgccagaggccattcagatcagcttttatgtcttgcatggtgaagggcatgattggatggactgtggtactcacttttttctagtagataatgtagatctactggatcagtctccatggatcggctctggtccagctgtagacactggggattgcttgcactggattgctctgagaagactgagataggagaggcaagcacagaaagacacgggcagaagagccaggtgacttgctagatgcttccaggccttgctcccctaaagccctttatcacccaggcctctgccaccacttctggcatgtctggggagacaactcagggggtgttggttatgaaagagcaaggatctgagcccattccttagaatccacagaaagagctgcgtgagcctgcatgagcttgtagtcccagggttgagaaggtggagatgagacgactcctgtgggatctctggtcagactatgtagctaatcctgtgagctccaagttcagcaagagactctgtctcaaagcataaagcagagagcaacagaggaagacccctgacgtcagcctctgcacttgtcatgcatggagatatatatgaatgcacacccttccaacatgtggcacacacacacatgtttgcatacctccaatatgtgtacacacatgcaaacatgtaaacatacccacacatggatgcacccttcaacatgtgcatatgcacacatgcaaacttgtaaacacacacacacacacatatacacacccttcaaagccaaaaagagtctcgattttatttatcagaagagacttgggtgtgtgggatcttctctgtgaggtgtttgttacagtggcttcccagaacaacatcaatgggaacaccttttccttcacgagaatgttgttgtggaaaaagaaggagctgaattaaacagcaacattttgttacaagtttccatggagttgacattgtgttataggtacaaaactttgagtgcccaggaccaccctttgaaaagcagccagctgcaccattcctcaatccaaagctgacctcttttctccctccagggaggactcgtggtgcgccctgtgggaagacctgcaggggagaccgggatgacgagtggatgggggtgagcctggcccggcagcccagagcagatggccgtgttttggtaagacctctggggagagggtgacttgggacagagcaccctaagcatgaaggactgaccccataggaaaggtggctagcacagaagccagaacacagcgttaaggctatctgttgtgcattgctgctctgagatctgtcccacctgcactttcaggccacatgtatctgcatgaagcagggacagctaagaggttcaacacaaaactgtaaagtcacttaaaacattgtgagataacttttgtgggatttaaaaatacctcaattgtgtggttctgagtgtgacccttgtaggtgacagtattgggttgccatgtcaaagtctgacatgcctagaacctgttctttgtattacctttagacatattgggctgaggatgtaactcagtggtagggagctttcttttgtttgttttcgagacagggcttctctgtgtagccctggctgtcctggaactcactctgtagtaccaggctaacctcaaactcagaaatcagcctgcctctgcctcccgagtgctgagattaaaggtgccaccactgcccagccctggtagcatgccttcttaacatgcatgagaccataattaatcccaggaagcagagagagagagagagagagagagagagagagagagagagagagagagagagaggagagagacaggagacagagacagagagagacagagaaagaccgagactgaatgagacagagagacagagtaaggcagagagacagaaacagagagtgagacagacaaacacaaagacaagagagagagagagagagagagagagagagacagacagacagacagacagaatatgagaatataggtagaaagaagtttgtaagcctggcgtggtggcgcacacctttaatcccagcactcgggaggcacaggcaggcggatttcagagttcgaggccagcctggtttttcatctactcaaccccccacatcccagaggcaactgctgtcttgcaaacattgctgttggtttttctagaactttacatgaatgtaattcaagtgttcaattcctgggccaggcacagtgaaaggagagaagtgactcccatgagtcaccctctgaagtgtgcacacacacacagacacacacatacacatgcagacatatacatacacatataacatatacacacatatatatacatgcacacatatatacatgcacacacatacacacatacatatacacacacacatatatatacatgcatacacacatatacacatacacacatgcatatacacaaacacatatacatgcatacacatgcacacatacacatacatgtatgcacacaaacatacacatgcacacacattcatgtgcacacactgacacacacacactaagtacatgttaaacagacaaacaagcctctaactgtgacagagacttgattattaaccattttctcttttttcacatgtccttttctgttgcgtactcaggcatgcatacctcacagtctgctgatgttttcacacacatacatccaggcatcccatggtcagcaccctgcagactccttctgccctttcccaggcagctggtgccctgtagggtggtcctcttcagacttcctatgaagtctgccgtcggctttcctcgaaggctgtaggatgatttgtgtttgaaaagttcaaggtcaagaagggaaagtgagtccagctgctgtatctcaggggtttcctttgggccacaagctgtcaaagctgggggctttatggatgtttgttcccaggggaaatgggctttcctcaaggatacaggccagacgtttctagtccctctgaggaactctgttctgtgttgatctcctcaacccgacctcagcacacttaagagacccccacattgttgggtccttgggagagagagcggctggatgctgtcaccagaattataaggcctccctgctggacaccactgtaggtctcattgccccctcccccatttctgctggccttggattctagtcctttaatccctgtttcagcaggccatggatgatggccaagccaccacattcttctaggcatggtggcctgaccccacagggtgactcagccccaaagagccatatctcttgtctcccattcttgggaaaaagatgggagaaaccaagcatgtatattccccagaggggacgcaaagctgtggttcagaaccaatatggaaggggagaaggaggaggaagaggaggaggaggaggaagctggggacagcaaggcatgagatgcccctccaggcactgaatctagagatagcctgttctgccaagatatactaacttagggatgtgagactttagtgtggttgagagtttgcttgcaaaagtgcaagaccaagaccaagctgtgccagttggtacgagactctattcagtttaggggcttaaagcaacagtgaggagcatgggagacatttgccccaaagccaaggaggcagggttcaaaatttgtgggatgtggcgctgcagataatcctagctaagtaattgggctagatttctgttttacacaatgcttgaaccatttcatttgatcagtcactccctaagggtgctggggaaggaggggtaggcacgagggggtatctgaaggtctctattcctgttgtcgtcacgcatataacatgtgaagcagcaccccagccttgaagagtattacgtgctctgaggaaacgtgtgctttctttgggcacgcatgtttctgataaatgaaaagctcacttctctgctaaaatcaggagacaacatcagaagtgcgtgagaaaacattgttgtacaacagcatctctagaactctccatctcacagatgccaaatcttgtatctctcaaacacaactcccttcctcctgccccctgcttcctggtaatcatcattctaattttgaagtactcaacatgtcagatcccctgcagataggagcgggctggattcgtcatcttgggttggcttctgccatttaacgtagtgtcttcactgctcagctctgtcgtaacatatatgacagcattcttttcttttcttttcttttcttttcttttcttttcttttcttctcttctcttctcttctcttctcttctcttctcttctcttctcttctcttctcttctcttctcttttcttttcttttctttcttttctcaagaccaagtgatactttatcacacgtgcacagtgctttctctgtttgttcatggatgcatgtttaggtggcttctagctccttgccattatgaataaagttgctacaaacactagcaaagatttattagacatgctgggtgtggtggtgcacgcctttaatcccagcactcgggaggcagaggcaggcagatttctgagttcgaggccagcctggtctacaaagtgagttccaggacagccagggctacacagagaaagccctgtcttgaaaaaccagaaaaaaaatttattagacaccccactttcccttccttttgggtacgtatgtggaagtgcgactatcagatcatgtggtaattttgctttccattgttgggaataccttggcactctgttcctctaaagttcacaaaccattttgtgtttggccagcatgcagaaagttccagagacaactaattgttcaactgcttgctattggcatcttgtgtactgaagatagaatccacagcctcaggcatgctaagcacttgttctgttactgagccacacccccagcacattctatttccctttaaatagtagccaccctaaagagtgtgaggtgatatttcatgatggtttgtgtgtgtgcatctatgttagtgttatttaaatccatttcttttttttttaatgtctcatttttgtctgtgaaatatttctgggaatcaaaaaaattttttttaaattgaaggtagagaaggcattttgatccctcaggaaaactttgtggcacaggataaaacctgtctccctagggatacagccttgatttcaaggatagggtggtggaggggacagctgtgacttcgagagagtaaatcatctcaatgacaaatggtctcagcgggatcaatgctgccaagacccagaatgtcaagctggccaaccaggctaaccttggcccagtggctgcctatcttgggtctgtggataaggtggttccttctagtttccaccagggacaaatgatccctactaccaatgctaccatggtactgaaagcaagttcccttcccacactgttcccgcacccctggagtgcagagatggtgttgtcaggaatagggaagaaggcttagtcagccatgctgcataagcataaaaactggagtccagatctccagtaccatgcaaaagctgggcacagccactcatgactgcgctcgtagccctggccagccagccagactgatgagagccagcttcagtgggagattctatttcaaaaaatatataaagatagaaagtaagggcggaaggtactttatattattaacctctgggcgcacgcacgcacgcacacacacacacacacacacacacacacacacacacacacacacacacacctcgaacattcagaaccacaatctttcctcatcagagctgccaagcctcagataaggaattatctaaacggctcaatatttttttctgggtggaagcagcgctttccggctctaactccgctgtttcctttctgaatgtcagggctctctctggccctctcatctgcttacttcccttgtgtcttcttcaaagccacccagtatgttcctgtggctattcctgtcgctgcttcctggtttgctgcgtgcgtacgtgtgaatgagtgctctgccaaaatataacatgtgaagaaaagtgcacaggtcacgagaacatactctgatgagtttgctgtaggtaaacatctgccaaacaacattcccagcgctaaccaccccagagcctcttcccctgtgccccccccagttacccccacccccaccccggcccagggaggcacagtgtctttgggagaattccgtgacagctcagccttgctttaatcctgtgcccactgcgtctcgatggccggggtgtgaccgagctgtgcattgcagacctggaagcatggcaaagcttgttcatctgtggacaacaagtgcaggtgtgtgagggtgggagggacagacaggcatttgtcaccaagccaccctccaggaagaacatgctgtattcacacaacaaagaaggcctttgaagggaattggagaattttcttcctcttcttattgcttgggaggataatcagtccttctaacttgagatgtgtgagggccaagatttggggtgatggtagggtccttagtcttttcctagggtgctttagaagatgaatttaaacagggtattgcctcctgaatctcctcctcgtctccacctccctccttcccctcacctttccccctccatctctgttctccctctccccttccttatcctcttccttcctttcctcctcctcttcctctgtctcttccttctccatgttgttttctctttcccccttctctccttcctcattttcttccctcatcttacatcttgttcactccccttagagcacacagtacctctgggttacccccatagcccaagaacataggctctggccacttccagagcaatctcttcttccttatccttcaccactccctgcccttccttacaactcactccccaaatcgaccgagtcacgatgctttgcagttcctcggaatcttgctctttttgtacaggatgcaggtcagacgggctcacgtgcgtgaggatgatctggctaagcacagtgttttcttcttataatttatattcagagttcctttctattttctggagtggggtctgtctttgacctttgatctctgtcctcccagaatattgtaaattagatgagtgtaaaatgtagtatttgggtctcctagggattcttcaaggtcacccttaaacagtttatgggatggaaagcagacaatataataaacatcggtgatgctgtccatgtgtgcagctggcttccagacacaccacgataaacttcggcctctctaactcagcatgctataggtaacgagagctctcaagctgtgggccaagcccttcaactagaataaagcctatttgctcagaaactgggtgatctaagagactcagatttacaaactgtaagaactaagtcagaatccaaaaatgaaaaaatctgctagtcagccctttctattcacgggttctgtgtctgtggattccatgggctatgggtttgatagctccagattcgaccaattgtgatcaaaactgatttttaaatctgcatatgctctacgaatgggcagacctttcccttgtattcattctccaaatggcgtgatgtaacaatttctgtgttgactgcactgttataagtatagagatgattttaagcatgtagggactggggagatggctcagtgagcaagagcacctcattctgcaagtgtcgggatctaagttctaatccccagcgcccatgtaaaaaccatgtatagtcacacatgccagtagcccgagcatggcgctggggagcagagaagctgactctaggttccgtgagagactctgccacaaggcagtaagataccacacacacataccacacaggagggatatctctatgtagaagtatgggacaactattgaccttgtgatctttcctgtttctcactaagtgctgtctccatctgctgagaaatgtctctttttttccctcacaatgcaagaatcaagtggggagggaagataatatagtgaagtaggagagacagctgatctgtcattggctatctcaaacatggcacagagtgtggccaagctcaggtctccagtgccctactgaggtcccctttgggcagagtggcttatcagggccccccagtggcagcgtcactggagggaaaaagagcagagagcttagatgacaatgatcttatcattcaacaagtgaggaagagcccatacagaggccttgggtgtcccattccagctaggtgccagggcctcatgggacgggttataagaatagccactgtccctgcttctcaatcaggaatccagaatctgatgatagaaaggccttatagaaagatgaagcacaggagcagctagatccagtcctggtctcagcattgactgtgttacccagccactccctgctacttagcaatcccatgaagaacatagaagtcctgggcccatgagatgactcaatgggtaaaagtgtttgttgtacaaacccggtgacctgagttcaattcctgggaccacataaaggagagaaccggctacacaaagttgacctccaacctctacatgggtgctgtggccgagcactgccttgccatcattctcttaataataacatagttgtaaagatttaggaaactgactcagtcactgttctattgctgtgaagagacaccatgaccgaggcaactcttaaaaaagaaagcatttaatcagggcttgcttgaagtttttggaggtttagtcccttatcatcatgacaggggacatgatggtgtgcatggtactggatcagtagctgaaagctgtatcctgatccacaggcagagagaaacactctcacttggcctgggcttttgaaacctcaaagccttcccccagtgatatacttcctcccacaaggccacagctctgatccttctaatctgttcaaatagtgccatcccctaatgattaagcattcaaatatatgagtctatttgggccattcttatccaaaccaccacaaaaaaatagaaagtgagaggcctagctgaggcctggctgcctctctgacatcttcttacttcagagtctctccactcattgtctttctttccctgtgacttccaaacctaatgctctgctcacgtcctttgcaccaaatgcttctctttccggaagcgtctcccttcttttgctcagtgtggagggtgttgtccactctctaggctttccctgccctctgcctagaagccacgtctcactccaagactcagtagcccactgtcttctgtcgttctgtctctgtgctcaggtccagctattgatcactctctcctccagtgactctcaggagctggttcttctccatttcatttttctgatgccttgatgtgaacttcaatctccctccctccctctctgtccctttaggcctgtgcccatcgttggaagaacatctactacgaagcagaccacatcctgccccatggattctgctacctcatcccttccaacctccaggccaaaggcaaggtgctgattccctgctacgaaggtaagtgtggattggttctctctcagcgcggtgacctccttgctgggtgacttcagcaatccccagccctctccctcacaccactgcctcagcttctctcaggctttccacacactggtgtgagagcagggttatctgtccccagatcgactctggcatcaatgtcatgtccatggaagaggcaactgcaagggggacagtggtctaggccctgcccagccctgctcctgccacagagactactgtgttcattaccagttccagggataagatttagtcaaacaattcagctgttctcttagctttctggaattaccacatgctatagggccttgggaaacttattatccttttctgaacctgagagtccttatcagaaaggcaaggaacgggttcaggtgatcaatacagcactgccataaagccaggatcgtcattggacttctagaaaagtcctggatgttctaggctgtgggaagagaagatccagtctctataaagccataacatggcagaagttgaccaaccagccccctcattcagttcttatggcatacacttctgaccatcctcgggtgtctgtcagaactagtcagagagcattccttgggtctagacaacacttggtatcagtctactgtcactgtgtaacaatacatctctaagtcaaacaataataaacatgattttttttttaaatttatacaactccacacaggcttagtgcgctctgattgtggatttgagtcgggtccattctacatgttgtcttctgagaccatgagctctgtggggtgtgtttgtgagcacagggtcactcggggtcttctgcgatgccctgcttagagctgcacattcttgggcaaaactgagccaacctagttctggtgagctgctgagccaggtccctctctaagtgcaaaaggctgtttgatttttcattgcttcccacttacacctttggaaagaggtctaagtggcctgggtccgcactgccttgtgcttccctgggcttccttaggttttgttctcgtggtcatcaagaggggttctgacactaaggatattgtaaatcatttttgtctcatggggggcagggggaccccatggcactatgtggaactcagaagcccccagcaggacattctgtgaacggttctctacagaaaggtcagcagggacttaagtggaggcacagcccctcttcttgtgtgagggtgggctgttttcataccttcattctttctctgcttgaggctgggccagatggggagactgaaatctggccctgttcatctctatattgtcctagtgggacaaaaactcttcatcctaaacacccatgatatagccacaggtgtagctcagttggtagaatgactgcccagcatatgtgaagttctgggatttttatcttcctggccagcttgggaacatgaatgagcccctgtcacaaatgaatgaatgaatgaatgaatgagtgaatgagtgttatcagtcaagtagcagagaacatacatgagtaccagccaggacatttggttttcacccacccgtctcagcactttccacatcctatacagctcactcactggtccccaaacacaaacacatgggacaggccagcccacccaggtcagctgagccctagctcttgcgtagctgtatgatcgagaaatcagcatcgttatcatttgccatgagggattaaaattgttacgcagaggtagctgacagatgcagggctccgcttgggagctcagagtcctcctgcagcagtggcctaggtttctttgctttgtatatttctttactccatgatggtcaaatggagccagagaagatttaaccagagaacatattagcaagatgtttgctcccacctgacttttcttccttaaggacacgcatacatattcaaatttgtacgttgggaaaaacaacaacaacaacaaacccaaaacaaaaacccaaccacagtaaggagaggggccagtatagggagtactgggaccaagagcagctgctgaggaaatctgaggaccggacaatggttctgtgtacttggatctgtaaaatgggaggggtggtgatgctcagatttctcaggaagactggggtagtggggtgagggggtgggggtagggattagatgagaggcaggcccgcagtgagaaggccctgtcctgtcctgttggttttggagatctctacttccttgttttgtggttgaaacgaaaccagctttggctcctaaaacaaccattattttctcttaatgtggaaaacctcggtgatgcaagctccctgttgcaggtgggggtcacattatggttaaggacaatgggagcatttagagtctgataggacctttcagatgtcatctagaccggcttgcagggtatcaaggtccagagagataagcatggcttgcaagtctgagttttcactatgtggagggtgagttgcacagtggttagaacaaaacccaggactccaaatgccagaacctgagtcctgcctctctacagctccctctcattaacaccaagtgccaatgaggatgtaaattctgtgcccagcttaagtgatcaatacttttgggttcttacagcagtgtctggtgtgtattccctatgctgaacatattgcatacattaatatgcttgttataggctaatgagccaggtactaagcgaagtttatgagtcattacaaggtgactgacttgtgtttaaggagtagagatcatttagttgtgttaagtggctcacgagcatcacaaaagccaacacacacagtcccagaagagagagcagtggggcattgtagatagaatgaagaagagaggggagtatgtgaggagagaaggggaaccagtgggaatggggagggacacaggagggccatagtgaaggaagggataccagaaaagtgtgtactaatatatacacgagagatggggagatggctcagtggttaaaggaccagagtctagatccccatatacatggcacgcgaatgtggcacacccctggaaggcagagacagaggggcccccacggaagactggctagtgagaccaagctattttggtgagctctgggtttgattgagaaggcctaaatcaggggaaagggcagaagaggacttgaggatgatttctgatactaatcttgggcctttatctgcatgtacacacacacacacacacacagacacacgaatacatcaatacacatatgcacatgcacaccatacatatgaaaaatatacatgcttgaaaacatcataattaaacttattttttataataattagaacatggattaaaaatacaactcttccagttgcatcccagtcaaggagacacggaggcaggcttatttcattgtatgattgaggaattggaaacctgtttaaagcttacagtctgctgaagtcagggaagtgagggacagaggcactgcactgtgagtcatggcagcaggcagggcaaggtttggagagactcctccttccaggtttacttcctgtgcagtgggggcagatgcatgagggccaagacaggtttgctgggggctgctgtgccacaccacatctcttggtgcagttagaggtcttgccagtgcaatggatgctggcatgcctccactcctctttgggctgttctagggagatcatgagaaattccagaggactgtgctcagagagcctgcctgttgctctgtagtgatgcctccttgttgggcttcgggagggtcagctgtacagactcccaaagattggaaggtcggtttggtagactaaactttctgggccacctttctaaaatgtcttgagcttttttgtttttaaaaaggttaattcttaagtgtctttgtgtgtgtgtgtgtgtgtgtgtgtgtgtgtttgttgtggtatgtgtagtgagtatgtatgtagtgtgtgtatgtatgtgtggtatatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccactcccactttttggtcctggcattccccctgtatggaggcatataaagtttgcatgaccaatgggcctctctttccactgatggccgactaggccatcttttgatacatatgcagctagagacaagagctccggggtactggttagttcatattgttgttccacctatagggttgcagatccctttagctccttgggtactttctctagcttctccattggggaccctgtgatccatccaatagctgactatgagcatccacttctgtgtttgctaggccccagcatagtctcacaagagacagctatatcagggtcctttcagcaaaatattgctagtgtatgcaatggtgtcagcgtttggaggctgattatgggatggatccctggatatggcagtctctagatggtctatctttttcttcaaaaacactggtctcgtttggcatgggacattttctcatggcttctcagctgcttcctgctggatgggagaggctatcagagcatcctgttggaaccaggaaatacagaaggaattgaaaatcaaaaaggactaggacataaaatcagataaactcacagtgcatccctacagcaacacatcgcgtttacacctgtctcgaccgcagacagtatcattatggccaaatgttgtctttgtcagaatgtgggagaagataagaacttaacatcatgatttggggagattaccagaaaaacagagtgagcactatcaaacattagttacttaaacaaaccaggatgcttttagaagagttatcttattttaaattgtgtgtgtgtgtgtgtgtgtgtgtgtgggcaggtacatgtgagtgcaatgcctttggaggctggcggtcagatcgcttaagctatgtctccagtcaccacaccaggatatttaaagcctctccaaacttaagtcagttcatgtgataaaatcaagtacagatacttcttttgtccgttatccttgaatccaccaaggcaagaagccagaactcagcatgagactgtaagcaactcatggtttttattgtgatggggaaaaaaatatctcatgagtctggggtgacttgagagcagcctagaagaattccaaaaagtgttctccggctgagagaggagccgtgagaggaccagctggtaaaggcacttgctgctaagcaccaggccccacgtggtaggagagaattgatttccataagctgccctttgacctgcacatgtgtgcactagcatgtgcacatgcccttgccctgcaaacaaacacacaaatgataaataaatgtagattttgtttgttagtagcaatgacaataccattatatttcaggatgtggtggcaccaaacattcacataattgacagtttttgttcctccattctgataaggtgacgttgcacaagcttggaaggtctcagtgtcctctcctgtaaagtggggtgatcagtacctcctgacaaggaatttggggtgttttaagtgtccaataccttccaaactcaataaatgagaattttccggttgactttcaaatcccgtaatattcttcagctgtctcaaggggtgtccactggatgcttctttagtcaactgataactaaggacagagagctgggttgcattaaaatcatctgaagagctggaaaggttcgtaattgcttgtttgtggagtcaggtgtcactatgaagctgagactaactggtcttatatcctcctctctcggcctcccagctgctgaagtcacaggcacgcaccaccatgcctgggttacattttcttaaatagctttgaggatcttatctgtgtaatccagttgttaagcctttggttccggttaaatagaaaggatctgaggttgcgtgccaatgttcttaaatctgaatgttaaggttctgggttgatcaatttttcttgtgctttaaaattgatttcaattctcagggcagctgagcatttatttcccatgtgcatttcttaaggctgtggtcattcccactggaagaaccagaccaaggcattcaattgtgaagacattttttcctctcttcttaatgctgaagggcaggaccccacaggggataaaaatcaattatgatccatttacaaatcaaaagcagtcgaggtttgggtgtgcatttcttttgtttttagaaggaattgtaaaaggctatgcaatccacttaagaattcaagccccttccatttttattaaataatgagccctgcttttacagaggcctttctgttttctaaagagcatttgcaaacattacctcacttaaataaatatggtgaattaaacagtaagatgctactcaatattttatacagttaagagagggtcctggggctggagagatggccctgttggtaaagtgcttgctgcataggcatgaagaccccactcaatctccagagcccatgtttttttaaatgccactttcaaaatgcactctggactgcagctctgaagaggttcagataggcggatcactggacctcactgcttggtggccagacagcctagataaactggagggctacaggttcagtgagagacctgtctcaggataacgtgaggagtgactgaggaagatctagtgttaccatctcacctccacatgcatgagtgcacatacatatacatccacacagatacacactcacacactcatgcacacacactgacactcagtctcatatacatactcacacactcacacacactcacaaacgcacacacacttatgcacacatacactcaatttcatatatatacacattcatgcacacacagttacagtctctctctcatgcacacacacactcacactcagtctcatatacacactcttacactcatgcacacactcacacacacacacttatgcacacacacactcagtctcatatacacactcacacactcataaacacacagtcacagtctctctctctctctcactcacacacacacacacaaatggagactggctccacaggacagtcatggctgaaaggagaagctcagaggtctatgaaaatgatgctgggattcatgagagtctaagtttcttattggagccaagacctttagacaaaaatggatcctatacctcaaaaaaaaaaaaaaaactttccacacattgagcaggattgctgtttaaattgtatcttctaacattacagatgcccacagtttctaagtctcttttaaaagtgcacgtgtgtggcttagcatcttgaggattgttgtctgagaagcacccagatcagaatccacttgacaataaataccttttaggagctagaaggtaggacggccacttgaacctgtaattatacttgtgaacacaacattgggggggggtcagcattttcttgttgttttgtgagacagagtcctgctgtgtagctctgactgccttggacctcgctgtggaggccggtctggctttggacccgtggtgatctcctggctttgccttctgggtgctacagttactggcttgtgtccctctgcctgatcaatgttcatgttcctgttgtagagatgagaaaactggggtgcagagaaagctgatgaaggtcttactgaaggtgtattaagcacagggagggttgttggcccttaaagtgcagcgtaggtttccctagatggcctgtttctgttggcacattgattcctttgtgatcaatgagggcacaaggaaagatatccagttactacgttatgatctgatggcttttcaggacattgtagacttctagtgtcacacttcagtttgtttgtttggttggttggttggttggctttgttttcttagatgtaacctagaggtgagccctgcagtcactgagagcagacagcattagcctggtgaaactcagccagaggcaggcaggtttgctctgcagcccgggtctctctcagtcccccacattcagctttcatagcttagctgctcatgtcctatcactggttatgacaggagcgattcacccgtcagttctcagctggagctagctctcactgcaatgtgactgtctcatgcccaggaggaaatgtaacccagtgtggaccaagctgaatagatgctcgctgttacgcagcttgcaggctgacgcttctgaagtgggaggaggcaaaatcttgctttctaatcctgagtggaagcaaccattaatgggctaaaaatgtttattttacttttagttatgtgtgtgtatgtgtgtgtgtgtgtgtgcatgtgtgcgcatacacatgtgtgtaggtaggtatgtgcatatgagtccagtgcctgtgacagccagaagggggtgtcggattccctggacctagaagtctaactatatcaagagcagtcagtaactgctcttaacagttgagccatctctccagacgcttttccttgtaatatttaattgcccaacatatgcataacaatgaacattgtaaccatttttgaagtgtgcctcattcttgtctacactgggcagctgccacctctctccagaagtcttgcgtggttcctatcatcggaaaccatccctggtcaacagcagttttccatctctttcgtctccagctcctggcaagaacctccccactttctgcatgagagctcactctgggtacaagcagaaccttccactgtgtgacttgccaacttcatttagccctgtctcctcagggcatgctccatgtcctagaatgcatcagcacgcctttccatttcaaggcagcataatattcctttgtagccatacagtagcattttaaacaacccgttttcccgtgatggtaaaccttcctctggaaagacagcatgagaggcggcagaaatgggtgagatagatatcatcagccccgccctttgctgctgactgaggctaacgcagcagccctgctgtgttagctgaactgctggctgtgaacaaagtcgccctgacctacaaaatggatgtaaaaggtcaaaagtattaaatattccctgtaatgcttttcttctcgtcaaatgcccttcttgcttaattgcttgatgcagttggctttcaggacttgccacagtctactcgggaactgcttcaagacctttttccttcttcctctctaacctcgctattaatagcataactcttatttcccacgtagacggaagtccatcagaacggaaggtagtttatctcttccctttgggggaggtaaatgcccgttttattactaacgacctgtccgctaataagcacagacccctaaatttttgctttatcttca

SEQ ID NO: 1100 - DNA, 525 bp, Mus musculus
ggaccggcgccggagggctccgcgcgctgctgctggcgctggtggccgcgggggtcccggccggcgcctacaacctggacgcgcagcgcccggtacgcttccagggcccctcaggctccttcttcggctacgcggtgctggagcacttccacgacaacacgcgctgggtcctcgtgggtgcaccgaaggcagattctaaatatagcacttcagtaaagtctcctggagctgtgtttaagtgtcgtgtccataccaaccctgaccggagatgcaccgagctggacatggctcgagggaggactcgtggtgcgccctgtgggaagacctgcaggggagaccgggatgacgagtggatgggggtgagcctggcccggcagcccagagcagatggccgtgttttggcctgtgcccatcgttggaagaacatctactacgaagcagaccacatcctgccccatggattctgctacctcatcccttccaacctccaggccaaaggcaaggtgctgattccctgctacgaag

SEQ ID NO: 1101 - protein, 175 aa, Mus musculus
  VARIANT (1)...(175): Xaa = Any Amino Acid
TGAGGLRALLLALVAAGVPAGAYNLDAQRPVRFQGPSGSFFGYAVLEHFHDNTRWVLVGAPKADSKYSTSVKSPGAVFKCRVHTNPDRRCTELDMARGRTRGAPCGKTCRGDRDDEWMGVSLARQPRADGRVLACAHRWKNIYYEADHILPHGFCYLIPSNLQAKGKVLIPCYEX

SEQ ID NO: 1102 - DNA, 389182 bp, Homo sapiens
  misc_feature (1)...(389182): n = A,T,C or G
atacttatgtagtcacttttctgtcttgaggcacacaaaaaaaacaaggtcatatcttttaatgtctcagtaaaacagcttgagccctccccttatcaccttgagaaacgcctcaggccttcctccaaggaaagacccccaggatgcttagtcatatccaaaatgtcaatccctgtcctttccaccttgcctttgcagtcagaacctccacccaaggccagaggatgccccaatgtcatgtgcactctatctaccccactggcatcccaggcagtgtgatcagggcttagtgtcctgcttctgccacctccgcaactgctggcacagaccttttcatagttgcagcagaccctggggcatgtggagggaggacccatcttcgactccccattgcactcagcagatgtggccaccttccagtatcactgactcagacacacgcacccagcccttgcccagggtgcaagcctgccttcaggaaggatgactgcacccaggctggctgtctcagctcctggactcagaatcactattacctcctcaaccccaacttcctgcaggagctagttcacctgttttttatgtcagggaccttggggccttccctgtcactggatttgattcggagtcatcccaatctcacaacatattatttattccccccttcatgtctttgaataaaattgatgcacccagaaggtataacatgtatatcttgcagcttcaagtacaagaggtcctaggcttcaacttaaaaactttctgggggaaggcataagaaggcttttcttgtgggagcgtgttaagcagcagaaggggtcccaaaacgtgtttagtgtttacccttccctaaagacatttgcttagagtttggagtacactgaggctgcctgaaagaagacagggaagaagctagaactgcccttccatttcctgcaaaatttcatctcctgccccactcccctactcgtaactctcctttagacacactcctctatggcagacaacttctgatacattcaattccaggtactcattttttggtgaatgttccattgcatctgaatgatattgaagtgaacttctcttacctgcatgtgtgtgcacacacacgcacacacacgcacgcacacacacacacgtgcgctcacatgcacatgcgcacacacacgcacatgcacacacgcacgcatgtgcatacacatgcacacacgcacatgtacacatacacacacacacatgcacccaaggtcaacaccttaaaatcccactgcatttaaaccatgagtgggtgggaccttgaggaaatcaccaaagatgtttcaggagtctccctctgatggcccacatctgggaagccctggagagatgtggatttgacaatttacgaaagctaaggtagagagggccctgaaaaaggagctggctagccggccgctgatgtgagagtgaggtcatgggtgcttgggttgtgactcacctctccagcccttcacagggcacctgaagcacctgggggtttgagggcttgaacacttagacaaaggaaggctctaaaatggcccactgaaacatgcagacaccttgagaaaagtgttttgagtttttcttttactccaaataaaaatagctattttaaaagagtggaataaatgacataataataatggcactaaattgctaacatgtaccagttgcttccctcatgctgcgatgtgcagagtggctcattacatttaatcctcacaacaaacctttgggtatgattccctgtaacaaatggggagagctcaaataacttctcagggccacatacctgatgctgtggactgaatgcatgtatcctccaaaattcttatgttgaagccctaacccccaattcgcctgtatttggaatatgaaagtaattgaggtcataagggtggggttctgatctgatagaattagtgtcctctctcttgctctcgctctcccctccctccgcctctctgcaagcacgaagaggtcatgtgagtccatagcaagaaggggaccatctgcaacccaaaggaagagccctcaccagacaccaactctgctgcccttgatcttggactttcagtctccagaactgtgagaaaataaatttatgttatttaagccacccagtctgtggtatttttttatggcagccctagaagactaatatatctgacaagccactacattgggattacgagcaccacagccctcactgttactcatcaccctaaactgcctccaacaaatatcatcattttaatattttatgttttgctaagccataggctagctttaatatttcaattgaagtgagaagtgtttttaaaacttggcattatgttgtacagctgtattctaacactgatggttgttgcttaaagccgtttcactaaatttagatctctggaaaaaaatttgtttgagcatggaaacaggttggaaatattgcacccaataataacagtttaacttttggcttatgaaatacttcagtgggaaagtatttgctcaaatctctgcctgctattatagttgaaggcttggcgatagtatttgcccttcctctgaactttctggatatcaaagccacgtggaagtatagcttgtcttatgtatgaaaaacagggcaaggcaacttttgaagaattgccgttaagaggtgcatttagctgtgtcaatcatttagacaacgattatctggtatgtgaatgatccaaaccctttttatttttttctgcctcttttgaaaatactgtgaggagccatctggctattgaccacttcttccttccacatgatggctggtctacctacctcagttggcaaagtcccctcaacagaggccagggccagagggcagggcttgttaatagatgggaatgagagctgcccttggctcctctttctttctctgttgtgtgaaggtcaagttgtctcctcatttggagatcagatagctgtgtgtgcacagctcttgatccacttccctatttctaactttgattagtgactttggctttacggaggtagcatcttctacatccactgctggatgtagacatccactgtgtctctgtagacaattcaagcagtactaaaggagtgatagatagacgatagatagatagatagatagatagatagatagatagatagatagataggcaagaatagcccataatctcaaccataatcattattaacatttagggtaaacttccaaatctctttctttgtgcatatatacatacagatgcatagaaatttacatataccagattatagtaggcatgtccttaaggaacttgagttattacccttgttatgctgcagggattgttccttgtcagtgtgtaaagttgcatgccaaccttttgtaacaggctgtgtaaggtgctgattcaaccaaatagtggatagtataggctggattgtgcattgttaagaaccaagtggctaagttctttagggctaactccaaagaaaacccgacagttggcattagatgccatgtgccccaagaatgagagaggatgaactgactttatgggccttgctcttttggagggattagaactacagagatcacttttggggggagtgcagtgttcatgggctggttatgtaataaacggtatattatcttgtaatatatggggtgtgatgctgtcttctcttctaaactgaaaaaacttgattgcagaaacacatttggccctaagagttttggacaaggattgtgaacccatcatatggtcagtcctcatttcacatggttctatggtaactgagataaaatctcagactgcatcttcccaactggatcactgtgaggtttacataagataaagtgatctataacatgcttagtgcagtgtgagacacatagtgagtgagccttccttgctgctagcagtcctatcaccttacagcagcatctgctctgctcgagtgtctgtacccgtcaggtctctgcaaaccgggctctcataatcagtggggagtgtctaaacctccatttagggtcctcctacggtacactcacacagaccccagaaatgcaagcagtcccttgggggagacaaggaggatgttagagagttatggttgggaagctttgtcagggagaaattagcatttcccatcggagaccatgggaagggcactctagaaaaaagagcacaggaaaaagtatggctcaatacagggtccagaaatactcacctggaggaactatgtgtatttcctgctatagtaatatagcatagtatttgtaatgaaaaattgtattctaaacctaaagattactaagccaattggcttgtattaagagccttagatatctacctagctttgacctagtagttaagcatttaggaaataatgagaggcagataaaaatctacaaatgtataagcaaaaagaaaaaaaaagatattagagaaaggaaggattaaaaagactaattaatcttaagagtttttcctttttcttttctttctagagacaaggtctcactgtgtcatccaggctagagcatagtggtggaatcatagctcactgtagcctccatctcctgggctcaagtgatcctcccatctcagcctcccaagaagttaggactacaggtgcataccaccatgtccggtcacttttttcgccctagagatgaggtctcactatgttgtctcaaactctggcctcaagcaatcttcccatcttggctttccagaagttgggattacaggcatgagcaactgtgtctggcctccaagacttttttgaggcttctgaaaagccaatgttgttttcaccccaacatttaatcattccaatattcctctctgcagtgaggcaggagggagcagagcagtataaccatcacttcttttgcattgttacagtagcagtaacaattcaacaaagtatgtatgtaactgtttaattgtttaacaatgtaactgtttaacaaagtaactgtggagagcaattttgcacagcttatagaaaacgccaatgctaggtgagctgatagagcatgctgttcagtttgcagccactaaggctaatggaaaaccttcagattccttcttgaagtgagagcataaaggaatggagggcatttggttgccatttccgttgggaaattggacaagaggttcagtttttcaaaagtctccattccataaagcaaatctacattttgcatggccaggtttgaaatagtatgcctctcccctccagctggtgaccctggagacacgcccttcaggtcaagtctctgtaaaacagcttattctggcaactaggaaattgagctcactcttgagctcagattatacgaataactaatacatgtttagcgttttatggttaggaaatgctgtcctgagaagctcatcaataggtttattagttattggtatccttgttttattgatttactaaaattacacagttgttcgggcctgggagttaaattctcttcaccagatgccaaatcctacgtttttcttaccacatcatggtgccacaggttaaggaatacagtgcagggttctgaatctctctcctgtaggacagtgcttcccaagcctggctacttgacaaatctcccaagaggtgttggaaatgcagattcctgggccttgcccctagattctgacctagagtgttattagtaaatctgtatttttaaatagttgcctggtggtctaatatacagtcaggattgacagctactgtttagttaaatcaaacaccaatgctataatttttaaccgatatcatttttagggtttggtttccaaagttggaaatcagtgtgttttagatcagtggtttcctgtcttctaaaacctaccttacctttaaagaatctgttgaaatctgtggatctttccctaagaaacacacaaacacacacatacacacttttatatataattctagagggctatattagtttcctgcttctgctataacaaatggtcacaagcatagcggcttaaaacaacaacatttattatcttacagttctggatgtcagaagtgggacaggagtctcactggattaaactcaaggtgttgcctttctggaggctctaggagataatccattttattgtctcttccatcttctagaagctgcctgtattacttggctcatgggtcccttcttttatctccaaagccaacaatgtggcatctctctgaccccacttccacttcacatctctttctcgtgctacagccaaggaaaggttctctgcttttaaggattcacataattagactgtgcccagccagataatcctggaaaatctttccatctcaagacccttaaccttaatcacatttgcagtccttttttgccatataaggtgacatattcacaggttccagggattaggagggggactattagtctaccaaccacaggggatcttaggacctctgaagcaacatggaaaatgagtgaactctaggttaggagcatctgttctagattccattcattctagatgttaaatcaacaagaaattctgcttgcctacaaataacagaatccctaaaagcagtggctcttataaattaggtgtttactttttttcaggtagtaagaagtccccaggaaggcatcccatgtcaggtgcagcagttctagcatgtgacagctgaagtctctgcaattctcctggcctttcctttgaggtggccctcaaaacagctgctgcatctccagccatgacctctgtgcttcatgcaagaggggcaagggcacaggacaaaagccataagtcagctgagttgcctctcctttaagaaacctcctgagaagcctaccacccaaataacatgctcatatctcattggccagacactgcacatggccactctgtctgcaaaagagactgggaaacatagttttatttatttttaaagctaggcatattaacactccactaactctgggctttgttagtaaggaaaatgggaagtataaatattgggaagatactagtgctctctaccacagatgaaaacttcagccaggcacagtggctcatggctgtaatcccagcactttgggaggccaaggcaggtggatcacttgagctcaggagtttgacaccagcctagacaacatggcaaaacctcgtttctaccaaaagtataaaaattagccgggcatggtggtacatgtctgtggtcccagctacttgggaggctgaggtgggaggattgctggagcctgggaggtcgaggctgcagtgaacagtgattgcaccactgcactccaacctgggggacaggagcgagacactgtctcaaaaacaacaacaaaaccaaaaaaagaaaaacaaaagaaaaccttgtgttttgtgttctacaacgagaattgatcatttttcactctcacacaaccaaaacatgaagaaagttaaaagtctccttcaaaatctcccccatagtgcctcatcctcttactaagcttgcttttctttaagcagttcattctttttttttttcatttttcttgagatggattcttactctgtcacccaggctggagtgcagtggcacgatctcggctcactgtaacctccgcctcacaggtaaaagcagttctcctgcctcaacctcccaagtagctgagataacaggcgtgcggcatctcgtctggctaatcttcttatttttaatagagatggggtttcaccatgttgaccatggttggccaggctggtctcgaactcctgacctcaggtgatctgcccgctttggcctcccaaagtgctgggattaaaggcatgagccaccgtgcccagctattctttttctttcttttcttttttttttttttttcagatggagtcttgctcagtcacccaggttggaatgcagtggcgcactgtcggctcactgcaagctcgacccctcagcttcaagcgattctcctgcctcagcctcccaagtagctggaattacaggcatgtgccaccatgcttggctaattttttgtatttttagtagaaacaaggtttcactgtgttggccaggctggtcttgaactcctgacctcaatccacccacctcagcctccccaaagtgctgtgattacaggagtgagccactgcgcccagccagttcattctttcaacaatgtttaagcatctacctaagcctggcactgagctgggccttgggggctacaaagatatctaagacttttttctccttagagagctataccgtctatggagagggacagagagcccccaaaatgatgaacatgttctaagtgttgagatagaggcatgtgaacactctttggcagcccagaaaagaaaggggaagaggaaatggcacagaaagggtgaggcaagaactggcctggaagtctaggatggataggattttgccagttgaagaggggtaggcacatttcaggaagaaagaacagcgttggagaaggcacagatgtgtgtgaaaacccctgttggacacgttcaggggacagctagaagttgtgtgtggatacattgtagggtttgtgggaagtgagtcaggaaaggggcataaaatggggctggaaagagagatggagcctccatgtgaagttatgctaaggagatcgggctccatcctataggcaggagtaggtggtggggggcaacgggaagttttcaaccattatccaaactctgttgtagaattaaaaagtggaaagaagagaacacaggcagggaaaccataatagtgtggtcagacttcaacatgatagcagtcaattcagtaggaatcttgaatttgagtagtcaagttcatagagacagaaggtaggaaggtggttgccagaggctgggggtggggatgggggtagggttagggggaaagaggagttattgtttagggtataaagtttgttttccaagatgaagagttgtggagatggatggtggtgaaggttgcataacatgcatatacttaatcccccgaactgcacagttacaaatggttaagatggtaaactttctgttatgcatatttacaattacacacacacacacacacacacccttcagtgcacgcaaaccctgctggactccaaccttcagagcttccgatttagcagggctgagtgggacctgaggatttgcattttctgacaagttcccagatgacgttgatgctgctggtccggagaccacacttcgggaatcactggtgtacgagaccaagtgactagaatatggaggggtgctctgctcgcttccacgtggctactattgttatgaacaacaacagccggcgtttactgagcactgctcctacagcttatctcacaactgggtgaaggagcagaggatgcgcagggctagaacctggagtctaaactcgtccttcacccgggttgctctggatcttactggttgtgagacagggagggaaagagagacaaaggcagggagacaggcccagcagggccggcagagcctgtagtgacggaggggagcagccttatctccgggaacccgagcgccccgtgcgcggcggggagggggcagttcggggcgccccggcgggtcccaggggctgactcccgcccgggaagtgcgcgcagggctcacggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgctggcccagcgagcctcctgaacctcgcagggcctggaggagtcggggcactggagctgcacccctccccggttttggggaacccctgaggaaggagtatagcctctccagcgccgctgcgcggggtggggctccccaggggcagggtgtctgggatccactggggcgcactggagcccagagccccggcgcccccccccccccccagctcctacaagaccctgggtggaagtggagcggagaagctcctaggatatagggaagaggaaggtgagggagcacttcccagtgacaccgccggtggggcaggtagttatctcttgggagagcctgagtctcatctcatatgggccattcgacccggagaccttcaccagaagccttaagagagagacgtgtttctatagtggccaaggggtccagttgtcccctgagtccggaggggtgggcctaagaagggggcagctctcccccattaagcaccataagccgagtggtacagagcttgtgcccaaccccagcagagaagcactaagggggggttggtgccctccttggccacatcctctggaccagagggtataaacagccacacagtggtcacttcttgataggagagagagttaggctgcgggaagttcccccgttcaaggtcgtgcctcatgggggcccaggtgacagccaggccggggttgattttattgtgtattcaccagcctgagcgtccttaggggtggcaggcagggaggtcgaggtcactgatgctggtgctctcagcatgtagttatgcaggagagtcactgctctgtattggacagaggctgatggaaaagggtggtttgtggatcgcagtactcaagcattcctggaaaaggggactctgagaccagcccactaagaatcatgctgttcaggagatcagccttcaagagaaccagttttcaaagccctcacatagctctcgcccagctccacatctccctctctcacttactccagttgctgggtataagaccgagtgtgtctgttcttaacacttgtcaaattccccttttaaagcggagcaggctgaacatttttctgtgtcctgcagactcagggtctgaggttgaagaacacatcccagatccccacactaggcaccaggcacgcgggaagcactgtcaaaaatgggagggctgctgtggacagcgggctgctgagaaagggcgggcagctgagcaggcagccaagccagccggagcattgtgtgtgatctgcaggctgaggctggctcaactgccttggagctctttgacagctagagggagagaggccaggccactgtcactgtggatttgcatgggccacaggtcaaagccacactgcctgggaaaggaatgggtagagacgagagcagatctgacagagaaaaggtgttcagcctactttgatttaaaacggggatgaagaaaagctgtgtgacatgagcagatttggccagtgtgggaaaagacagtctggccttcagcttggtacccagggtaaatggtagggagtgggtgtggagcagtaatgctgtgcatattcttgttgccagttgagatgtgggactggtatttcaggggtccatgggaacccatgtgtctgggctgctgagctcaaaagtgccctctcttgttctgatacaagctggctactctttgtattggagtgcttgtccccatagctgttcaggcaccaacttaactctactgaaatctttttaaaataatgcttctttttcctccctcacccaccatattgacttaattttttcttagattgtgttctccccttgatttctgttctcatgctgttgttttcaagtattttcctccccatccttttttctctttccctttttcccagtattctttgtcttagaccttgaatgtattttttgctgtatgtatgcttgaatgtgttttttacccaggcttggtaaactatggcctttggagcaagtgacttccaacatcttctttctcctttttctttcctctagaggctagacttattgtgcaaggctgctgaaacttaagccaaaggattcttgcttgcataggcccctattaatgccttgtccccaattttataattttatgttaattttcttaaagttagtcaccctaaatttgtaagatcaggtcctgtgaattctggatctgtcctaagtctgtaccttaacttcaactgtggggttggttgattgacttggtaactgattgttggtcgcttactcctaagcagtacctgagccctggatcttctagtcctgcttgagggacatgtcagtcattttcaattattcgtgattgcaaacagcagcaggggtaaacaacctttaacgaaacccttgaggacaatcttaattatttcctttgaataaattcctgggcttagaattgctgggtcagagaggatggaagcttcaaggcattctttatgtattaccaaagtgccagtgaagtgtgtgtactttagaaaaatacattaatttattcagacactggaggcttgggagtagttttgcaaagggctgctctagtgcactgaaagagtatagaacctacatgggggtgacttaaaaggatcacaaatactcgtcaaaatgagtgaggaaggtaaaatatagacatgaaagggaaaagcagtatagcaaaactttgaaaggaaaagaagacatgttaattaagccttgtatcttacgtctctcttctcgaagaaattattctttgttacttaattcaatattttgcagtctaagatatttgcttcatgctaattaactacctgttttacaggtgaaaagatgtgttgtctctagggaaagggagggagaagaatgtgctggaagtggtagggggagagcacagaccccaaagtcagcacggactctgcaggcggcagagtagagcgttcccatgttgagggacctgcgggtgtacatctcaaagcatgtgaatgtgctctgttggtggaactagcacttctctaatcccataactgagcatttctctcaattattttgtagaccaaaattgtcactaatcggaggatcctagatccctgtgtaagtgtgggggtgatcttgcttttcccagccctggtgactgaacccagctctgtagccatatcacactgagcacagagccccagacccagcttctctcagagtacttgcttgagtggtcccgctgtcactgtgctctgggcagtgagaactgtccccatggctagatggaccagaatatcctggacaatgttccagatgacgtttgtatcagctaggatacaaacatgcaagggactcaattttctttttttctaataacacccagagtgtctgcctgcccagagccagcttcctctcctatagctcccactccctgagtcttctggcgtcctttgaacaacaacagtaagtgccagggaacatggacaaagccgatttctgtccccttcctttagacatggaccggttactcagctgcagggctgacaactgtaacaccctgtgatataaataaatgctgcctggctggcgtgcagcctccagagcggacgtctttcacaccccaccccgtcccctcctccttctctgccccagacgccctggagtccaaagtggttgggtgcactggcttcctttctggagacgtgcttcctgctccctctcctgggacacatcaagacggctgtgcttaggcacagagcgagtgctcggaaatggaagatgtgctgggctttttgctttgttaaagttgtcagagtgttgttcagtgaggaataggaggcaattccaagccaaggagaacatatccttgatttgcatgaaggttgagaattaaaagaacaagctagatagttctggtgagctgtctgatgtagtcaccactagccagatatattggtatgtaaattaactaaaaataaaatttaaaatgcagcttctcagttgcacttgccacatttcaagtactcagtagccacatggggctagtagctactgcattggacacaacacagagagaacattttcatcatcacggaaagttctactgggcagtgtgggtttagagcaatgatgtaagtcttaaagggctagacaaggatcaaaaggagaggtaagaaaaagaaaaagaaaaaaaatcaacccatagcatatgtgagtactaaaaccgaaacgggtgcttacatctaactaaaaattattgcctgctgaagaggttgaattgtctttctactcataaaacaccgcagggcctgatctatatttagggctgggggttcaacaatgaaaactttttgctcacaatctgacaggtgagaaaattgtggggttctagttgtgtgtctcaaatgaaatttaagatctaggctctgatgggggagaggcttgtcctcaggcaggcatgagttgttcagaggggcagaagagaaactcctgtgaagggaaaacatttagaaggggagccctgggatcataggacctgctgcccctggccctgcccgtcttgctgaggaaacacccagaaatggtggtgggagccctgccttctcataacctcagtggtgagcatctttgcagagttcctctgtcctgtgccagactctaggggaaggtgtaggtccgcttcctcatttgaatttttctagggaaatggcattttcagacattgttcctggtcctcactcaccctacagagcctgctttctcaagctctcaagaaggaacaacacatatatgaggcctgagttccaaggggatccaaaaagcatcttctcggggtttctgggaaatttctctgaagatctggagaagctggcaagggtgctgttttctgagctagtgctgaatgctggctgggggcagagacagctgtcttgcccagtggagaaccttccagggcaagaagacagtcttgtctcaaccagtcattaacggccctgagtgtgagagtgtgaagggccgggccccagccagctctgattccctggtgacatgctgctgttcaggaaatggtctcctgataacttctattgtgatttgttcagggaaaatgttgtttttacatttgttaaaagcagccatggtgttctctgaaattccttgctttcaaggggttgcatggaattttaacaaccaaaatgaatttcgtcagatagtatctacaagaagtcagatgctttcacaggcataatattctttagttgagtctttgtaacatcctggtgagtggtttccagtttgctatttggggaactgaggcttacagagttacacgccttgttcaaggcccaccccagcctgagagatcaatgcacattcactgggggcttgtgtcagtttgcatcctttaggaagcagatgctaggacagagataggagtgtgagagaattgttgggggcgggtattgcctgtgaaagacaaatggggaagttggatgggacagagagagcctctgactctatgcagatctgattaaagtctcagtcaactcaacagagatcactgggcagaaatagctgtcctctgccagggtcaggtattggctggagctgtctgggaagagcacagcctcagctggaatcctgcagcagatcccaagaaagctgcagctggaggctgtcagctgacattccgccttgcagctgaacagcatgaagtgacccacacctctgtggctgccctggagcctgccacgcgtgaatcactgtgttgggagggtgtgagatgtgctccttggcctgcagtgtggctggggatcatctttgctcatacctctgtaatcagtgtgtggagcgtcaggactgacagtagggccattgggactggcccagaaacagaatcctgagcaatcttgccaccagctgactcacaaggtgcctctttctgatgtcagagaagtcacaggtgatggatttcagaagaaaggagctctgctttacgctgagccaccgagttctctgaactgcaaatccttttagccaagtggatttggcgatcaaccaaagcagaataaaatgttttatcccaaccttcctttttgccagaaggagtcctaggaagccgatgtaagtccaagattgggaaaaatctacagtctttgaaaccacgggctcacttggtccaccaatgtctgttctgaccaaaaaggacttctgtgttgagtttaaattagcaacagtagcaacaataacaccaaaagcagcaacaatgtatctgaatattcagtagatgtcaagtgctatctacattggtactcataccagctcatttaatgttcccaacagtcctttcagctggtagccatttgggctgccataacaaactgttataggttgggttgcttataaatgacagaatttatttctcacagatctagagccttggaagtccaagatcagggccccagcagatttgctgtctggtaagcacctgtttcttggttcatagatagtggtgttctcactctaagctcacacagtgaaagggatgagggagctctctggggccacatttataagggcactaactcattcataggttatatcctcatgacctaatcacctcccaaagtccccacctccaaataacattaccttggggtgaagatttcaacatatacattttgagggaacacaagcattcagtctgtagcagctggctatcattttatccccattcatggaggggaagctgaggtacagaggcattattgcccaagttacatggctaatgagttgtcgagcacaggcctgtgcctttgcccacccaggctgactgcctgtcaggaagtcaagaatccgagtttgggggcttcagggcgctcaaacatctgtcttgtgaagttctgttctgcctgctttcctggaaaagttattgaattgcaatagcagtagcttctctgcggcaccctttggggatgcttattcatgacccactggctactcttggggggatgctagggttctgttttctggagatgtttgatcactgagtgaacagggacccaatgattctgccagggacatttgaagggcctcttctcacaccaaggctgtctagcattaagacagaagtgtcccaggaaagatggagtactctgcaatattccatgtatccctctaacctcctggggctgctttgttactatccccccatccactctgagttctactggctcccaccacttatttaggaatctctgaattggggaaggtagccatggtggccagtgtttcagaatcactcctgggtttgtaactttattaaagaaacccacacagagtcaaacttctgcaccagtgaccaacaatatgtgagaggatgatttgtatcctcaaatatttgaacacttaataaaaggcatgaatgggtacaaaaaattagaaagaatgagtaagaatgagtaagaactagtatttgatagcacaacaaaatgacaatagtcaacaataatttgattgtagtttaaaaataactaaaagagtataattgaatcacttgtaacataaaggataaacgcttcaggtgatggataccccatttaccctgctgtggttattacatattacatgcctgtaacaaaatatctcatgtacctcataaatatgtacctactgtgtgcccaaatcttttttttttttttttttttgagatggagtcttgctctgtcacccaggctggagtgcagtggtgcgatctcggctcactgcgagctccaccttctgggttcacgccattctcctgcctcagcctcccgagtagctgggactacaggtgccccccaccacacccggctaattttttgtatttttagtagagagtgggtttcactgtgttgggcagaatagtctcgatctcctgacctcgtgatctgcccactttggcctcccgaagtgctgggattacaggcgtgagccaccgcacccggactatgtgcccaaatttttaagaaaaataaaaaatcacggaacaaatttcctccatcttagctgatctgttggtgtgttaaggccacctgggagatggcctttcctaccccttcctatctagtgtccaagtgctgtgatgtatgtggatcccagagtaaacttggtgttgtgcagtacacaccagtaggcagcattgcagagggtcttggcacctcttttgcaccaggatgggtcctagagggtggatgttccagattcagctgagtagtgttcctgtctctaccttcattgaatccctggttccacagcaacaaccagatccacgatttttgtgccataaaagggggcactgctgagatgcacaagtgcctggtggccaagagagtgggctccagcattagccctgccctcagcctgccttactcagctctctgcttaggagctgtgtgatcttgaccaattacttcagctgtttgaacctcagtttccttttctgtaaagagtaataagggtacatccctcattaggttggtgggggcattaaatgagatgatatctgcaaagcccagagcacaacacggcacacagtaagcccttgatagatgctcgtagttatttctcttgttacttgatctgatttatgaaaccaatggtctttttcatcctgacttgagatgctgagttttctttcagtatttttgttgattcattcatttattcatcagactttgagtgttgacactcaacactgaaatgaatgagatattctaacatagacacactcttcattatgtgtggcctctaacatttttgttatgctctacataaatctgcatttttgtgcattcatttacaccctgtctgcttccaaaaaggatctgagatggctactttaaatggagatctttgggattgtaaatcctagaattttgcctgcctgtttcttctctgtgctcttggaaagccaaggagcagatgggaggccacccttgttatggggagctccagctcccaccccaggctccagataagtctgggaggtagatctacagttccaggatgggatacttttttaaaaagtaaatgtaaatgtattgccatatttctcttgaaaaaaaattatcacaagaaaccaacaagaagatatcaaggctttttcttagatctgccagaagtctgtaatttgctctatcccttggattttagtgttcacttgctgctttcagatgtggaaggaaaacctcagtccttttgccttgcctccttctccagttgcctcccctcagtgtgtctgccaagacctgagccccaggccagggcagcagcctctgacctttcactccctaacacacaagctggggaccaatgtcactccaaggttggaccctgcccccgtgcctctgcttttcccagttgggcatggactccaccaatttcattctctgacttagcgttatgtggtgtggattgtactgctctccctccatttactgtaacctaggctctccaggataaaaattattattgccaaccttttatgaatactttctatatgccagaaccactgtgttcatagttccctttatgcagagcaggctaccactcccgaagcacagagaagccaagtcacttgtccaaggttacccagcaagtaagtaaattacagagttgtgctttgaaccaaggtgggactgatttaatgctaaactgactgttctcagggttagccatgctaccctccctacctccacctccatcaaggccctgtccaaggtatcaggtttctaaggaaaaaggagaagggccctgaaaggaaaagggcttcttcggagggcatttgtgtctgctcttggccttgcagataaaataccataatctactcttgcaaatcaggccatcctggggtgcatggtcccccaaacactttcatctgccttttccttttgtgcctcatcactgccttgggagggggatcatgcatttgttattatccttgttttacagaaaaggaaaggaagggtcagagtggccaggggacttgtctaaagtcacatagctgtagctggcacactcctgggtgtgacttcggatacactctttagggcctattctactactccaccatgcctgtcccatctcagggccttcagtaaaagtctgtggtcctggttggtgatgagattcctttgagggagggaaaggagaccaggtagctagaggagccatagcaatagttgtcagctgcatagttggataattggtttggacttagcgggaattagtgggcgatggaattaccacggtccagattccgtcagaagtggcatgccttagcttgatgacgtatctgttttctatcaccacaatattgctgcatccctaacaaaccaccccaaaacttagtggcttaaatcaaccaccacctgtagcttattctctggttggcagcttaggttgggttcagctgggtggttcttctgttctctccaggactcactcatgcatctgtggtcaacttctgggttagctggttggctggctggcaaaggatggcttcagctgggagggcttatttttgctccatatgtatttcatcctcttgcaggctagcctgggcttgtacacatggtggttgggtagggtaccaacagaacaatcagaggcttgcatgatttcttgaagcctaagctcagaagtcaaaccatgcccctctgccacattcttttggccaatgtaagtcacaggtccagactacatcaagaggaggcagaaacacatttcatctcttgacaagagaagctgcaaagtcacactgaaaagagcagggatacaggaaggatggggaattgtggccactttgtaatatattactggtggtgaaagcatcctggctgtccctgaattactgtgacagtctgaataaattcctgcccagcgcaccagaaaagggaacaaggttctattaacctaaatagcaaacacagagagaggctctctaaaagaaaatgtttactcaggaatagggcattgcagtgggaatacatgtgtcacagtaatctgcatgaatattcagggaggtaaaggaaaacaaaggcttttaaaggaaaaatgaggattacttaattgttttgagataattatctttggatacaaggatcagtgacaagggtggcaccagtttgaggttggatagagagttgctaggtagatttcctcacagaaggtgtgagtgtgtgtgtgtgtgtgtgtgtgtgtgtgtgtgtgtaaggttgtgatggcctttgtgcaagattgtgtttttgcagatttttttgtgctagttcttgttatcagttgtttatgcatgaaaacctttccttcatggcgtcccacagctctatttgtcagggttttttttttttttttaaacataagtgactccattttgattctgacaacttttgcaattctaaggatctatgagctcttgggtgctgccaggagttagaactgggatgagttgagtgtcaaggtgtttgacctactactgcccagcagtctaacatttctttgaacacctactttgtagcaggcactatgatgggtgttttataaacattcttttgcttaaaccttacaagaaaccttcttaggtacacttttattcctcctgttttacagaagaggaaaactgaggcttggagtgtttaagacacttgtctaagagacacagcttgtcagcagtagaggcaggacttaaaccctatgttactgcctgtgcttcttacactttatcaccatgcataactttcccataaagcttagaagccaggtagaactactggcttaaaaccctagaaagcagtcagtatccactgcttaaataccaggagcctcagtttccccaaatataagaagagcttatgaggcctttcaggtcccatggctccattgggcaagcattggtccctagtgagtcccctccctctggaaatgaagggtttggtgtggtcagaggtggctatcctggcaccagctcttcctttactcaagcctgggctgctttctgcccagtaagggatgcggacaattcctggggtttccccgtggtggacacacagtgaagaatttgactcatgtaaccaaaacgtgggtccctggggaagctttggctttgggatcaaatgctgaaagcaaacctaatgggtttaaagtttttaatccccagttgctgtccttgatctggctataattttgcctgtggaatcgctgctgtggtgtttgtggggagggagggaatctttgagacactgtcagttctcagtcctgcccagggaggcagctgcggctcagtccttctctgtcacccgctctccagagaatttacctgcagattaccctcaaaacatgagacaggttcagagcgaggtgggcggctggaatggagccttcacagacagcttgaccacacacagggagctcaggaagcagctttgttggaaaaatgcagggcacttaaactgccacaccaggagggggtttggagaggctggaaagagcatgccattggacacagacactctgggttcaaatcccagctctgccacttactggtggtgtgacccaacatctctgaatggaaaacacatgagaggctgcctgacaggatggccatgagcaagaaagcacccttgtgagcataaccagtgttggtgcatgaaccgatgcacccacactgcttattaagagaggcaaacctctggttaacaccatgacagcagtgtcaatgctttggaaaagcaaggtgattgaagttcaccttttgagtcacctgagcctgatggggaggggaaggtcttttctcttccaaaccccagcatgccctttgacatgacggagctttcacatcagagttctcacttcagagctgccctcaaaggctcactggggcttgctcaggtggggattacatatgtgagtagctggcaccagagggggcactgggtacctgttggttcccttttcctcctttcaggctgatgtggggtgggtagaatagggcacgggtgatgtatttgactactggggtgcgtgctacagcttggcatcttaacatgaataaccatcttaacctcctctggccacctgcttccctatctgtaaaatggggataatattagtacctcccgtagggttgctgtgaagagtaaatttgatcctgcccgcaatgagcctaacccagcacctgcacactctacgtgcctgctacatgctggttgccctaattagaagtttagagtcctgcattgatgagaggacctaaaaggcttatgaggccaggcatagtggctcaggcttgtaatcccaacactttgggaggctgaggcaggtggatcacctgaggtcagaagttcaagaccggccttaccaatatggtgaaaccccatctctactaaaaatataaaaattagcggggcgtggtggcgtgtgcctgtagtacccagctactagggaggctgagacaagagaattgcttgaacccgggaggtggaggttgcagtgagcggagatcgccgcactgcactccagcctgggtaacagagcaagacaccatctcaaaaaaaaaaaaaaaaaaaaaaaaaaaaaaaagggcctttgagtttgtggcatctttaactggggatgggataggaggagagagccttgcttctcaagggcaatctcttctactggctccaaatgaacataattatttgtaatcagtttagatagttacatagtacttcttaaactatcaatcacctggagagcttgttaaaatgcattctgatttaatgggctggggcctaagattctgcatttccgacaagtgccaggtgttccccatgctgctggtctgaggaccacacttgaagtagcaagcaaagcagagaagtagcttgatgctttgttgatggcagcctgttggtggggacactcaggcccttttatgtggtaaccatagcagaaaggaacatagtcttgttgagagtaccaggagagttggggcgatgtttgaagtggctaggatgtctttttataacttagcagatggcatcttttcagtggcttgttctgaactctgggccatggtaatctctgtatcccttgggatcagcctggtaaacagccagctgaattaacttcagaaaagacccactcatgggctggcctgcggtagtcttgctggatggtggcctaggtacagagcagtgctgggctgcggaggaagccacgatgttctgtaaacacatagatacaagcacattcccgcgtgccacctcgtgagtgtcatgcatgtgtgtgcatgcccccttatctctagcctgattttccattgcacaggatttgggaaaaacctttcatctgaccagctgatcagaagttttgaactgaaaggttgttatcagggtttgaatcagctattgttgttagaaccattgagtaccttgggcttggaaggaaataataattcagcaggttcctttccactttagattttggtgtaaactttgtccctgtcagtcttggctctaggctggaggaagcagtgcctgggaataagctctccagggtcccctcctgcttagataacctatgaatctgtgtctgtgaatttggagccatggcattatctgaaatttccagggttccaatgccagtttgggagacacagtggaggaagaacctgttgtttcttgcagccttttcccttccctcggacgtgatgaattctcactcttgtgaatttttttgtgatttttgtaaaataaattacaagtggcaattagtcactgtgctgatgtaaatttggagttggtgggaatttttggactctgctgtgtggccctggggtttttgagtggaagaggtattttatgctccccaggtcttagaacctgacctgtggaaaggctgaggatgtttcagcagtttagacagggcaaactgctaattcttctcacctgtgaaaacagctggtcttatgaagcgcaatatgtgacttaccccagtggctctaaagctcagccgctacagcaagggggaaaattgatcccttaatgtggctttcttctcactggagttttgttttgtacgtcattgtgcatttgagttacagcagacaagggccagccaaactgctcttgtgtgggtgagggaggcaatgtgatctgtttgggaaagtgcttgctttgatttccaaagggctgtgggttccagccctgcttctgcttgggaattctgcagttgtgcccagcaaacacctggggaggtgcatcccagggcattattgaggagccgcagggcagcctgggtacctgcaccattgggagtcttgcttctctcactccccagcagggcatcttcctcatggaatcagatacagaccctccaagactgacctggaaggagacactccagtgaggggtgggtctccctggctctttgtaccctccaattcttcaggttctaggtgttgagctcagggcagtgggaattaagatgggacccacacacattcccatgaaccttaacaccatgtctctgagccaggttagtgacgatgtcctttgtgatatctgccagcctttgctggagtcccctttgagggcctcagacttctgttgtatgatgtagaggccttgtttgtctgcccctttgcctagctggagtgttgcaggaggagcagcagcattccaagaccagggtgcagtgaatgactgagatcccaagatgaaggtggctttcagggcagagggaagggagcctgggtcagctttctacatccccaggaaagctgtccagggtcatcctaacctctgctaaacaccttttccacaaatacataatatgtaatgcactctattccaaggcatgtgggagatgatctatttcatgatacagaagaaacccttgtgaggtgaattccctctcttttctaggctgctggagataaggaacaacgcctgttctcactaagaagtggcttggcattttctactctttgaacatcagtgtggattttgtttgaagtctcattgtccaagaccttttccaaatggctcgtagctcagcacaaaccgtgcctgattagtgttgtttggtattctttgctatagatcttctgttgactgctttccggaaacaatgcataaaactgtaggtcagaattatttttgtaacatctggaggggagcttactgccatttcccccgtgttctgcactcacacaggcccaaacctgcctcttctgtcttctgggtgggtcttgcccctttcctgtagccgggggatgctcctgctggggatggcccaccctaggcagcttttcagttcaagatggaggatacagaggttcattcttgctcctgtttgcatgcaaactgttctatttctgttttgcagtgggagagaggatacggtttataattccgcactgctgctattttttttcctatttgcccctaaatgtccatgctgtgtgtgtggtgggtggtaggaggaggagagggagacagaagagaaatagcgtttctaaattttctatttgttactgaaatgtaacacatccaggaaagtgtccatatcatatacagttatcacaaatttgtataatgtcactgaggttgaatgacaacattatccgcacccccagcaattcccctccctaattgcaaccctgctttctcctctccagaggtaaccattatcctgccttctaacactatagttaaatttcacctgcttttgaactttagataaatggaatcagactgtgagtatgctattgtatctggcatcttttgttcagtattgtatttgtgcagttcatctctgtggttgcagttgaatgctgttcatttgttttcattgctgcatagaactctttttttgttttgttttgtttttgagacagagtctcactctgttgcccagactggagtgcagtggcatgatctcagctcactgtaacctctgcctcttgggttcaagcgattctcctgcctcagcctctcaagcagctgggattacaggcacctgccaccatgcccagctaattttttgtatttttagtagagacagggtttcaccatgttgcccagactggtcttgaactcctaagctcaggcagtctgcccacctcggcctcccagtgctgcatagaattctgttgtattgctgtaccatgatttacctgtccactctagcactgatgggcctttaggtttcttcttgtttttttttttttttttttgatattacatatgcagctttgaacattttgcatgtctcctggtagaaatgtatgcatctctattaggtatagtcctagaaatggaattactgggtcaaagggtaggtgcatgttcagctttattaggaactgttgaatagttttcccagtggttttaatggtttatactgccactagcagtgtatgaaggttctagttactctatatccttgccagcacttgggattttcagtctttttggtttgagccttctggttggtatgaagttgagtttctctgataactaacatagttgagcaccttttcatgcatttattggccatttggctatcttcttttgtgaagtatctatgcttgtctttggcctattctgttgacttgtcttttcttattaatcaatgaggagtttttaaaatagattttggataggaaccttttgttggttgtacgtgttcccacccatccattcgcagtctcctgggtaggtgggactaaaagcgtgcgctgccttgcctggccatttttttttgtgaagatgggatttgccatgtcacccaggctggcctggaattcctgggctcaagcgatccacccgcctcggcctctcaaaatgctaggattacaggcatgagccaccacattcagcctccttaagctttaatatgcctgggaaagatctaacaggtttcactttaggacctctcccccaagcccacacagaaaagtataataatatgattttcaaagtgagcactcagagagcccacccgtggttgggtgaatacttagccatctgcctcctattttcttatcgtaggttgtgacagaatgcctttttctcttgctgcagggtccttgtgggcgcaccaaaggcagattccaaatacagcccttcagtgaagtctcctggggctgtgtttaagtgccgtgttcacaccaaccctgaccggagatgcaccgaactggacatggctcgaggtgggtgaccattactgctgtggtggaaatgggttctgtacccttataccttgctcttcttcttcccaggatggcctgatcattcactcacccatccatccttccctccttccctccctccttctctccaacaagcatgtattgagtacgtaatagttattaagcactgggatacaccagtgaacaaaaaaaacaaggatgctgccatccctagtcccataaattagtgggcaaaagagatattaagacaagtaattgagagagaaaagaccagagggaaggtgagtatttgatttaatctagataggagggtcaagaaaggtctgggacctttcgacatgattagaaggatgcgtagtcgttagctgggcaggtgcaggaagcacagccttcaagcagaggtgccatttggaagcacagagcgaggttgtgcagctggagagggagccaggagagtggagcacaggagggcagcaaggcaggctggggccaggccacgtggggcctagcaggccagggcaatgtgctggaattttattctgtgtgtgagtggggaggccactgaaatcaattttgggtattacattttaactagggaaagatatgatcagatggatgtttttaaaagctcactttgcgctgggcatggtggctcatgactgtaatcccatcactttgggaggctgaggtgggcacattgcttgagcccagaagttcaagaccagcctgtgcaacatggtgaaagcctatctctactaaaaatacaaatattagctgaacgtggtgatgcatgcctgtagtcccagctactcaggaggccgaggcaggaggatcacttgaacccaggaggtcaagggtgcagtgagctgagattgtgccactgcactccagcctgggtgacagaactgagactcttgtctccaaaaagataaaaaaataaaataaaagctcactttgatctagcagaaaatataagatctttggaatcagatggttctgactgcattcaaagcccagctgggactgattgggaatgtcctatagcttcttgggcctcagttccctcaccttcaagatcaagactaatatacctacctcgcaaggatggtcttgagaagattaagtgagataatacaggtgagtacacagaactgtgcttggcacatcagtacaaaggaggtattttgttataatcatgactgcaagcatttctttctccaaagtctttttgcataaagattttctaatttttttgttgttttttgtttgtttgtttgtttttgagacagagtcttgctgtgtcacccaggctagagtgcaatggtacaatctctgctcactgcaacctctgcctcccaggttcaagcgattctcctgcctcagcctcccgagtagctgggattacagtgtatgaccatcttcggctaatttttgtgtttttagtggagacggggtttcgccatgttggccaggctggtctcgaacttctggcctcaagtgaaccgcccacctcagcctcccaaagtgctgggattacaggtgtgagccaccatgcctggccaagatcttctaattattttttaaataaagagttattgtgattttctttagcagaaaaagaggtttgtgaactgtttgttactggtgcataacaaattaaggagcttacttcagaacataaatcaaggccctgcctctttccatgagaaagtcttgccatgtggttgggtgcagtggcttatgcctataaccccagcacttcgggaggttggggtgggcggatcacttgaggttaggagtttgagaccagcctggacaacatggtgaaaacccatctctgctaaaaatatgaacattagtgggatgtggtggcgcacacctgtaatcccagctacttgggaggctgaggcagggcaatcgcttgaacctgggaggcagaggttgcaatgagctgagatcgtgccactgcactccagcctggacgacagagagagactgtctcaaaaaaaaaaaaaaaaaaaaaaaaagaaagaaaaagaaagccttgctatgtaaaaaaacagttgtctggattaaacagtatagtacatagtgatggagttgatttacattttgtggaaagttccttatttcctcatagggctgtggaccaccctttgaaagcagccagcagaacatcactcctcaacccaagtctggctcttctcctctttctccagggaagaatcggggcacgtcctgcggaaagacctgccgggaagaccgcgatgatgagtggatgggggtgagcctggcccgacagcccaaggctgatggccgtgtgttggtaagtccctcctgggggtgctgtgggaagggggtggcactctgagaatgaatgatctgttaggaaggctggatggcatggtgacaagtgcatggctttgaggttgcttattctggactactgcttagacaaatgacttatcttcttattttctttatctgtcaaatgtgaataatgtctgtcccaaggtgctgagatgtgactattgaaaaataaaacatatgtgaaaagtgctttgtacatctcattcattacataggtatttgtgtgtgtgtgtcttaaattgaggtataatttacagtacacaaatcttaagattacagtcttgattttcacaattgtacacacctgtgtaaccatatgcccactgagatatagaatatttccatcgtcccaaaagtctccgatgtccctttccagccaactcctctcacctgagacaaaccacagctgtgatttgtataatacattacttttgctttttctagaatttcatataaatggaatcctacagtatgtgctcttttatataagacttctttcactcaaaataatattttctgaaattaatccccattgtatgtatcagtagttcattcctgtttatctctacataatattacattttatgaaataaatgttatttttaactagttatttatcggacctccaaagcacctatgctgtattttgatccgtaggtgctttgagggagatagaaagaaaagtctttgcatttgagactcctgagatcctggagttgtgctgtgcagtaaggtggccaccagccctgtgtccttatttaaacttaaatttatccaaattaaactagaaattcaggtttttagtcatattagccacatttaagtggctcaataatcacaaatggttactggctactctattggaaagcagagagagagaatattttcatcatcacagaaagttttattagactcaacacgaaaggaatttctaacactgcagaggttttgtttttgtcaatttttcctttaagcttttctatgaggtataatactaaagcacttaacacacccagctgtgagtgcacagcccgatgggttttcacgcatgtacacttatgcatccccattgccagtactccggaaggacccctgcaccctttcccagtcagttcctctgcccttggtgagtgaacaactgttctgacataggctttctcttgcccttgacttttatcagaagctgtacgaagatttttgttataaaagcgtaagctcaagaggggaaagtaatactagctgccgcttatggagggcttcatttgggtcacatgctgcaaagctgagggtttcgtgtgtattttatcccagggaaacaggttttccttaaggcactaggcaaagtgtttttgtcccctctctaaggagcccacttttgtgttaaacttcttcatggcataagctgttaatctgaattccgtcctcagcacaattaagcatctcccccttgtcgggccccttgggagaggaggaagcagctggatgctgtcgccagcatggtgggggcctccctcctggaagccgttgtaggtcctgcacaggctccctgagcccgctgtttgccttggtttccagtcctttcatcactgtcatggctggccctggaccctctccaaacttccacattcctccaggcatggtggcctgaccctgactggacaaatgggccccagaggggctgaacccttgtctgccattctggggaaagaaagggaagaagctgactcatctgtaaatcaaagggtagcccaaggtcctgattcagaacaaaaaggaggtggtggccccgtggcagcataacacaagatgctcttaagggcatcgagcctagagtcagagtttgctcctgtgaaaatatttcctctctgcaaggaaggataacctctctgtggctgagggcttgtttccagaggggcaagacagaattctgtgttaccacagatcagtatcacaaaggagtcatttctggggacagtgaacagcaatgaggaccacagggaagatttagcaaagggagccaagaaggcagcactagagcatttgtggataatggtgccatggatagtcctgtctaattaattgcatgcaggactatttttttaatgttttatgaagttattgcatcatccactcagtaagccactgtatatgggtgctgggcaaagaggagcatctgacaccatctgctttccttgtgccttttgtttgtttttctaattgtggccaaacacatgacataaaacttaccaccttaaccattttgagtgtacagtagtggtaaatgtatggcacattgttgtacaacaaacctttaaactttatcttgcaaaacttacatccattgaacaacactctcctttttctccttcccgtggttcctggcaacattgtatttctattaagagtttgactactttagatcttatgtgagtggagtgtggtgttcgtccttttgtgacgaacttacttcatttagcataatgtcctcaaggttcatcatgttgtagcatgtgaccggatctccttcctttttaaaggcagaataatatttcattgtatgaattcaccatgttttctttattcatctattgacggacatttaggttggttctatctcctggctgccgtgatgaatgctgctataaatgtgtaccaatatctctttgagatcttgttttcagttctttggggtatacacccggaagtgggattactggatcaaatggtacttctatttttaatttttaagaaacctccatactattttcccaaatggctgcagcattttaagttctcaccaacagtgcacaagggtttcaatggctccacgtccttgccaacatttattgttttcctttttttttttaaatagtggccctcctaatgggtgtgagataatattttattgtgattttggtttgcatctccctgatgattagtaacattgagcattgtttcatcatctgcttgttggtcattttatatcttttttggagaaatgtttaggtcctttgcccaattttaaattggattgtttggtttttattgttgttgagttatcctcatggcattttgcacatgggcagtcttgctaggaaaggcttgtcctaagtcccctctgcccctgccccactctgtcctcggcacttctctttcttcccctgtatgggctctgcctccttcgtgaagcctgttaagggttttctggaacaagctgagcatcttttgtgtcattaggaactcaacatcatcttattacttatattgtgtgtataatttattttgtggccatatgtccccttttatggaagccacttggggatagagaccaaatctacccactttcattctcagcatctggaggacatctctctaaggaatggcatctgaaagtgtgtttgaataatacagggactgagggtcaatgttaaaacaattagaaaccaaattagttgccatcttttcttggtggctgattctaagtggctgaaggaaacaccaggaaacattctgtaaaatgttccttggaaatggcaggcaaaaacaagatacagtgagtgtccctatttacatttggaggtctcatagccatttgcttttttctttaatgtttcaaccctacctgtcagagctttctgggaggcaagtatttacttttaaattaaaaatgggaaggatatgtgttgttcaggtgcattttgagaacttgagaagtgcctgggggtgtaggcaagagaccagtatccccaaggagcacaatattggattccaaggttgggtttgaagagggagaggtgggctagctcttttgaaagtggtgtctggtgctgatagaaaacctaagaacaaatggagaatttgaaagctgcaatggggcgtgaaatgtctcagtgaccaaaggcattatgtggaccatggacccagcaaccagctctggcaaggaccagattgtcaggctggtctggcaggttgaccttggcttagtgcctgcccatctcagctccatggacactgttgcacctcccaggttttccccagaaacaaatgatactggatgtaaagatagcatcaggattagaggcaagccccttcccttctcactctctcatcctgagcttcctgtgtgcagacgacattttaagaaatgagcggggaggggaatcacttcttgaaataaccactgaacaaactctgtataggcactgactgctgctcagactttggaggacaactcaaaatgttcaagtctaatgtcgccccttttcatcagacttgccaaggctcagacaacaaataatttaagcttctagattatttttgtgcagaagcagtattctctggttctctttgtcatttcctttctaattatcagggctgtccttatctgttcagtgcttcccatctgtccatttttttttttcaaagccacagggtacatttttgcatttacttctgttgctctgtttcctgattttttttaaagtgaactttttattgagctgtaacacacatgcagaaaaaggtataaatcatcaatgtatacctcaataaattttcattaggtgaacgtcctcagaataacattttcacaccccagcagccccttcccaatgcccctcctggccacttcctcctcggttggggagcttcttaggggagtctcatggcatctcagcctctctgtgatcctgctccccaccacacaccattcttagcagccaggcccagttgtggccgtgcactgtggacctggatgcatgacaaaggctttggccatctctatggcaggtgcgaatgtaggagggttggcagggactgatgtgcctttgtggccgaagcacccggaaagtgccattacccacctctaggagggatgtgttgtttccatacaacaaaaaaggcctttgaaataaagtgtttattttctttctctttttcctcttttgggaggaagagcaatccttataccttgaaatgtgtcagattctaatatttggagtgggacaaggccctccttcccctttcttatgattagttgaaatctgagtttgagcaagtcttgctgttttcagagaatgctctccttctcctgttcttccctcacagccgaactcatttggagagattgatggagttactaatgctttggagacagtccctaggaatttttttaaaatgtagtggtcagattgacatgtgtgtatatataatgataatcaaggctaaacacagtcttctctttctgtaatttatattcagagacactttgcattgttttcctacatgaatccttcctttgacactttgatctctgacctcccagaatgcttttagtttagtatgaaatgcaatatttggatcttctaggaattttccaagatcaccccttaaatagtttatggcacttaaaaaatgagacaatacaccagacattaagtacagcaaagccttcctataagtgtcagtgtgcagctggctatcagacagcaccatgataaacatccgcctcttttcacagcccctccaactcagaaatacaataaaacatggtcaacccttgaagccaagggctttgctaagtccaaaaacttagcaaaaccaaaacataactgatttacccacaaattagataacaataagtgattcaagtttgcgagccataagaattgagtcagaactttaaaaatcaattatttagcagtatggagtgattatttacttagtgatatattttttatagttctctgcctcatatcatttcagtctatttagaaacctgctattttagcacaaaacaatatcaaggagaggagtgaatgtggtttgcagcagaaaaaataacaatagattgttttctgtagtttaatgtcatacgacaagaggcagaatgtgggcaagctcaggttttgagagtcattctgagtgtgtcctcttttgccattgggcagagagtggccttgtccagggccttggtggcagtggcttgaaggatgaagagcagagagcttagaaggctgtgatcttatcatagaatgatgtcagggagaaccaggccccaagagccccctcactcactcggtgacgtggggcattccattcgaccccagagtggttatttcacatgtcctgggacatgtggcaggggggctgtaaagaggataaagtcaccaggcctgccccagggggtgggttttgatggcctctcaggtaggaatgagaagttttaagatggaaaatgcttcatagtgaaacaaggaagactcagaattcctggattccagtgctgtttgcagcacttactagctctgccacttaggcaaagcactctttgatacatggtgctcttgtacagaaaatgggaattctaaagacacctctgctcaccttccaggattgcagaagaggtcagaggtaggccataagaacgctaaatgttatcacttacgaaaacaatgcgtttgagggaggcaaaccaagatgttaaaaactgattattttcaaaagcaatattttaagaaaatgcattcactggctggggtgaagtgaactgatatcagaagtgagtagtgaatgcccaggagaagtggaacgggctgggcagggtagagtgtgtgcctctgagtaagcagctcggctcttcatcagcacagcagtgacatctggatgtgcagagacatgcacgggaactggggccactgtcatgtccaagcagaaggcaggggcatgtttagtgtggcagaaggacgatccaggcctgcatcctggctgctggcactgctccagtgtctgttagcagagctgccctgcctcatggtgtcttgcgtggcttcgaccctagtgctgagaggctcctctggagagctggccaatgcatctgtccatcttcttcgccagtatgcggagctctcgtgcaccccaagacccttggccatgaaccttccttcagctttctcctcagagaggccttccttgacctgcctggcaaaaccagccactccctggcatgagggaactttctggtgagatggagatgttctgtgtcttgctagggccttggtgacatgagtgtgtacatttgtcaaagctcatttgtgcattttgctgtatgtaagtttccataaaaaaacaactctccacacacatttacttctagttaatgagatgcatgctgaagtgtttctgtgggtagaaacatggttgaatatcagccattcctcccttccctgctgtctccacatcggttcagtcccttgggcctgtcagctctgaagccacccccgtcgcccatctccactgcccctcctggtccagacctgcatcatctctcacctggtgttcatttgcacttttgccctcctgcagtctccaccaagcagccaaatggtctttccaaactgtcacttggatcatgcttctcaactgtgtaagactctccaccacttcccattgcagatctgctgaagtcacagccattcctacgtccccctgtggtccaaccttggccgcctctttgatcttatctccttcccaccatggtcactccagaccggcctttctttctcttgagcctctgagcctttctcacgatgtatcctttacattctgctatcctttgaatcctcccagaaccctcttcccctcatgcttcaggccttcccgacctctggtggaaactatccttcccactcccagattctctattctataaccttgtttctttccttcccaatgctcaggactagctacaattctcatttgttgatatatttatttcctgtctcctagtaggctcccagtggcttgttcctgttcatgcagttttctgatgcccagaaaagtgcctgttatgaaggtgtggctttctggtccctctgctcctctcttctcccacagaaagaaacatctggcactgacaggagtctgctttgtgatcttttggggccaactttcctgctctcaactgctctctatccctttaggcctgtgctcatcgctggaagaacatctactatgaagccgaccacatcctaccccatggcttctgctacatcatcccctccaacctccaggccaaaggcaggacgctgatcccttgctatgaaggtgagcatggattgatttttcctcatccccctacccacctcatgccctaagcccgccttcccacctctatgcaccaccagctgaacatttccccagctttccacatgctcatgatagggcagcactgtttgctcccagatggtctcttggtccccaaggccctgcccagagaagaggcaggtacagagggggcagcagtcccaggcctttccaaccctcacctgacttggctgcagagcccacggtgcttaccaagcattatgaagtctcagggaccgaaattcaccaagcctcagccaagtgacctaacagctgccttggttttctggtaatgccaggtgctgtgttgccttgggaaacttaccttctctctctggacctcagtttccttgtccgaatattcagtggttggcccagatgatctctacagccccaggcagctccaagtcagtcattaggctcccacacagcttctggctgcactgtggacagatgtcctgaggctggggggagaggagacccaggattcataaagcaacagctggacagaaacctgacactctgaactttcagcatttcatgacatttgaggtctgactttccttcccatgtggtcctgcagcccaggcagatgctggagaattgggcgcatcctgaatgtggttttaagagctcctcgccaaggggcacttggaaggaaaatgtatcctctcagacttagaaccttcaaatgcctgggcatcgaggacagtcactaatagtgattgagtcagtcactatttagcccagtcgaatctgagctttaagcgttcagaaaacacggttattttcttcagtttgatagctcgtagtttcaagttttctcagcctaattttgggtaagctggaacctgctccttctgtaagtgctggactatttatttcttaattcccctcctactttatttggacagaagtctcactggcttatgtccacattgcctttgggcctccctgggttttcctaggtttcaaattttgtggacactaaaaaggattcatgagaaacactatatggacactgggacccttctgggtactgaggtgacacaggtagggtgctctgggaaacgtcccccacagaagagccagcaagatctctgcaggaggcacaaaccctctcccctatagagtgagccttcctttggtttttctttctcctctgtatcagcatttgatcagctctggctgggccatgtagggaaatgaaactctggccctgtttatatctgtattgtcccaaacagaagaagaacaaacttcatcttaaaaatagaggatgatataatcaatcaagagtggagggatcgttggtttcagaaacgcaaagcatgtgtcaagcctgggtttccactgccccagtttactcctcctttttcctaaggaagaaaaaggaaaagcctctggaacaaccggtggggcagctcttcaggctgagaaggagcgatgggctcagcagggtgatggaggcagtgattgttgaaccatactagttatgcataggaccagtactttggttttcccagaagatgacatgttgtgacagggacacatgatggtccctgatgattcctctatatataccacaagcacaaggacagccctctgaagagggaggtggagttcaatgtccatgtgtacgcaggtccacgaggctcataattctgcattactttctattaagtagctgtggatcatcagtaggccagtgttgatctgaggtctttacacattctctcatctaatcttcccagaagctgtgaaaaatgtttgtttcttttttttcttgggtctgattacaggtattttattttggaaattgttctagaagacaccagtgaggcagggggaagtaagaatgggaagggaaggcagcccatggaagatgtactcctcagcacgttacctgggcgagtgggtgcagtctctggggtgggtgctggggccagtgtggagcacacatctagagtcctcctgcctgagggctgaggggaaggggcttcctccacctggcatcctgtcctgccatgtgtgtgggctgggaaagcctccaggacagaggtgctggcaggtggcagtcaggccacatcataggaacggtggtaggagctggggggagacaggtgggatgcccaaaggccagcttctgtgttgtcattctcctgtgacaggagtaagtggagactcagagtgtatgtgaattgccccaggtcactcaaacaataaatggtggagcaggattttgaagctggcctctgtctgactcagcaaaccattttgtgtcctggtaattaatggtaatttctgttagtttgttttttagggtttctaatttaaatgagaagtaaaagccagtcaacaaccctcacaaagcaagaaagggtgactgaactatcccaaaaatacaatggacttaatgatggttaaatggaactggtgaagaaattagcaaaatgattatgcccctgcccaatcttccttcccatgggcgcacacacacttttatatgctaacccattcattggcccagggtgggaaataagggatggatggggctggcatgtggagtattggggtgtaagagcagccccttagaaaaatgggggactaaattgaaagtttctgtagttcttggccctgtaagaggagaggggtagaagatgctgagtatttttctagaagactggactggacgggtggggctgggaggatgccggccgtagtgagagggctcttgtctgtgctctgttggctttaggcatctccacctccctgttttgtggtttaaactagacctactatggcttttaaggccaccattatttcctcaatgtggagaaactcagtaatgcaagttctctgttccacgttaggggtcacattatggttaaagacaatgggaagattttagagtttgacaggacctttcagataccacctagaacagcctcctgtctttcatgaggtccagagaggtgatggcctgagtttttctttctaatctgttattcacatgccacacaatggagaggcagagtagcttggtggccaatgcacagattctggacacagactgccggagttcaagtcccggctctgctacttcctcttattaacagtgtaatctcagatgggttatttaagttctctgtgcctaaccaacctcaagggtctatgaagaggactgagttaatgcttctaagtccttagaacagtgtctggcatatacttgctaatatatgctaagcatatatatactaatatgccatgtacaacatactgtattctgagcaagtgtttgttaatcatcatagggtgactgacttgtgtaccgggaatagaatccacttaatcttaagtacttgttagttgccagatagacaaaacccaagtgacacagttccagctaccaagaagctccccatctacaggggaaaacagagaggggacagggtgttttaaaagtgggagggccgtgtggagagagaatttcctgccagtgtgtactgctggagcccgtccccaagggcttgagctgcatccaagtgcaaggtggcattatttcattttacaattggaaaaactgaaacccacttaaagtctgcaggctgttgagactatggaagagagggatggtggaaattcgagactggtcatggtggtgggaacagggcaagggaggagggggacggctgcctctaaacccacttcttgtgggatggtggaaagaccgtgggaggggctgtgggttgaggacggctctgctgcacttctgcccctttagcctcaggcctgtcacttggcctctcagtgggagtcgatgctgtgatgcctccactgcatttaccgctttgggttatggtgaggagctcccgagaaaactcaggtgaaagtgctcagcaaggccacccattgttctataactgtggcctcatggtaagtctccatatgggccagctgtgctcctttacaacattggaaggtcggtttggttgcagagactctaaatatgtggggatctctccaaaatgtctcaagcttttgaattcttaaaaaattggtctctggtttggcactaggacatggcttctcaggtgcttcctgtttctggttggatgggaaaagctaccagaatatcctgttggaaccaggaaaaacagaggaaatgggaaataaaaatgaatttaggacataaactcatggagcatatccttcagtcagtttagtttgtgtttgtctgatgtgagaacatcattacctaccatatgttctttggttttatcagaatgtgtgagaaaacgagagctttggtgggacgatgtatagggaaaactacttgtaaattaaagggcaagcactataaaacattaattactattaaccaagctatgatattttaggactccgaaatgttaagtcaatgcatgtgataaaatcaagtacagagatttctttcatcctttgcccttgagaccactgaggcaagaagccggaacttagcaggagtgagactgcaaacaagttgtctttttattgtgaccgaaaaacctgatgagtgtggaatagtttgggagcagcatggcaaattaacaaagcctgttcaagattaaactctgagaaagaaatgcaagaggtaattatgatgccatggtatgttagacctaaattgtggaatctggctttactactcacttattgctatgattaaacctatatgctcctactttctgacttagtgaccttaggcaagctccatgagcctggtgccctcatctataaaatggggagattaagatctacttaagaggtatgtgaggtataaagtgcctaccacagtgctcagtcgagagtgaatgctgctcattgccttcaattagaaaatgtaaattttctaattaattttcaagcaacataatagtattcttaaatattctcagaaggtgtctaacatatcctgttttagtgactagataatgaagggtagaaagctggatattcctaaaatgattttaagagcccttggcaagttataatttctcaaatactgttgaagatcatattggcacaatttggttggtaagtgttccttccctctttttgtagatgacctaaaactttaactcatgccatgtttaaatgttcttaaatttgggattgttgaagtctgaattttactgtgctttaaaattgtgatggaaaaacttcctatggattccaaagatttctgtaccactctattatcagggaatgactggcttttatttctagtgtgtgtttgcatttcctaggacagtgatcatttccagggaaggaaatagattacccattcaaaggtgaagatttttttcccctttaatgttaaaagtggtctccacaagggataaaaatcaacgaaggtccatttacaaatgaaaaggaattggggttttgttgtatttttgttttgtttttgttttggagagaaccataaaaggctaagttgatccatttaaaaattcaagaacaagcctcataaatttttattaaataaagacctctacatttacataggattttatggtttccaaggagctttaataaacatatcttatttaaataaatagagcaaattaaagagaagaggatgcagttgtacattatggccagttaaacagagagggattctgagggggaggaagggagggtggccccagaggacagccatggctgtaaggaggaggccagaggtctccagcagggcctctctggggctttccaggtttccttggagccaagaattttaatcttgggcaaacctgtctcctatacttcaaacgtgtttccatgtattacgtggaattatagactacctaaactgcatcttttgtttctctcagaaaaattcacagattcagattcacctaatatttattgagcacctacctggtgccaggggttgtgctaggtacttaacatttttgatcttactgagtaatcacatcattctcagataagtattcttatccttgttatacagatgagaaaactgaggcccagggagcttgatgaaggtcacaggcttattagtcagaggaggggttgacggcttttaagtgtgtagtaggtttctttgtagctacctgttctgttgggatcctggttttcttggtgattactgagtgctgtggcctatcacagaaaaaaaagtcatattttttttcaatggcataattttatgaatttttgggacactacactatagacttgttaagctatgtttcagttttgcaattatagatacactctgtagacaagtcccagtaggtacagagggcagacgtgggtcctcagactgataaaatgtagccaggagaccaatctgctctagtctggagtggctgcttactgggaacatttggtttcagtatctgcacagcagtttgtctgtccatgctttggtgccagttatttcatgagtctttttatttttattttttggttatatagatcagaggtttccgtgttgcccaggctggcctcgaacgtctagcctcgccttcttatgcgccaggacaacaggcctgagccactgcagctccctatttcatgagtcttttagctttggtcccaaaattgaattctgctcagttctgagctggggttctcactgaaatgtgactgtcccatgttcagggtcacttttttttttctgagagtagagcatgacataatgcatagtaagttgcatgtctatatatacattattatgtgcctgtattattacttgctgctgaagtagggagttggcaaaatgggttgctaagttctaggtaaagggaacgctttaaagattacaaaactccttttttggtaatattaaaaaattattggccaggcgtggtggctcatacctgtaatcccagcactttgggaggctgagactggcagatcacctgaagtcaggagttcgagaccagcctgaccaacatggtgaaaccctgcctctactaaaaaatacaaaaattacctgggcatggtggggtgcatctgtaatcccagctacttgggagggtgaggcacgagaatcactggaacctgggaggcggcggttgtggtgagccaggattgcatcactgcactccagtctgggtgacagaatgagactctgtctcaaaaaaaaaaaaaatattgtaaaaaataaataacataaaaattaccattttaaccatttttaagtgtacagttctgtagcattatgtacattcacactgccatgccattatcaccaccatccatccccagaacttttgcatcatcccaaactaaagctctgtacccattaaacatgaactcctcattccctgcttcccctagtccctggcaactgccattctactttgtctctgaatttggatactctagacacctcatgtaagttgaatcatacagtatgtgcccttttgtgactggcttgtttcacttagcataatgtcctcaaggtgtatccatattgtagcatctgtcagaattttcttcctttttaaaggaaggaatatttaataatattccattgtatgtgtgtgccccacatttatctattcatctgtttataaaacattttctttggatgataagaatgttttcactggaaatgtgctttgtgaagcataagggagtggcagaagcagatcagaagttgggagccttgctcttgggtcctgatgctgaggctaatcagcagtgtagctttaaacaaaccacttgctctttctgagcaaaaatattccatttgtaaataaatggacagagttagagttattaggcattccctaaagatcttttccccttttaaaatctttctttcatttaattctaagtttctggctttatgcactttgtgtttcatgcacaccatagcttagtcatcagttattttcataaaatgttctcgcttcctctttaacctagctgtttaatttatttacattttttcccccatttatatggtggtcccttgtaaactgagggtagttttattctctcttcatttttctgtataattgcccttttttttttttttttttactagagctgtgtctgcccaaatgcattgtttcctgtattgtacaattatcagttatttagatttgccactctgttagaaacaaaatgcttgttcctcagtgccacaatgaaatagcacttgaacataaatttaattttctcagcaaggcaatttttacttctactgaagcgtgcgacttgtggatggagtaatggtgagagcacacctggacaggggaggggcaggggttcttattcctgttgcaggtagcccctactgctgtgtcgttcccctatttcctggggttcaactgcatagtctgagctaattccaactggctgttttaaagagagcaggagtacgatcctgagtggcggggtgagtagtttggtgggaagggtggttacagaacaggtgactcaggatgatttgggtcagagcaagtgaccaggggtgactcaagatggagcaggtaaccagggtgacttaggttaaagcaggtgaccaggggaacagatctgaactactgattagaactggcgggaaagttgtttactgaaactagaggcaagggggccaaagagaaccaggaagttaaactttaaaatggaaaatcaaagaataagagagctgaacatattgacatactgattctttgaagagaaacttggaattcgctataacaactccttggtgaaattcagaataaagactggcaagctatttttcccccagtattttatttcagagctaagctaaggaactacagaaaaataattgtaaaattgatgtgttaaaaagctttgaaagacagaactttctcaaatgggtaatatgaagggagattattaggaagaatatatgttatgctgtatgtgaatcttgatctttctgtggaatggttttatcctggtcttttggaaagggtacaggaagtgaccccacccgattggtggtctgcttgaattacattcattaatgtaggctccatgcattgagttgcggattgtgaacatttggaaaccagtattttttttcctctctgaattgccttctgtttagacagggcttaataaaaccagcagctaaaccaaggaaaatactcccatttttagaatggaggagccatacgacttaatgaattaaagcatgtaatgcaggccaagtaattcaaacccacccatggcaggaagagttccacaacctggttccagctcctctaagtgacttctaagtccccttgttcaaccctatcttttgggtctcagatttggcttccccccccccctttttttttttttttttttgagaccgaatctggctctgttgcccaggctggagtgcagcggcatgatcgtggctcactgcaacctctgcctcccagactcaagccatcctcccacctcagcctcctgagtagctgggactacaggtgtgcaccaccgcatccagctaatttttgtatttttgtagagatgggggtctcactttgttccccaggctgattttcaactcctggactcaagtgatctgcctgcctcggcctcccaaagtgctgggattacaggtgtcagccaccgtgctggccagcttccccaaatgtaagggttaggtttgttacagtgcctgtgagctgctgtcaggcaaagcctgcttttcccctgcttctttgaggtggataaatgttttgttcagtagtggagagggcactagctattgtagtcctctctgcagggccatgtccctgggggcatttggagaccaagtagacatgcccaggagcagccaactgctgggccccacggcctttgtgtttgtgcaggaaaagttcttcctgggaacacaggagactggaggtcacccccaccccttcccaggtccctccaccctgcacttcctggacttgtcaatggagggagggtgtgtgacccaggcttgttggggatgttgtttgtggggcagccccttgcctctctctgcgcctacctcacttcccatagctttgtgatataggctgtcctgccatctcaggtctagacaagcaaaatcaagttgtatttttaagttttttagatacgagtatggtagaataaccctatgtacatactctttggggaagaaaggctcgtacatgaacatttagaagatggattagggagaaacctaaacctgccctcttgacatatatatgaaggaatcaggttaaaataatagtagtgcccttaactcacagaaatagcattcaaaggagtgaaaacaatggaaagcatgcttgtggcctaggctgtggaaggtgtggaatgtgaaactgtctaatccaataacacccactaactttcctagactagagttgccaggccccacaactgcccccaaagtgtgtgtggcagggatcggataggtggtagaaggattagaactggattctactctaccttgaagggattaatgacagtcacagaagtttctgggaggctgggacatggcctgctctctgatctagatttgattataggagccagtcaggggcccccattgtttgattccttgccctagagcatcctgagaaggcagcttagactttgggtttcagaaacatgaaagtcagtgatggtaccgacttccatgtgtgtcccaggccctcagacctctggtggggcagtcccagcttgggaaggcggaggctggcctgaaaacagtgcttcatgctgcctgaaacaggggtgcctttaagggcttccccttgctggccttcagcctgggccagaagtggggtattcttagctcccagtgaggctgtcaccacctcggaaacccgaggtcctgctcccaacatagaccacaccaagtacagtttggggaggaggcactgaagttctcaaatctcccattttttggagaccttgtcataaagagaccttgagactgctttaaaagatgaaagagtcccacacaattcctattcatgtcagaaatttatgaggctgaactggtggtgtgtcttgcactatagtttcattcagctcatggggtctgaatttcctttttatgtttcattttttcaagagttacaattgggtgtttagtctctagagtcagtgggatggatatgctttttgccagacttttcacatttaatatgtaactgtttgtttaggttgagacattttgatcctttttgccgttgtgctatttgatgcaggatttattattaatttgtattatttcttgctattatgaaatttgatgcaggatttgttcattgctttgcactagtctcactcgcagccctggtgcaagattctgcagggaacaaacaagttccttttgtcactggactgctttctggcaggtctagcagttgtccttataataaccggacaaggcgggagaactgattttatcctgcatggaagaggagtaactcaattgacattctttgtcatttagcagtcagttaatggccacttactggaaaatgttactaggctctgtggtgagtgttgttagaaactgaattactctgtatatttccccagggccctttttccccttgcctggagtagacactcagaacggcaggaagtggcactgtgttgcaatcatagtttcattgttcctttgtattttgcatttcaaaaataatgatattgcttttaatggtaccagagacttgccaggagcccagggggtggtacagggtcactggggtagccccagcctgagggtgcccaggagtggtctgtggaaggtctccagcaatgtcagcctcacatgtgattaatttgagtcactgtgaacatctctccacctccttgactttacccatgaaatgatttccaacatccagtcactttcctgggtatttttagtcactcactttgcagaacctttgatggtctacagaagtgaaggaatgggtttctaagtccaagctgaggtagaatcctggcattgccatttactagagctgtgtgaccttagacaattcacttaacctctctgagcctcagtattcttacctgttaacaagtggggatatgggttcccagggatgagggaccggtgaaatgatatgcctggagacagctaacacaatgcctggaaaatgctaagcacttgtcaaaagtttcctacccctcttccttgccagcttaaaattataactgcagcagcagaacgcccccatttgttgggtagcagtgttgtgagctgagggggtggaggagaaaagcttatctgttagttttctttccacctggagagatcttccccctttccttccacacagcaatagtgtaaccgaatgccagagcagtcccttcttcttgcggtcctctgtggacggcttgtttctttttggatggtaggaggcatccaaagcctcttttagggaaggttggtcttcttccaggagactccacactgggatggccacatcattccatttctgggtcacgttttcagctccttgggcctgcaagggatctctgtcccttctggagtaaatgaaataattgtcactagcctcccacttaatgactgtggctattgctcctctttctcgcacacgaggggaggaagtctgctggggcactgggcagcctcccttcccgatggcaccagagcctggatttttgaggtctggtggattcctgagactttccttcctcaccccagtctggacagcatccctgggcccagcctgccgcggcactcgtgggaagtggctggctggctctgctggctccacgcacagctggcatacactgacatggctgtggtttgcttctctctccttccttgcccctagagtataagaagaagtacggagaggaacacggctcctgccaggctgggatagcgggcttcttcaccgaggtgggtgtctgctgtctgggcatttctgttctcttgtgggtgttcatttccttgcttatatgattttggcaacccttagaggtgggacttctggagtcccagatacttgagcctcgagggagcagattctggtcctcacaccagaggaggctatttctacctgccaggagggcaccagctggccagagaccactgggcagaggaggtggggtggctcatctcgaggctacccctatttgatgatttttgtaggagtctgcttgactctgagacctggggaaggagtcgatttggggatgtgtgagtgagatgacattcagtcaggttgtgccccatcattggcgactgtgcagatacatgaagcgtgtgagcatcccctcctagcagccttctctccttagtggagagacttgtttgtttttcgagacagagtcttgctatgtcactcaagctggagtgcagtggcgtgatctcggctcactgcaatctccgcctcctgggttcaagcaattctcttgccttagcctcccggttataggcgcccaccgccacacctgtatttttagtagagacggggtttcgccatgttggccaggctggtcttgaacacctgacctcaggtgatctgccagtctcggcttcccaaagtgctgggattacaggctgagccaccacacccggcctgagagacttggttttacacacaactctaaccattccttttcccagattcagaaggacaggacacctgcatgcttatgtgcccgtgtggtagtagcatgacttttggctggtagtacatttttagggactgttttcttgtgtcattcttacttactgtaagtttgcccttcgtatcagttcctcctctctcaaacactttcatgactgcctgctggcactgtctatccatgtggttgctcaggccaaaaaaagagtactttttacttctaattcatctgcagtcctgttgttttagcctccaaaacacatcccaaatatgacagcttttattactattacaatcacctccattatcaccatcatgcttctagaaaggccaccaccatcacctggaggtacactggccctgattggtcttcttatgtctattatgcttttttaaaaattgtggtaaaagatgcataatataaaagtcaccactttaaagtgtgattcagtggcattagtgcattcacagtgttgtgcacccatcaccatgggctaggttagaacactttatcacccagcctgcatccattctgacctgtgaagtgtgctttctgcatactagccccagggtccttcaaatgaaacccatccttctgactccgaggcttcccagtccatggaggattacaatgtaaagctcctcatcctggcccctggacttggctccctgaggccacctctctcttttcctcactccaggagagcagagagctggggaagggcatgggacatggggggtggagggaggatgaagggtgctctctggcttccaaagtgagggcccctcctgagtcaggagcaagactgcctaccttcctttcagaaactgctgtttaaatccaaagagaacatagacagttggcaatatagtgtctgatccagaaagcaagaaagaaaaggcagaaagtctgaagttttattttcactctcaaaccaataaataggagatgctaccctccaacccccattccgcaccctcagtgattcttacctcgctggagaatcatttttatgacagtcgacagagttctatgccctgggaatggcaccgccaatcatcctaaccattgaggccgaatttaaagattgttctctcacctcactctcctacttctaagccaccttgcaagtcccaccacctcctatgccctcaaaacctctaacaatgacatccattgccctccacatcctctgccaccctacaaatctaagccatagttgtcttgcttccaacccactgcggaatccttctgccgtcttgcttccacccttgcctctggacagactggtccccatgtagcagccagaaccaccttttacaaacaggaaaaatatcatggtgctcccttgctcaggactttctggtgtcttctcatcctacttagaatgaaatgcaaatgccttcccttggcctcccagccttcatacctttccaggctcatctcctacctcacccactacatggtattttcagctgctgctaggacatgccggactcccactggtggcattgcactggagatccattcacgtggctccttgtacacaagtgtttctttagaagagacactaatggaggaactgctgggtccaaaggcactcagatttgaattttgatacatgttggcaaattgcacttcagacatgtttaccagttgacactcccctgcattgcttctgtctctatcttctctcactcagactttaaatttttgttatgaaaaaacatctcgttttaatgtcactttccctgattattaatgtcatttaatatccttttaaaatattgaccatttgtatttgttttcctggaagttgcctgtttatgttctcagtacattattctgttttgttgttgttgttgttttcctggtttttaggaacttgttacatattttcaacagtaatctcttacctgatctatgtgttgcaaattttttcatcagcctttttcttatgttttaagtttgcctatgatgtctttatcatcctggcaataaacatgcacatttggccaaatctatcagtcttttttttttttccctctagattctaaacttatctcttaagaaggttattccttatgtatactgcaagttggcatgaacagctgggcaggagagtgcccgggatctacaacacatgtctgggctgaacaaactcccatattttatacttatattttcaatatacttgtatttttaatagcactttcataggttgtttttaaaaaagatttcgatctttaatctttctggaatttgtgttgtatacattgtgtgatagaaactaactacattatttttctaaatatatagttggttgttctgatactggtttgttaaacaacttttcctctccccattgaaatgccatcctgccgtgtggcgacttcactctcttcttccatctcagcaaacatttagattgtgtgacaactatggctgttgttcctccaacaggcctgtctagtattgtatgacttgagtcaataggcagtgggaaccactgtaagttcacaagcaggtgacacactggcagatggcagtgttgaaagaaaggctatttgagctgggtttgcccagaactttgggagtggaagggcctgaagggaggcctggtaggaggccgtgatgtggtaggaggccgtgaagcaacaggacagtgtagagggaggcttaaggaataaaaatgattgggggaggcagagaatatgaaggaaatgtcaaggggctgggtggccagggagctgtggggtagaggaaggagggtttgagccaggcttctggagaatggtggtgcctctggtgaaaaggggttgcctgagaaagaacccattgggagatataaactgccaagtctgctttcagacacagggagtgtgcgatgtttttagaggacgtttggacttagggactggagtcctgcctggggcagaaacttagatttggcccttgctcatgactctcttaggggatgagtgtgcttagtgtagggcatgggggagacacctccctttagatgggaggagaagctagattgatgggagacatcagaactcaacggagatgttgacagagagccgaggagaaagtgttcccaggagggaagtgtcattatgtttgccgcagcagctggcaagtcaggcattgggctgagtggaggcagggagtggtaggaggaaccggcggggcaggagtgtggaggggaagtccaggtagctgtgcaagctcagggtgaccagaagaacagaagacctgctgaaatccaggctttgggatttagaacctgagggaaacatggggtgtcagcatgtgctggctgtgctcatggtacagcaaagtggggacatggtgggtgtacagagtgtccggggagggtgggcagtggtgagtgggaaggcagcccctctgggcgccactctgtcctctgaccccggcctgctgtctcctggctactttggactttggcctccgcttcagttcccaggcttttggcctccttaaacaggaggtctttgaactcactgcctgccttgtttctggaagttcagctgtttgtggctgagcaggaaatgtggttgaagggtccaggccagcgcgactcccctcctctgccctcttgctgacctcgccacttgggcttgccttttctgtgagctgttgtcccctcccaagctggacatggatctgtggccttctggtcatagctatgttgccccaaaatattttggcctaaggtgcctgcttgacctacaggtcagtgaccctgagcttaacaaagccttcggagctatggataccacctgaattttagcctgacattgaggattagagagaatttcctgggaggtttatttatttttgtagatgaggctaacagaggtagtagatactgcttagcagcaagagaggatttggaccagctgggctggcgttcacgcctgctgtagaagcctagaggcacttgggtgggagtttgttcagcacggacttctgttgtagatcccgggcactcctgcccagctgctcatgccaacttgcagtacacagaggaaatatatggcttctcccaggcccacctacataccccggttcctctaggggttctgctaataaatgcatcttgggaaaaagctgcattgcttattgatgggattccacaaatgtgatttaggtagtggtggcctttgcttagagaagctttcatttgtgtgtgtgacattgacactggctgttcctgcatggtggggagctaagtattagtcactttttcctagcacttgtgaacagcaccagaaaggtcacaagcatcatccatagggaacagaaaaaacaactatgagggatttccaggaaggcactgtccctcccttcagcctcagccctgagggtcgcaggcttggccctgttttatgtagtatgggctgaagggagaggggtgtgagcactgggggcggggtggcgtggtgcggtaaaaacaagagctgttggttttaaaggtttttgaagacaggaattactttatcttaccctgtttataatgtttgagaggggatgcagtggtatggtaggcatacatttttcaacttttatcctgggttagtctaaatcatcagaaagcaacatatcccatccctgcccccaatgttccgaagagcctttgcaggcctgtgctgatgctcaaagctttggcctgtgcaaagctgcaggtggagaaagctctgcactgaggatacatctggggctgaggaggttgctcattaggttcttcagtgccctttgtattatatttggacactgattacaaattcctttccaagctcaaggccaggagaaaaagtctctcctctgatgaacttatttctgttttttgtactctttctagaactagcgtggtctcttatgcaggacagatgagtgtaaaaagaatgagtggatggatgctctgctgtgtttcccagtggagcgtcctgactgcagaaagctatctatttttataaaacagtgagatacccctgggaacatctggcttatcatcaacagcttccttcaaggggggtaggatctcaaaactttaaaatgaagtgctcatcaacagtcatttcttgtctacaccctcctgaattatcaaaaagcaagcctttccggcgagaatctagtggcttttcttccatctgtgttcctgccctatcctttgttaaggctcttccccaaattaaccataacacgtattgtttaaggcattgccctcttgcctgcaggctctatcctcctctctctattttttttctttaggtacttctggcttttgcagacacttgctccctgagaattcagtggtgactttatgaattgtcctcagaaattctaaatctctgcggcaggatctagcctccagggacttgtcagagccagcagcttctgccagtgcgtgggctcgtctctgcagagggagatcaacctgaaaagatctgtttctgaaatatatgtgggtgaccaagggacggggtgcaggggaattctgaaggctcaggggaaggtcaggtgggtttcagcagtgagagacttgacctgcacagcatctgttatccccatgagccttcatgaccagtatctttggagttttgtctatagctgaaagatttcctctagaaattttgttgattttaacctgtttgcatagaatttttttctgaaatactttgcacattaccatgctgtcttaccccaagaatgatctacgaagggactttatttatctttatatctagtgtgaactctgagatataatagtaggtgcccaataaacattgttgagtgaaaaattactgatttcattagaaaaataattctgattatttcttattgcagtgtcgaaactttagaaaataaaggtaatccaaaagtagggattccctgttggggaaaggaaggactgaaagccagggacctctgatggatacaagcacagcctgcctcctagctccagcacagcctctgcacaatgggagcttcgtcttaatgcttgtaaaatgtcatctcattagcatgttttgtgtttttatgtgatgacttccttgttagtgtttaatcactgttctggaattttaaaaagtcaagattattaattaaaaaaattaatacatataataaaatacactattttaaatgcagagttcgatgagttttgacaaatgtgtataccatgtcgtctctgtctgaatgaagatgagaacatttccatcactttgggaagttcctcatgcccctttgcagacagtgttcctcctctttactccaggtacccactgatctgacttccatcagtgtggattggttttgctgattctagaacttcctatgaatggagtcatttttttctcatcaacatttggtctaggattcacccatatttcaactgagttttgaatactgcgaaagggttacacaagcagaggaagtgtgagggcattgcacagatggagataaaaagatcagagggagttccgaagaccagaattagtttagagtgtcctaggcatgcagtctgagggggcagtggcaggagaagagcctaatgtggttgaaatagtggacagtgttgaattttacctgagccctgtactcttggaaaacagtgtggtctagaattttgaaaaatgcaaaggaaataaactttgggagtgagagaacaggggatgttgattgatttccattatcgtatcacccaggggaaaaccccagcagatatctgtgctgacttccttgggtgaccaaatcatttctgggaacttagggttgttgtcagcattggtgatggttctggggcacaaacatgctctcagccctgttgaccatttccccctgatctaaatgctgaagacagctgtgcctcttatgttcttgagtctttttttttttttttttttttggcagagtcttgctatgtcacccaggctggaatgcagtggcatggtcttggctcactgagacctctgcgtcccgggttcaagcgattttcctgcctcagcctcctgagtagctgggattacaggcatgtgccactacacctggctaatttttgtatttttagtagagacagggtttcaccatgttggccaggctggtttcaaactcctgacctcaagtgatccacccgcctcggcctcccaaagtgctgggattacaggcatgagccactgcgcccggccttgagtctgtttttaacagtgataccgtctattgctgccttgtggtcccctcttccagtttgtgtttttccttagttgaccttgctggtctcttggttttgttcttccatgtttgcagtggactgtaatgatcggaaaaccatgttctagaacgtccctgagagggtcttgagtgtggtctggaggggattccctggagtactagtgcacagtttcctctcgctacgcatcaggtcgggggagttgaatggtgagcctggagtccaggcagggtgcggtattgcttactgcttttcatgagtggtgttccccagaatctgtggttgaggtcaatgtcagctgtttgtcatttccttgttagagcctgatgtaaagttgaggaaacgtgtgtggtctcatcgtggatagaataggggcctggcctgtcgtgaattctgtcaccttgctcagtctcttcacatctttagtcctgataatcccgtctgtataatagattccataatgctgatgaatctggtgaaatctgtttttgttgcttagctggggaaaaaaaagttcttggtgtgaggaatttctcctttgttgtgactgtggttctcattgcattcccctcctcccctcctcacttccttctctgcttaccgttggatttctttttggtaggagctggtggtgatgggtgctccagggtcattttattgggctggaaccatcaaagtgctgaaccttacggacaacacctatttaaaactgaacgacgaagtgatcatgaacaggcggtacacctacctgggtgagtactcagggagagaacaggtaagaaaggggaaatgggagtgattcccaccagattcacaaattattgcttcattgttggaaagaggagttagttggctttgacgcctgttgttctaatgacttacatctttagccagggcatcttcacatctagctccacaaacacaaggtagagaggaaaaccaaggagggaactgaattaaaactgtatgctttaattaaaaagctgacagttgaacctccagggaaataaacattttattttctcattttatcaattgttgaagttcagatggtcaggtagaaatgagtgtgatggagtcttgattttccacgggcgtccctttggatggagtccttgctttctgatcacaaaactggtagcaaatagaaagataagaactagaaattatcatgacagatggcaacctaatgctgaaggttaattaaaggctcagaaaaatttctcttgctttcttaactcttttaatcttctggaaagaagatagacacaatttaatgtagctatcaggcagaatgacactgggacaaggtccatgccaatttaagaacagacataggctgtctttgcttgtgtagatgacaattacaagactcttttctttaatttatgccctaaatgctataattctggattgaaagcgaagctaaatttaggaaggcctaatgatgacacacaatgctctttcgcactcatgatacataacttacagggaaaggccctgactccctttttgcatagcgtcactgggaacttcttgttaaatggggttagggagtcgttgacttgccttttcccttctaactacaagttttttgcctggtagcatagacccaacaatccttctactctggggtgtttgctcctgtaggcacccagctgcctagtgctgttgcttattaagcatttaccctatgccaggctgtatgtattatttctttttaatttctgaaacaaccttatgaagtagctattattatctacattttatagataaactgaggagcaaagaaattatacatcttgccaaggtcacatggctcctaagtagcaaaattagggtatgagcttgtggtttctgagtgcagagtctaaatgctgagctgccttccctgtgggtgcgtctgagagagcacctatcactggtactgtacttctcactgggctgggagcaccttgaagacaaaatgtgggattgtgtctcacatttggtatagtgcctggtgtatagtagtaactcaacacatatttattgaatcagggaatgaagagagagcagaagaaagcccagtttggatgatgggtttggggtctagaacagctcctttgaagcttcgagcctgtggtttctctttgtatacacattagaggctcttatcagctgcagggattatcaaggatccgttcaggctttgatctcactcagaatactcttaggtactatcagtcgccagtctgagagaaatcagccacatggtgaggaagaattgatcatgatatgatgtcatcgcgaaactcaaacaacttacaatcactttagggttagagggtgatgacaagtttggggattatatggcagcctgtacaggatttatgctggccagaggagagctttcagcctgctagcaaggctctcagaaagcaggagacgttgaggctaagcctaggcaatcttttcctttgtttctaggttccttttgcatccatattttttcactgaccaccctcccacccatccacccatccatctacccaaccatgcatctacccacccacccactgacagcttcttttgccttcttgtaggagggagtgtggttaacagcaggggctttagaggcacagattagatttgagtcttgctgtgtgatctttggcatgttgtttaacaggtttttctaattctgtatctgtaaaatggaagaaacagtcatgccttcttcataaagtttttagactgaaagagatacctaaagacatgcataaaaatgttggtagcaaccttgttcatattaaccccagcctggaaacaacctaaatgcccagcaacagaataaacatatgacatatttatataacggatattactcaataataaaaagaaactactactgtactcaacgatgtggatgaatgtcacagatgttatgttgagtgaagttcaagaaaaggcaaacctaatatatggtgatagaaatcagaatagtggctacctgtgtggggcatattgactgggaaagggcatgagggaaccctctggggttatggttctgtggttatagtcacttccttgatctgggtggtggttgcatggctacgctcatgtgtgcattcattgagttttacacgtcagatatatgaccttaccgtatgaaaactatgccttgaaaagaagaaaacagatatatagtatttcatacagtacttgtccgaaagaagacactcagaaagccctctttcctgccctgatatccttgtgaacatgactttttgtgagatgagagccatttcagcatgagaaggttgacagctgccatttttttcctggtagtttatgttccaagagtagggagcatgcttgagaaacattttcctctgatggatgtttttttttcccttcccttctttttcaaccgtgtgcttggtttccgcccatcctgttcaggctacgcagtgaccgctggccacttctctcacccgtccaccattgatgtggtaggaggtgccccacaggacaaaggcatcggcaaggtgaggagaaacatctgtggaatagctggggtcagacagaagaggggagcatgctgtccctggtgcagaggtttgccagctgacattgacctgaacattctactgggtggctggtggggaggtgatgaggaaccccctgactgccccactccattggaaagtttcccttgaaagctcaattagagtgtgagtatactcacactctcgatttcctgcacactctcatctgaggtttttcacagctgaccatgtgtgtgtgtgtaatttataagactgagccctggccttatggtgtccttcaaaagaatggcatttagtgctgtccaacttcaaatcccaaacccttcccaagtttggctttgatttaatggagctaggtccagtctcagatatctttgaggctttattcatgccccaaattattctcgtatttatttccccagtgtttgagaaggaacattgggttcccaagactggttcagcccaaaggctggactggaaatatgtgggtctggctttccctaaactatagtatctgccaaaaaacccaccccctggatctagggctgcctgaattcctttgggaaacatgacctctgaggggcctgaattgtgaactacgcttgttggttctttatcatgaaggtacaggaaatccagattgagtaggtacagatggatcaggaacccacatttttaagaagctccataggttgtctgatgggaaagactgagtgaacagaggaatgaactttggatctggacctttaggggtagacctgtgatagagtctggtcatatctcccagggcttggagaagtggaatctggattctggattagcccagatgagctgagaccactggtaattggagccttcagccaggaggtcaggatgatcagggagctgacgaactttccagttgactaggcttgactaaggataatttctgtggatcctcctgggcagaggttaggagctgctgctcacgtttctggagcatgtgcctccctcctccctaacactgatgctgtggaaagaggttcttcaaaactgaaaccagataaaccagggccctgagctggcagggaggagggatcaagcaggtgaccttcgatcacctcaagaaagaggtggttctttctgagttgcatgaatttatctaagtagagaaagaagcactgagagctgttcacattgatgttgtcttcttggggaggggctgcgggctaccgggcatctctgtagaaatggtaaaaatgcctacgtctagttcacagtgatgcgggtgcctctatgctaatgatagcagctttcttttctccctaattgcagaaaacacgacccagttttatagtttttccttcagatgattgtgatgaacttcatagtccctgtcaagtcttaagatgacccctccgcaaacccctctcactggctatctggggggtgcaaggtataaagttaaaaagttgagaatggtacttataattgatagagccagacagcgggactcctggacccagtttataaagtacataaaaatgcttctttcaattagaccacctgagaggcatggggaaactggtcatagtgacaaagttgctgacaattccacattcccagggattggggctagtacagacttgattcccaaggacccctggccttcaggattttgctggatattctagtgtcagggcacaaaagcactcacactaagatggcagttccttatctcatgggaaggttatttacactggttctcatgagacactcttcccacgagatgtaatccaaaaaaaagaacttccatagtcaagtacatttaggaagttaaatgtcagtgatcgtctttgcagtggcgatgcatagttcacatgaacatgctaaaggctctaaaaagttccacagtcaaagaatttacttaatgtttaactccacatttcccaaatgaaactcatttttacccaggcagatcacatgactctaatattacgtgaaatcactttgggaaactgctttgtctacagtactcatctccacctatccctttatcttctgttgtaatgcctggtaaagtcttactgggaataaagtccaatccataccaccaactaattttaaaaacaggaataaaggaaatatttcaagaaacaaaatactagctttttctcagagttgaattgtttacttgtaatttggaagcttcttgggtcttattgtgtgtggcttttataagtattgtggttcaggagcagtggaggtgatgtctgcctcaggattgaaggacccttttttttgcagggctggtaaaatgacagctgacttcttcatgatcatcagctagcataagcacatctgctgtgcacctggctcttaagcttttaaataggactcccaggagagtgctgataaatatctttgatcattgatttcatcctaactagattttttttttttcattccataggtttatattttcagagctgaccgaagatcaggcaccttaattaagatctttcaagcatcaggtaaaaaggtgaggttcttggtataagtgactattttttatttgagagatgtgatcatgtgggagtcagtactttttagaaaattggtttgaaggccctacctgtgccctgtgtttatatggcagtgctgtctgcttgttggtgtctttaccttctcagcggtatgtgtaatctgtacattcatgggattcatactcgctttaggagacattctgtagcaagatgagttatatggggccaagttacagcacagagttttaagagattgtccgtagttcagactgtcatcaaagtgactgcatgccctgtctctctgcctccatcctttctcaacgaatctccacctccagagagagcagatctttctgagtacaggtagcaataaatgcttctcactgagcctgtttcaccagcccaacattacccccttccctaatcctcagccctcaactgtcattgccaaggtgactgttgccacacaaagaaaatccaaacacaggttgcctgattcctcttagaaccttgaagcagaaatagctcagggtgctgccctaaagttagcctgggtgagattactctgcctgggtcctccccaccctgtccctaatcctctctctgctttctgaaagtttccattatactgccctgttgtctaaaattaagccaattagagagtcctgctattaataagcaacagttttcatgagcttatcagtcatgcacttcttgtgtggcttagatcagcaggactgtttggctgagcttggctactctaagggacacaagtttaggctgggagctgtgggggtaatttggaggtcttggtggaggccttagtgggatctgggaagaagcataggatgtctgggacatgggaggaggccatgtgcctcctcaattctgttcctgccgagttagaactgctgtacgccagcctaggatccttccatgttgttctcccattcaagtagacctttttgcaattttaacaatccgaataggtacacttagtgtataattgtcattatcttttgaataaaaaatgcatcaccaaacttggttttgcatttttcctcagaatggctctgccttcccgagaactctgctggcttgtgttattttaacatttccaaaaccccaaagcaacagcactggaaaatgactgtgagccattctgcaaaagggttttccaagcacccttaaagttagaaaagaaataactctgtgctacttgtgatttacaaaagagagtttcaaagagcaagtagggtatgagtggaattaaggctaacattttagatcttctgcagaagataacaaatgggtgaatgtatctagcatggaaacaatctccctcttcccttcaaatgtacctgggtttgaaagcctaaaggtaaaggattcctttttttttttttttttgagacagagtctcactatggcatgatcttggttcactgtaacatctgcctcctggactcaagccatcctcctacctcagcctcccaggtagctcggaccacagacatgtgccaccatgcccagcaaatttttgtatttttttttgtagagatgggtttcaccatgttgcccaggctggtctcagactcctgggctcaagggatccacccaccttggcctcccagagtgcgggatgataggcatgagccaccgcacctggccaaggattatttaaaatgaattgtggagtttctgagtatctttatgttcagttgtagctgtgcccccccaaactgcttttccttccctgccctactccttactgtctgtgccctggggaggtccggttaattcctattgccttcgagtaattaacaatctgtaattgtgccctctctcctccttgaaaacctcttggtttggatgagaacctatgctcaagttgatcaggtttttgggggtagatctgagagtgggtggtgcaaggaggatgagattaacctttgagaacccacttgtctaaacttcctgaagacttctgccattgagttccaggacaggttcaggcctgaatgtctgcttggatgtccttatcataccaagatacatcaggttccctgagaagggacagaaaggcccaggtattcaacttcttggcttcgtagccatttgactttttcttttctttagggctcttctggccctaacctttgcaccattccataggcaccccttctttctgccactcactcacagtcctcttgccttcacttccttctactagtgtctccaactagatttaccctgtcatcatcgttctgcttttgaaataggccatgacctttctttatacaacttattctacttcttgccagaagaaatgagacattcatgtctttctgacttctccattacctcctacaaaaggacatgaccccaggctttcaaaggatgcctttagatttatccctatgtccagagtcacatagacaggagggttctaactcagcaaaccaccggttcacttctgcttccgtttggctagaatttggtcagatagttctgtatcctggcttcctataagaagaaacaaagcaaaaagattaaaaaaacaaaaccaaacaaaaaaaacctggttcttgtctttattggttgactttctccaaatagtacacttaagaaatcaccaacatgtgtgcagttcagatgttaatacagacacacatctccacatttccaggctgatggggagctctgatcatcggacacacaccccaaagcatgtcattgccatattgaagttttattgaattaacggagtatgtgaagcatttgtatttcaaaactgagataggaaacttcacatatagagatttctaatttaacattgatgaagatgccaagttaaatagtcctttggaatgaaacaaatagttcccctggggctcagccagtgagcgcagccagcagcttggctctttgggtctttgcctgtgtcttactgatttcttttaccaaagctcagatggggagattggcaaggccactgaaatagtgactggcaactcggtttctttcctcctcaccctttgtgatttcaaccctttcctgctccgttctcctttgagaatgggtaatcagaggggaggaagatggccttggcatatcactggggaaggatttctgagcggccactacaaagccctcctgtgaccctgttagctgcaggaaatagattggagtgtcctctacctctctccctcaaactccctgggtcagctgccaacaaactccaacagtaaaagaaaaggcttgttcatgtccatcaacccaggggccttttattagaaaacatttattttaaaagaataatgctttttctccttttcttttcttttcttttcttttcttttcttttctttctttctttctttctttctttccttccttccttccttccttccttccttccttccttccttccttccttcttttcttttcttttcttttcttttcttttcttttctttctttctttcttctttcttttctttcttgacagagtcttgctctgttgcccaggctagagtgcagtggcatgatcttggctcactgcaacctccacctcccaggttcaagcgattctcctgcctcagcctcccttgtagctgggattacaggtgcctgccaccacgcctggctaatttttgtatttttagtagagatggggtttcaccatgttggccaggctggtctcgaactcctggccttgtgatccacccgcctcccaaagtgctgggagtacaggcgtgagtcaccatgcccggccttcttcttttatttttttttaaagtagaggttgcaaactgacagcctttggaaagaatacagcctacaaatacttttgtttggcttgcacagtatttgtttattgtttttacacacgaagaagttgcgagcatttaaaacactggcactttaaataaagttttaaatttttggcttcttttggaaaatggaaaggttgctcctctctgggtcagcattcctcttggtggcagttagctgcagctgggttgaagctgctcctttagccaggcttgtgggctccagtttgccacagtctccaccactccctattgttatgtagacaaggaagacaagtgtcacttgccacattaattttttttcttatgcctgttatatcacctgcctggatcctgttggtatttgggtttgagacccctaattaagctataattaaaagtcaatattatcttgctctgttccctcatcagttaaacagtcttaaaagttgtacctttttctgtcacttcagctcatgccttcctaaccaatctttcacctgtgcataggaccaggagagaataacctatttccccatgtaacatttattttcatgcctttcttgtgttgtgagatttcatattcctacttgcttggccttgtcaaatgtctgatataaggagcatttttattatggttgtaacataactttgtgtcctcagcttgcatttttaaaaacagcacctcattctgtgggcatcaatctatttatcttccccttgataggactccaggaatgggggactttgggccagttagctttgtctcacattgactggggccctgccttgctgctggaagttgggtatttcactctttgctaggcattctggtttagggggcagcatagccatccagcctctgagggatgtttctttttttttatgtttttattttttagtatacattaagttttagggtacatgtgcacaacgtgcaggtttgttacatatgtatacatgtgccatattgatgtgctgtacccattaactcgtcatttaacattaggtatatctcctaatgttatccctcccccctcccccaaccccacagcaggccctggtgtgtgatgttccccttcctgtgtccatgtgttctcattgttcaattcctctgagggatgtttctaaagccaatggggtggaggaaagcgagggcatccttgtgtgagagcagacactgaatgctttgttgcaactcaacttggttgcagatgggctcttacttcggctcctccttgtgcgcagttgacctgaatggggacggcctctctgacctgctggtgggggcccccatgttttctgagatcagggatgagggacaggtcactgtctacatcaacagaggaaatgtgagtacaatactgggcaatgtgcggatgggtgtgggggagggacatttgtccagccagcagtggccgagcacccctctgggccggcactgggggcaatgttacccagaggagatgaaaatatgtgatatctgtcttgaataagctcaatggcccattaatggaaagttatatacaatgttacaactgcagacacccaggggccaaggaagaatcttaataattgtcttttgagtgcttactatgtaccagggactcttcttcctgctttctgcgagagatttctatgcaatatacacatggtatcaagggtgcccatttttcaggtggaaaaactgaggcccagagaggttaggtaatgtgtcccaaaccacacagctaagaagtggggctgggatttgaacctaggcaagctggctttagagctggcatgctttgtctcaaggttatgccacctctctgggagcatatgcacattttcccagggaagcagaggaggacacaatggctggggaatcttgaagaaggagtaggagttagcagacaggcagggtgggctggagcagagctcccagtgcagagctgggcaagtgggttggggtgtgaggtggcatcaccactcatttcagcatgggggggcaggggactgcatgggaaccataatctttttgttcgtttgtttgttttgaggcaaagtatcactccatcacccaggctggagtgcagtgacgcagtcttggctcactgcaacctctgcctcctgggttcaaactcttctcctgcctcagcctccccagtaactgggattacaggcacttgccaccacacccggctaattttttgtgtgtttttagtagagatggggtttcaccatgttggccaggctggtctcaaactcctgatttcaagtgatctgccctacttggcctccctaggattacagacgtgagccaccacgcctggccaataatcttggtgtcccctattctgcagaaccatgaaagggacgtgacatggacagaaagatgcctctggccctctgtagctaatggagggtgggtgagtgggggctgggttgggggacagcagtgcatcgtggaagcaggagaccagtgagaaagcagtcttttcaggatctggaagtacaagtgttcaagtacaagtattcagcaagaacaacatggttcaatgaaaacattctggtgccgcctaccttttctctaacatgagaaaacgcttatggagataatcagtggaaaaatgggatgaaaactgcatgtacaaccagtcctcagaaatatgccaaatacatagaaaatgtgaataacagctctctggatagatgtttagttttatctttatccaaatagtgagaatataatttcatatttaaaaaaatcgaagtgtactgttaagcagtggctgagatgctaggtatcccagttgggagagggcagaggtttagctataactaagtgggcagatgccagaaaggaaggaagcagtgaaaggagagccagggattgttagagccttatgttgcgtctgaggttttcaggctcttcaggaagtcagatctaaaaccagggaggtttgggaggcccaggtgggaggatcacttgaagccaggagttcaagaccagcctggccaacatggtgaaaccctgtctctactaaaaacacacaaaaaaattagcctggtgtggtggtgcttgcctgtggtcccagctgaggctgaggtgggaggattgtttgagcccaggaggtggaggctgcagtgagccgtgatcatgccactgtactccagcctgggtgacagagtgagaccttgtcaatcagttagtcaacaagccaacaagcaaggtgcagtggtggttgcctaggaggctgaggcgagaggatcccttgagcaccggagtttgaggtggtagtgagctatgattgcaccactgcactccagcctgggctacacaatgagactctgtctctaaaaaaaataaaatatctgggagggaaggtgcttattggtacctgttgcaggaactcttggcacctgcatacccactgacattccaggaagtcagggcagggtgcagggagaaatgaaggggacattaaataaatgagtgctgtgggcattcagtggtgcctgccattgtatttgcaggagactgagacatttgtgtaggagtcaggtccaacagccagactgtgtgtctaaatcagaaggtggactcttgaagcacaagaactcccccaggcctccactgggcatgatgcacccacaccctcccctgccaaccagtgtttcttgatgttgtatggttattctaagtaccagagtattctcatttctgttgaacatcagccatttgaataaagatcggaaggcagtgtggagtagtggaaaaaattctgactttggagcaaggtggacctgagtttgaatcttggttttgccatgtcctagcctgtgtgatgtggacaaatggcttgaaattggtggcccaatttcctcatctgtaaagtgagaggcatcataagatcttccttatggagtcattgtgtgatttgaatgaggagctggctgtacagtacctggtacataggagcaatcagttgctggtgttcctctcctcttccccactacactgaaagaaagaaattaatgcatatttgtgttttggggtggaggtttcattcacccaagaaatcatctcaccttgactgttttcaaggtgtaaattgtgtttatagtgaaaaagaagacttggtcatgataaaagccagacactcgtgggatggcctgtaggatatagtgggcccagactgcctctgcactggggaatgcatacatcttctcatgtctcaggacatcagattgcattgtatcactctggtcttcatgtgtcagtgatttggggtgagagtaggtatgactttttcccccaagttagatgacttttcctgcctttgtacaccattaaccccctccctctgttggttagtattttctcaggaaattcatacctgagccatgcatgaataataggcacagtgacgtctgccatcacagccaccctctggccaagaacgactgggtgcttggattttctgaaccatgactccctctatcaagataactcatatatgcactttgcaaaacagttttataaacttgtaccaaaaggcacaggaaagaaaaaatagaaaaatgtatacccttttaaaacaacattggggaaaaagtgctatgccttaaggacgtggagagcacatgggggaaaggtgggtagggaggtttgcttgtgtgtagtgtattaggacaaggcagagagtgtagtcattggctaccatgacattctccttccctcaaaaatgcatctcaggctatgggagaccatcctgctaagcaggtaaaagggacgcattttgccagcaggagagagaagtttgggttcctgtaattctgcccaggtgtttcctgtcaatgagtgtgctctagcagggcagcattcaaactctggttttttattgatttttattgtttgttctgtttgtttttgttttgttttccattttctcctccatcctgtttcccagggagccctcgaggagcagctggctctgactggggatggtgcctacaatgcgcactttggagagagcattgccagcctggacgatctggacaatgatgggttcccaggtgagtgagtgctcctggtgcacggagcccctccaggtgcagcacgctgctctgtttcagaggggcagcctgctcgctgactgtccatctctagtggcatgctcctgggtctactgatccccttcgaaggcccatcaatgtgctgtggggagataggacacgtttagaggtgctctccctgtagacacgcagggctgagcttccagcccactggagttttgcctctgcataatcccttctcaccagctcagtgttctttgttgtttgcagtggaagcaaaccttggggctggtccatttgggacttcttatggcaagaagtttgaatagcttcatcctgccatcaactctccttgtttctgagcctttgatgctccatcatgctctaccatgttgatggggaaatgagtgaggagaaaattagaaacccagacatcttctgcctgattatagcagcagctagattgacttttgagagtgtacgcgtgtgtgtgtgtgtgtgtgtgtgtgtgtgtgtgtgtgtgtgtgtcttgggaggcatggaggcatatgtacctaatgtctaggtctgtttggacagcagtgttcctcacagcctcttggcctctctctctggcttgtttgagcctcttcacctcgctgcatacacagcatacagacgtcgggaggcagagcaaccatgtcaccagggcatgtggtggtggaggtggggcaacccttgcccaggccagccatccagacgtctttgatacctcctaccactggctacagtgggcttcattttcctcccccttggcctcacttctgcagacacatgactttgttagaagcaagggaaaaaagttaggaagatctaggttttgttctaggagttgccagtttgtgagagtaatgttatttcttgtgtgtgaagtgaatgcccttctgtatatttcctttatccaggaatggatttattatcaaataataataaggaatggtcctttatccaggacctcagactttctcagttacacaatagccattgtctatggaattctccctgatggaaattatggcacgtagtttatatttgcatttcttttattggatgggtcagtggtttttcttacgagcataaggtagaaacttttttggaactaaattcttctcagtcagcttctatagttttcactggactttttttttttttttttttttttttgagatggagtctcactctgtttcccaggctggagtccagtggcacaatctcagctcactgcaacctccgcttcccgggttcaagtgattctcttgcctcagcctccagagtagctgggacaacaggtgcgtgccaccacacccagctaatttttgtatttttagtagagctggggtttcactatgttggccaggctggtcttaaactcttgacctcaggcgacctgcccgccttggcctgccaaagtgctgggattacaggcgtgagccaccacactggcctacttttttttttttttttttcctgctgagggatcttgtccccaaattaatgcttgaacaatcaacaaccaataatttctggtatccagggactcagacatgacaaccagaattagggaagctgcacttgtattattaatgtggctttttaacccatagctgtttttttaccctcagatgtggccattggtgcacccaaggaggatgacttcgcaggggcggtctatatctatcatggtgatgccggtgggatagtccctcagtactcaatggtaattagtgtgagagtgatatggcaactgttcatacattcattcagcaaacatgtatggaaccttcattatgcaccatgccctggaggtacaaagaaaaacatttttcttgccttggccttcctacccttttgtgaaagatacaattaatattgcttattaaatactaaaaaaagcattcttagaatcccaagttcgctaacactcagggatgcattttgcctaaagaagataattttcaactcttactcagagttggagccatttatttaagaaaggaaaggaagctttctctttttggtgactactttgtcaaccgtctatgctaaggcaaaggaatatgttttaatatataatctagaagaaaaatggtccatggtggaggggcctgaaactgatcacagactgtcgtcccagctggcctcaaaaccaggagccagttaggactctgcgcttgcgccctatacttgggaacatggaagtggtgagttctgttttttgccgtatcagcttggtgttcaatcttgctgatggtgtcaagcccagcccatgggaaaaaaggaagtcatgctctcagcagaagcattgtcaggatatttgtggatgtctgcctgtggagtggcactggctctggtctttctcccagtgggtcagagacagaaggggacacacattgagaaatttccaatcaacaaatatttatttattgaacacttactacatgctgactacttcctactcatatgtatttgtattttaattttaagaggcagcaggtaaatgcaagtacaacttctacatgaataattgtccttggcagatagagataaactagttaagggtggagggttggttggttgtcattcgtgcctcagatcccctctctactggcctcctgctgagctcagtgcctcacctgcaggagacagggctttgggaggcgctgcgaagaggagggactgttttttgggtgcctactctgccctttctttacctttaatcctcgcagcagccatgtaagatgggtctgtttattatccaccatttatttatccacgaggcccaaggaggttatttaacttgcccaaggtcataagtggcagtatggccacagaatctttgccagtctgctgcctgaaacttgttatcgtaaccaccatcctcaactccacattgcaaaaaggaacgctcggaaactcagtaggaaaacttacgaatatggaaactattttgccatgaggcatacatagtctgaggggcatttatctatccagaccatcctcttttcattagaagtacataacaggagattaataaacttcggtgattcagcccacaaggcaggaggaagagagctttgggcacagtttgggggccacatctgagtcacaagagctgccctaggctgcggcagggatgctcttcccagggtgacaagctaaaagtcacccaaggagccccgtgctcgggcagcggtcagggtcattctccacgcatcctccgggaagcttgttttcctggacctcggaagctaatcacacagtgaggcaacctgtgagagaccccagcttcccctcctccggggccctcccagtgttttgtttggttgctgggtggaatccctgtagagaaccacagtataactcttgtggttagcgtggagcgtctttagtgggaagcagggatagcatctggaccagcctgcctttgtcagcacgcaggctggctcctttgctttgacaaagagaagtggttttgggctcttaaggaaaaaaaaagaaagaagcaactatgactgtacgttcccaagctgctaatatgcatatgataagggcagagatttaaaagaaaaaaaattctttaatggcagattcttgcaggcccaggtcctggacagagcaggcattgtgtgggtgaactagaggaaggaatcagaaacaactctgggcaatggaatcactttgctttggcccagatttgtattatttctgctgggtaaattgtgagatcagggcctacacttcttccacattgctctttaactctctctcgagtttaccacggagagtgtttattttaagatccttgtgtgcctttcccaatgtgagagccctctgggcatatggcggcccctatgatccttctcttgctggaggggacactgcatagaaacctggtcaagtggaggtttccagggctcctggttttcatttagggttattagcactgggcagacttatcttcttggcttttagcataatggcctgcagatgtctgtgggataacttaagcctgcatcaccaccccagatggaccaccccttcgctctgcccctcgtcccagccacagcataccttagaaatgtagatccaggggcaggctgctgctagagttcttggacttcagagccaagagggtctgcttcaaaacgtggcttttaagaaatgtgcagacacacgtacatgtttgtttagacagagccatgtgggatgtagggctttgcctgttagtgtgaaacatttcttcagtgtttcctacagtgttctgatttgtactttggtgcttggacatttcctgttggatggcttaacggaggatggcaagcagccttctctgatcacttctaggagggttatttgcagttatcagctgctgggggtcagggggcatctctcgtgcctccatctgtagatcctgtgaaaactcccccctccttgccttcgtgacttctctgcaggatgactcgggaaagagaaggataaggaaagaaagtcaaagtgagcccctagatagctgtaaacctggttctattgtactttgaaaacaaagcatttctcttgtcctccacagtgaggacatcaggaagtaagcctcccctgggggaccatgcagataaaggcagaaggagtaggtcagaccccagaagatgggacttttctgattcaagaagttcagtatctttgtgaggaactgcgccacacgaatgttgatgcgcagcttcagtgtgacaaaggctgtttgtacaataaatattgttgaatcagtgctgcctgtgtggatatgtgatgaacttaatgatgaataagaagtgagcacagccaggagtggtggctgtaatcccagttccttgggaggctgaggcaggaacatcgtttgaggcttggagtttgaaaccaccttgggcaacatggcgagaccccgtctgacaaaaaaagtaaaacagctgggtatattggagcatgcctatagtcccagctacttgggaggctaaggcgggaggatcacttaagcccaggagtttgaggctgcagtgtgctatgattgtgccattgcattctagcctgggcaacagagcaagactctatctcttaaaaaaaaaaaaagagaaagttttttgtttttaaaaaacatataaagtaagcatagatgctagtgtgtcccatggtgaagttgtgaactctggttggttgagggggctgttttctagaggggagggcagggcatcttcttcagctgagtgcttttgatttcctacagtttaagaagtgttcaggaccatggagttctagatttactgggtaaaactgttcactcctgtctgtgaagctccagaatctatagatcatctggttggctggatggagaggtagtttccacatggccatcttttccagctggacatgttaattacctgtctgtctagggaaagactctgtaatgtgtgcctcttaggagcagagtgttaaatatttagtacatatttgggaagaaagatacaagctaaatatgttcttagaatttcagccagctacacctgtgtaaaaacaaacagaacctgcattaggaatggaagttaaactttatccattttgaatttcaacatgtcaaaacattatcatggtagtctaggtggatttttttcattaacacagaacttagaaaaaattttaaatgatgacgtttggccaagacaagtaataataaaggagtgtgtggccttcaactgcctgctaaagacttgctgatcacattaggattactttttttttttctttcaacaactttaagaccaagtgtcctagggaagctggaataaagcagtcacagttcttatttgtgactgtggtcttttcctgtgactccatttccctattatctgtttcagaaactgtctgggcagaagataaatccagtgctccggatgtttggtcagtccatatcgggaggcattgatatggatggaaatggctatcctggtaagctgtttttctttaaaggcacatgagataaatgaagataaatgcatgaagtagaataattttcagtctggttagcaatcatcacatccatttaggattaggacaattcacacaatagaatagggtgttttgcctggtgttcaattttaaggtgaaaataatgttgatatttattttggggttttaaactgatctactctgaatggcttagcaccaggagggtggatttgtgtagtggtttctggggcggtaattctaatgaagaaaaaaagcactggccacatctaaaatggttgaatagtgaaacctcatgttttcctttgtatttaaccacattcaaaggcttcttactcttgagagggaaaaagagcagcacccccaccgccccctgcccctactcttgaaataaaatgatggagaaagatttggagttaaaagaaaaccaagtcctcttgcgtgtggacaaagcagaccttcaccattcaatgctggctggcttggctttagagttaattattgcctgtggtggttgtggctaactggataaagatacatgatttcaaacccaaccccaagtgatatctggcctaggtcaaattgcctgggtggtggagtagtggttcttcaggtgtttcaagatggagtggggtaaggtaaggaaacaacagtaagaatttgaaaaaatccagaatggtcatggaattcaggaaacatttctctaaattttatagtcatcttgcttttgagaaatatttctttccactaaaatttaagaaaactaacgcagtcttgtatgaggacaccacattgtgtatttttgtacagataggagttttggaaattcctcaagacaacagagccaggaggaagtaagggaatagaaagaagtcagtgttgaagcttttgtcccaagaaagacccttgtgggcctttttaagtttgagaaagcagttcttgttctggaaaatttgtggccatccccaaataataccttatatgggtttagcatttaatatgtacaaaatgcttccacatgcaatgtgcatctcgcagtgaccccagcaggtaagtaggatagggtgttttccccactttataaacaaggatgctgagactcattgtgaggggctgcccagagcctgcagtgcacggggatccatgcttcccagtggttcagctacttttctgtaaatgtgaggtgagcaaggtgttcacagttcacaatggatctgaatttctgatcttgtgtttttcataagggaaattgacaaattcatcaggttcttttatttttaaacatatagcaaatttaaagactattgaagaacaaaattgatacaacacccaagtggagaaattttaggaacactataattcatggatttgccatttgtttttccctaatgagggcatcatatagatgctcagtgcatttagtgatgtacagattcagaccctcttggactcagatacttggttctgtgaagtagtagtgggaaccccagggccagggatttatatggccgggttggggtggtagggagaaaggcatagaaccactggaagagtaagtacttcctaaattaaagttatttaggaataaacattaccagttaaaccagggtcttggtttatagcttaccaagtatttccatgaatttactgacttaaatatctgatttcatatatttaataaatatttactataaatctagtgggtacttaatgaatattatataatgactaataaatattttctgatttaaatgtaatgaaatattatcagcttttgaagaaggccctggggataattatcttcattttacagacagggataccatgagatactcaggtcacatagagtgaggggtggagggtgacaattccatgttcttcagaacctagagcattttccaagagtcactgaattctaggtatgtctttctctaattcactgatgtgaaaagaagtataagccatatgtgtaatctaaaatattcctgtaattacataaaatgataaaaaaggtgaagttaattttattaatttttttagcccaatatagccaacatattatcatttcaacatataatcaatatgaaagttattagtgaggtagttaatggttttctgtactaggtctttgaaatgtggtgtgtagtttacactcacagcacctctcgactgagactagccacatttcaaggccccagtagcctgcgtagggattggctgccacgtcagagagtgtggcttccattcttacaagatcattgtatagcccagacagtggtcgtctgagggctctccggcctcaaggctgggtctccatccttgtgagcgcattcccagggcgcggttgtgtatgggcttcagcaagtttctgaacgctgtaaacttctcattttcagatgtcactgttggagccttcatgtccgacagcgtggttcttctcaggtgagaggccccactcttgctccttgaattgtgctgttcagggtgagggatggagccattcaccattcatgggctctttcctctgtcctgttccttgtaggctggaggtgcttagtaagtggaaatgctaccttattttctcattctaattattctctatcccagagtttctagctgtggccttgaatggcttgcaggtatgagatgataacatcctgggagcttctaggtaggggttggggtagcctaactcttaagcctaaggtaggggttggggtagcctaactcttaagcctaactcttaagctatttgcttttggccaagaaccttccataatgtgccataaaaatattttataatttcctgcgggtgctgggaagcactgttcattctgtctcttcatctgtacaccctgcatttgtacctccagtcagtccacaacaccctggggaccgggagcctcctgcccgttagacagcacgtcattccctgttggctgcagaggtgagggacatgagctgaggcccagagcttgctgaggcccgtgcagtctgcatctctcctgcaaaggccagtgggccgccgccaccacccgtgaaccctctccaagtatttctagctgtatgagtcagaggaggcagaattacactttggagtgggagccaattcttaggttttgttaataacctgatggcagaactttctaaaatagactaataggatctcagagctggaagggatcccagaggccatgtagttccacaccccagatccttcttattcagcggtaccttctgctggtctccactgcagggctacacagcctcctgtttgagtgagatgccccatgagtgggagcccagttacttctaagggaaccagcttgccccgggtaacattaaatcttgaattattaaagaggcagaagagccttgaggttgaatgtgaactcaggggccaggtggccgggttccagccctgactctgcccttactaggtgagtttcctgggcaagtcccctgacctttctgtttcaggattctcctctgttggccaggacagcaatacagatgctccttgacttaggatggggttatttccagataaatccattctaagtcaaaacatggtagtttcaacttaggatgggtttatccagatgtagcctcatggtaagtcaaggagtgtgctgcattcctatggcttttgcaccgttgtgaagttgaaaaatcataagttaaaccattataagtcggggactatctgcagtacatgtaaaatgttcagaacagtgcctggtttaactgcttaataaatcttagcaagtttgatgtaaattgggttaaatttgcctccctaaaattctgcttctcagtcttgtgtcttttatgtagcaaccctttagtatctgaagggggcaattgtgtcccccaagtggtgacttcactaagataaggcctccctggttcctgtaattatttcccatgtgactggattttcactttctttatcagcgcttcctctggataaaacagcttttgtggctccaaatgattgaggttagatttgtgaatctggttgctctagttggtgctttcatgatgtcatctttgctctcttcattatcctgagcatcttactttggtttgtcaggattcttctcaaataaaacacactcctcaacttttacagttgaaaacaggcttttttttttcttcttttctttttttgagatggagtcttgctctgtcacccgggctggagtgcaatggtgtgatctcagctcaccacaacctccgcctcctgggttcaagtgattctcctgcctcagcctcctgagcagctgggatcacaggtgcacaccaccacacctggctaattttttaatatttttagtagagacaggtttcaccatgttgatcaggctggtctcgaactcctgacctcgtgatccgcccacctcagcctcccaaagtgctgggattacaggcgtgagccattgcgcctgacccaacaggccctcttaaaaccggggccatctggctgaaggtccatcatatagactctgctttctcatcattcttgtgttttttaatcttcctgctgtgagcttaatccaaagggtattttctttttctcttcttcatggtgagggacagccttctccaggagtttgctcacatatggatgtaaagtaaagcgaggcagttacacaatgggtgggagaccccagactccagcctaggatggagggttgaatctggtgagttggagctcaacagggacaaatgtaaagttcttcaagaagaactccagggagagcacatatcaagagaagagacctaggagaggagcctggggagccctgccctgaataagagcatggaaggcccaagaagagtggtcgggccatgacagctgtagagtagcatgcaaggatgttgtggtcacaataatccattatcttattcattcagctaaggtgcattgacctgttgagatgcagccatgcatcagatcctggggatttgatgggaaacctgacctagcctgtgaccttagattatagccagagagccatatgcaagtgaataataatgcaaccaatgtttggtaagctcctaccgcatgcctggcacagtgtgagcacttcatttgtgttcattctttgttattgttttctttctgtattaaggtagaatttgcatgcaataaaatgcaccaatttgagagtatgactccatgagttttgaccactgcatacgctgtgtgactaccaccccaccacaataaagaatacttctgtcaccccagatagtttccttgtgcctctgtctggtcatacccctctcctgatagacaaccactgttctgacttctatcaccatagatccatcttgcccattctagaatttcacattggtgggaatatacagtatggactcttttgtttctggcctcttttaatcagtgtgatgcatttgagattcgttcatgttggtgtgttgcttgtttttccccttactgagtagcactccattgactgaatatccttgagtttgttcatccatcctcttgttgacagaacacatgacaactcttagtcttcttaacaatccatgacataagtggggctgttatccccattttatgggtgaggagaccaaggacatgcagatcttattaatataaaagggaaggtgattccagatggtggtaggtgctgtgaggattctaaggcagggttacttggtcaggcagtggtgtcaaagtcagcaggaagggccaagcagagtgaggcctgagacttgttggaggtggcagggggaggtcaggggtgcccttggctgtggtggctctagagaagtgatggggcaaaagccagatggcagtgggtgggtgagagaagaaacaagaaggacagtgactcttgactgcttctccagaagcttggctgcaaaggagcaaatgggaccagcaggtagttcagggaggtgttttaaggacgggaagctctagatcagtgattaggccaagaacgtctttgagccattttctggtctcccaagtcccttaccctcttggaagagatcagaggtggtcaccctcagcttcgccctcatctatgtgaaccctgatgccctaaccctgtgcctacacccaagggtcctggagaggttgaagagacaagagggaggatgggaggctgctccagggatgagggatggggggatgaggttggtgagagtgatggaatctggtacatgggctgggggcgaggggccctcatcttctgagccaggccccaagataggaataaggtcagagcaaggttcagttccggtacatgggctgggggcgaggggctctcatcttctgagccaggccccaagataggaataaggtcagggcgaggttcagtttgggatgtggatgaggatgaagcagagggtgaccaccctggtctattccaggaggacaagggaatcagggagagcagggaaggcttcaaagacaggctggagcccctaagagaggaagcaaggtggggcaggcaaaggggttgctgagcatgtctgaggggccagcaggctggatgtctgcaggggcagccgttgataaagtcccaggattcagctgagcagcagtgaaggcctggaggcatcagctggctatgttaagtaggggcttggctcagcctggcctaactgatgttagattttgagttactttaggttttgggtgggactagaaaagcagggagagctaggagaccacgcatgtgcaagcacacatagatatatattgcccatcgttcctaaccctcctaagggcaggaggccagaggtatgtgggttaggaatgctatgggctgcagctaagagaaaacctggctgaggctttcaactatatgacctcaaattagctccctggaggtaggtggccccagggctggcttagtaacctaacaatggcaccagtggcaccaggggtgaaggctctttatctgtccttgccttgcagaaggccaaggcaccttgagcaacatgtcaaagggcatcccaactggttgtattatttaccttgaagtgaagtgtcaggatttgaactgtcagccctcagggagaagtgttccagctaccaggtttttttttttttttttttttgagacggagtctcccgctgtcaccaaggctggagtgcagtggcgcgatcttggctcactgcaagctctgcctcccgggttcacgtcattcttctgcctcagcctcccaagtagctgggactacaggtgcccgccaccacacccagctaattttttgtatttttagtagagacagggtttcaccgtgttagccagtatggtctcgatctcctgaccttgtgatccacccacctcagcctcccaaagtgctgagattacaggcgtgagccaccgcgcccggccgctaccagcttcttaagaaaaaaaaagcactgaaagcacttgtgatgctgtccttgggtgctcctttgcttttatctcagaggctggcaatttgtaggcaggactgtgagacgcagtctcccctgcccccaggagtgtggctggcccactctgccctcaggaagtttgcttccctcagattagctccggggcaggtcctgtgtcagggtgataggcacacggtgctctcccattgaaggtcacaggaagcgatcagagaggcctctgaaagatttctgggcttttcttcatccaaaaacaatacttggagttgaaacaaaaaggttgaagggaactgatccgacagctgtgggaaggagatgtacctgtgaaggtccctgtggtccatttcaaaggatactgtttttccaacttccactgaggtcactgtgtctgggctgcccacgtctgtttcctgcctgccgcactgtcttctgcagagctcttttgtgagaggaggattcggcctcctccctgacgaggtggcccctggggatgatggggcgggctaggcttttcttctgtaccatgaccaggcgcgtcagggaccaggcaaggtggagaccagctcttcatggtacttctgtccatctgtgaggctttggacactcgtggttttcagtctcctaggctggagtaaaatttgtatttatttaacaagggtgtttgcacatttattatgggaacgagaggatgaattcaccggatcccagcccttgcagggtgctgcaggatggtggggcaggtttggaaatagacaatgactgttcaccttagtaagtgggggccagaggtgtgtgtacagagctggaagcacagagagggaggatgcctgtcaggggtactagagaaggcttcctcagggtgggaacatttgagctggctgttgaaaggtcgacggggttttatagggtgtccattggcatctgcacaatcacactggccaggggtaagagatccactttccgatttatttctagtatcctataaggatgaacccagaagaaaatggaaagactaaggtgttggccttctttcaggcactgctattgtctgacttccgtttgtcctgtggccagatttgctctggaagtcccgcagttccactgcatctgttatcactactctctgttgaccccatctcccagcatggtggcagcagtggagtcccctcaccctatctgtgcctcgtgtctcttcacttcctttgttcacccagattttccttaacgctttcttccattggagttggtgtgggtcatcattcccatccgccctatcaccctgggctctctttgagggatcattgtacacaggggcatcattgttctcaagctactaatgccccttaatcttgttatgtcaccccagtggtgtgaaggccagggctccttagaggtaaaagggtctctttgtgaggcctggaggggagaaggttgagcagtagcttaggtgaatgctgcctgagcagatgtctgcagtgggagcagaatggtgtgatttactctttgtttttgtgggatgtccttggggagcccaaggactgtccattcatcaagcactgggagatggtccatggcagggaggagagtatggctttttattgagtttcatttggtcataagactgggcaggttgatttcttctgccctgaagcactttgctattaccagctgggactccacttatcaagttcttttaggaaattacccaatgaattggtggaggtaaatgatgcaggaggtttgaccaactggatggggctacaacattgcagttcatgctcataatggcagcaaatgcttgagggaatccctgagtatgcatctatttcttgaatcatggcatctgctataggaaatcctcttaaatgtattcttatctccctaataaaatggaaattggtacttaattggtaaaattttaaataattacccagcatctggtggttcatttatggcttcaaccagatgcgttttattaacaacaaacttgcttttattattgggacgctaactattaatttactaggcaatatgccccttctaaaaccagaaaaaaatgctcacagaacatactagcccttctctcttgggatatttcatgctttaattaaatgctgggttgaaggcctaggatttatcctgttggtctagttcttgtttggttctgagagctgctccttaccacgactaagtcaccttcctctcttgccctgcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggtaatgagccaccaagtcagggctcaggatacccgtttagctggagtgggctagtgggatatttccgatgttccctgtcgctgttcctcccagctggttttgcaggcagcaggcacacaggctggacatcctttccctctgaggttcctccccttctatttcctgcttatcaacatgtttctaatgtcacacaacctccagctctaggacaaataatgttggaccccaagcattctttttgcaaatatgagggctagactgaagcctcattggaccacaggtcctatgggactggtggagatatagtgcctggagcctggcccttagggaacattcgagcagttagaaagcagaagtgacaggactttggaggctccttattgagcttgtagcatcagccagatgtcaggggacttataccatttactatggaattggagaccaaagatggatggtgggattcggatgctggtgttacagaggcttaggtttctaaaagaggggtgctgctttggcagctcagaattgaaaagaggcaggcattgtcctgacagctggtaactgtccctgccatttgtctggctggggaaaatcaacttgctagcccagctctagagactggattaaaccccagaacaagatagaaccagtgttgattggaattcagagcacgtgatcacctgaaggaaatgaatctggagctttatgcatattactaggtgcttcatttttatttaaaaggctgatttaataatagaaagaaaaactccaggcaaacaaaaacactaacggacctgaacctactgacgttcttagatatttttaatgtcatgagtgactccttttgctactcacagtgtagcccctggcctagcattgtcagcatcactgggaacttgttagaaatgcaggactttgggctccgctttggacttctgaatcagaatctgcattttcacaagagccccacaagattcctgtgcacatttaagtttgagaagcactgctctggagcacacatgtgtgcacacacgcccactcatgcagaaatatttacgtgagctagttcattcctcagccacacctcaaatgttctaccttatttaatatgttcatccttcttggctgtctcattggcaatttctcttgatcttcaggtatattgaataagctcaacgattaaacatatttattttatcattttttaaaaagagcttagaaatttcaacattgaatgaaaccataccataaaacttgggaactggttagtgagggaggattaacaacattttcttgtgcagctcaatgagaaagagcagctcactcaagatcacacagatattgttgaagccaggagttgaatttggatcttatgatacttagttttgctttctaacaactatttctcaccacctccataattgtttaagatactacagtcttaaggaaaaaagctttctgatagttctgggactcgtgtgtcctccacataattaagcagtctgtcttctgtccagtgccagctcatcacgtagttggactctgttaaaaaacatttttaaagaatgaagattaattttgatacacataagaatgagaactattctagaactctcaaaaagggcaaacgagtaatagtgtctgtgtatgttcatttgacacatgcttattatgtatccacatgtgccaggcactggagatatagtcctgccctcatggagcttctaaagggagttacaaagagtttctactattttggccttgaagcagtgttagacaacgttcacttatcgctgttgtgaaagtgaaggtaaattggcatagctgaagcagagaagaagaaaccaagatgcaagttagagcaagagtgattcagagcatgagacaagtggtagagcaaactctgatttgaaggttcatgagctgagcgcagaggagatgtgggtgcctcctcatgctgttcccgaccagtggctctttctggggccccatctagcatgagcctttcacagactgctaagcacaattagaatgaaggtctaggcttagccatagccccagaagtgttggggtaaagtggaagaggccggcagttggatggcatcttgtactgtaccttgtgggcaatgcgaagcaacctggcttatatctgacattaggtggggcccattcagcaccagtgtaccctcccattaatttctcttccctatcctccatctgccacatgggttcatagataaagtcaaacatccctttatactctaagggtgtgtttccccgataatcaggcttaaaggggatggtaactggagaattttgatatctcagtataataaggcaatgcagaaaattattcatccccagcatgtttctgtcactttctctggcattcatatctcaatctttgcagtagaaagagaaatgtagaaatctgccagaaaatgtgctggcagtgaaatggagagtttggggagggaaaaatgggcaggccttatggaaatgtgataggaaatgaggtggaggtgaaaggtcaggtaactgtgggggcccagctctgggtgaggtgtcctagaattcagcaaggaaggcagcctcttggctctgcacagttgggaaggtcagtcttcagatggaggaaagatgggcacttccaggacacagataccctccactcccatccaagctcagcagagggtgctggccaactctgtcatttccaggcctccgcctcaggaacccacagctgagacactgggttaccagccttcctactctttgtgctggcagctgcagaggaaccatgtggatgatgactttgtccatggaatgcctggtgaatgagtgccagccctgggcaggccttccaggcacctctcaatgtctgcatatcttgggctgagtttgttattaagacggctgcatttgggcagagcaatacacagatacctgtggtgggctaggtactgctgtcagaagtggtatcttctgtggtatttatctgctgctgtcttcagctacatgacctgctctctgaggatggttttgagagccataagcagctgatgttagtcttgtgcctttggtttcttcttctctacctggcagggttcaagcctatgtacagagaagggacaccaactgcctctttatttcctgctttagaaatgggagaccacagtgcctacttggtcatgggagtgttcaggaccagctcattagcgggacacaagctgctgtagcctctgtaaatactgtaggaaatacagactttctctgtaggaggtgaatctgccttggcctctgaaacaggcagagtccagtcaggaaaacaaaaaccataccagttattttaacagaggaaatttagcactgggaatgggttaaacaggtcatggacgacctgggagtaactgcaggaagcagctgccgcctccaggtctgcaccagtggatctcaaagtgtggtcccagaccagctgcattagcatcacctgggatctcattagatatgcaaattctgactagaaactctgaaggtgggacccacatctgtgtttttacaagcctccagatgggttcaatttgagaaccactgttcaaggttatacttcgggttaaccacttccttggggttatcagaacctatgagcttggagaaggggccctgcggagctaggacctgaacctctgaggaggaggctggtgctgctgatctctctgagggagtgcaatgaggctggctctgggagaatggggggaaaattgaaaactacaattaactgctgttggggccagctgccgtgagaaactgttgctgggataagctgctaggaataggaagcagggaggaaggagcgagttcctttgccctctccagccttgcaggctccctctgatgctccatattagcagagccgcacagcgagcctctggcaaaacaagtgaggtttgcagggtcccagctccagtgtcacagtgcagggtagagaagggtgggttggagctgaggacaacagcttcataaaccagcacagcaagcatccagttacattgagttgctgaatccctgttgggtcattcaatcaaacaataataattaaggtcctacagagtgccagacaccctgcttatcctggggcacggagcagtgagcaggacaggcaaagtccttgccctcatggagctggcattctagtgggaggggggcaggcagacgggacaaaaacaaccagctgctctcttgctggcttttctagatgagctccgggccccttgtgtggcatgcactgtgcttagcactgggacacagacagacacagacttctcactccgactgtgggctcctccaggagcaggtttacaacgtatttcataaagcactttaaaataggagttcttcctgtccctaatagtattattcatcacttcattcttggcctgggaacagcctgtggccccttggagcctcctggctagcataggtgaaggtggtgaatgctttgcccaaggggaccctgcccctcacccatggacggtgcttgtacctactcactggccaggctgaagcctaaacttgcttgtcaatctctggaggctgggaatcaagctggcagttctgggctttcaccagagtgtgaaacgaaaaccaggaaggggcgctctctgagtgattgcattttgcactcagacccagtgctcctgtgtttccatggttagcctgaaactcgggaaggagaatttgttagaatttcacagctgaaatcttgttctgacagagagcaggaattaatcaaaacttgctgggagagaccagagctagagttgatgagagacagctggctccctcctggcccaggcccgtgcaggggggctcctcgggaagcagccgggggcagggcagggaggtggctgaaagtattactcggggctgatcagcttttccatcaccatgacatcattcgacatggcagggacacaagctgccagaaggaaaaacctaaagatgtgaaatgtgctgttggagcaggccctaatcagaactagcagcctcccagggacagacaggggctggccaggctggcttacctcatggccggctgtgggcaacttggacagcctgatccacccaccttcccagggccctgaccgcggagcccgggcagctgatcggctgcttcccagacatgtcctctgcttccctttccaccagaccctttaccagtgggtgctggtaaaactgccagttccgctcagggctttggaatgagtggtcagcatttcttcttgcctcctcaggcagggtctctcgttgtgactcttgctttcttctagaggagacagtctgatgtagaagtaatttcctttggggtaatttaaaatgtcaaaatttaaatcaaggaaaagtactaattaggcagttctagagatgaaatgcttccagaatgattgcacttggtgaattggataatgcggtatgtctgtgattgtatgttttaacattttagagaaatctgaaagtttaatgtgctggcatgcacacaccccgctggagaggagcagcagttgccttgtcctcagctcagtttctgtgaactgtgggttgtttctctcttccttgagttgcaagagatcagtacttccggatcagtacttctgcagtgagatgaaactttggaggagtaaagttggtgtttgtaaattatctagcacagtgcttggcacacgttgcaggttgaatttatttgcttttccttacttaccctgtgttaatatgggttctccccaaaacagagcctgggtcaaggatctgagtgcatgtggttgatacacaaatgatcccaagaggtaccagtaaggaaatgggacagtgagacaggaaaggaaggcagttgcaggcctcaggcttctccagagaaacagaatggagagagaaagaaatggattagttggttgattttcaggaattgggttgtgagattatgaggtctgggaagtctgaattcttgggggcaggccagtaggctggagactcagggaagagttgatgttgcagctcaagtctgaaagcagtctaaaagcagtttatttttttgggaaccttagtctttttctcttaaaaccttcaacagatgaggcttgcccacattttggagggtaatctgctttattcaaagtctactgatttaaatgttaatctaatataaaaaaataccttctcagtgacatctagattggtgcttgaccagattctgggtactgtggcccagccaagttgacacataaaattagccatcagagcagccaaatagagggtgtcttattgagcaggttaccactgtgggcagctggagctcagtcctgctggggaaccctggcagtcagtgtagaccgtgccccagaattaccccacatcaaggggcaagggagctggggccctgcattatggagggctgctctggggacttgagttccctggcactcctggcttgccaggcacatggacagagccactagagaaagccctcaggagaagagatgcaggtactggcagttgcaatttgggccggacagcagagaaatggtaaaagccaagaggatatgggtgggggagcaataccatcagttccatcttcctgtgttcctttccacccaggttttctctgagctcagctagttcatctctggtaagatagtccagtctcgctgttctctccattgtctcccttcctgagggaaggcagccattcacctgggaaggaggctggtcaggggaccccgaggagagtctgctcagcagctgcctccaccacattggttcacccaactgtggcctctggcttgtcttccagcaatgtgtatctgtagccatgactttgcttaagcgaacttggaaattcacttcatttaaatgtaatctttcttacttcagggcagttgttcagggaagttgtgatcagtagaaagtaaattggctagagttcagttgtagatctctgcacttgtttggacctgctatccatgcattcaaaaaaatgggaggttttggtcaagtaatgtacaacatgcagcaagaacaagtgtggtgggaatagcctggcaccagagattaagggagtcctagattcagctgtttgatgggtggccctctggcctggagcaagtcttgttcccttttggggcctcagttccctcatcttaaaaaatgaaggtttttgagcttagtggtctccaggattgcctcaaagctttgccagtctgaatctacccttttcttgctattgtccccattggaattggtgtgtgacacttgcacaggtgccagtgttttctgtgtgggagcactttcctgtatgcattattttcttcttaataatggcacctcctgagagtatccaggtctcagatcccttctggtgacacagccttgccttgtaagtcaactgtttgctggcgttaaacaagttggggcagatggctctgctgactaggaatttgccagctcggcatggcaagatccctgagatggcagaggcccagggaggccattagaagcatcaaaaatacgccctgtggcaggtgcagaatgcccattcaggtcaccttcctctctgcctgttcatacctcccctggtggctgatcccattgatgtcattaaaagccggagccttccctaatgcctgacttcacttacttaaatgccagtgggctcggggctacttgttactgatgcaaagcccccagattctaagaggcaggtgtgtggagacagggcagggctgggtcatctgccttctgttgcttagccatcttgccttgtcattccagggacagagattcctgttctctcactttaaaaataacatatttccttgaatccccaaaacagttaaaaaataaaaagggttacggaggggatgacctctggcacagaaaagcagtaaaataggtgtattgacactgaagtcatatttctataatgaaatacatacctatctatttacttattgactctgaaataacagaggtagatccttccaggtttatctagcctgcatttgatactgtgatcatcttttttttccttctttctttcttcttttttttaaattcaagactgtgttacaaaagttctgccatctggcatacacattcaggtatgggggtgagttattctttgcaggagaggacctcagtacaggccctaccgtggtcatagttttgttgaaaggataggcactacaaaatgtttgatcaccacactcggctacctgggaataaaggcaactccagccttcatctgggttcctgtgcatgtaaactacctgaaggcaggagtttatgcctgcgttgttcattgatacatcccctctacctttagcggtgcctggcctatagttagtgctcagtaaacgatggcgggcacatggtctggtccatgtactgattatagagcacgactcaactttgttgagatgagttaaaattatcagacgagatggttcccttgtgttgggcataaaccatgtgctttatagaagtcagtattacacaaagccttgataatttcagcagcttctggtaatgttctgtaggtttgtcatgatgttttgcttgtcaggacactaacctgtgttgggtacaccttgttaatgggcatattgctggctcagttgatacctcatgatggcatgaggtttaaatcagggagagccgtgaagtatgacacaaggagagtcattagaaaggcagaggacatcatgcttctctctcgattctttgagcaccctggctgtgtgctgctttctgagcaagtctctgcttggggctgcagtctcctgccatggaagggtaggtatcatatgagatgtgcatgtgatcctgtgacaaggaaaagaggtggcctcatcacagtgtgtcggtcctttctgacattttgacctctcatttattggcaggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaaggtcagtcctctcctcctttttatcctcaaactttgatctctgcagatgttcacttggagctggtggaaactatttttattatgtattatgtgtgctcttccaaaattttatttcacagggaggagcatatccatttcttcttttcttttaaagttggcctctgacagcccttttatttatcttactgtgttgatttcagcctttaaggggggtcgtggtggtctaggagaccagtgatggtccctggctttgacttgttcttttgagaggtttctcatcctctcccctctatgaggcttggtagccttttcagaggagagccttggaagcatgtgcctctgggtctgcagtgatgctggatcacactgcacctgatgcctttctcagtggtctactacaaattagctcatggtcacagttaaggcattttaaaactggttggactagattcttcccccttgactactttctatttattttaggatgcattttttggcaacctttcccctcgcactctaaataaacttgcaaatgtttttctcctcttgaaattgtttgttaaatacactttgctgctaattcaggaggccaggctttgattagctacagagtggcccttgcagcaggcgctggcagggtggaagacctggcagtgcctgatgctgcaggaatggccagacactgacccatgggcagggtcagagagcggaggaggtggaagaatgcacttaatccaggccacatggtgggtggaatgagcatgggttttggagacacatagatccagtgtgtatccagctggacacataattgtgacctctccctgtctcagtctctgcatctctaaaatggacacagtagtccttaccttgaaaggtggtcatcaggattaaacattacacaatgaatttacttaaaggaccttgaatggtgtctgataaatagaaagcaaccaaattattattatttggttgggctgtatataattgccaatattctttttgacttacaaaaatggaaatttcatatagctcaacccaatattgtttattagccactggatttctgactgatagtttgaaaagtctgcagattagagatgaagtgtcctcctgttagtgccagagcagaagaataacagctgcttctagatgcttcagggctgtgtatagagagatgccccacacacccatggcccagagcccatgagtccatgcccctcagatgcttctcagtggggctgggctgtgtcttctgccaggactcctgcaggggcctgcccagaccagctgcctgagggcttgggatgctggccatttataaagctgctcctgtgcctgttaagccatacagccccgccccgtcagtcttagattacattggcttgttggtgcctttggtggggtgtgaggctgcgcagtacaggctcgtatgcaaacactgtcaggcctttgaatgcctgtgattggtgtttttatacctgctggggacagggcatcttctctcgggcctcttcttgctaggtctgttcacaaaacctttcctttaggtttctttgcagcttcttgctttggctgagaagttatcctttgttcctagttaccaagggtactggctatgagatgccacgtagagtggcaatagtgaagtgcaggccagaggcagggctgtttctatggtggccctgagggttactgggaaggatcagggttgcgcaaggggttggtcctgctactttctgatatctagggttgccagacttagcaaataaaactatagaactcctaattaaatctgaatttcagatcaccaatgaataattttttagtatgagtgtgtcccaaatattgcatgggatatacttatactaaaaacattttgctgtttatctgaaatttaaatttaacttggcatcctgttggcagattcaactctgctgatcttcctctacccaacaagtggcatttcttcactcaagcaaaacctggctgccaagaagagagattgagatgatggttagaagagtttggaggctgagctcagggctctcgagtgcagatccagcacagaccttgacgtgattattttggtcattctagggagagcaaaagagcaggcctgcttcagtgaattgggacctagagtcatttggatacagtggttgcttggccattttctcatgcaaggaggtgggagcggagaaatacaccagatagacacatgtctctgagacctttatggttcaagaggcaacattgttgccaaggtacactcaaggtggctgatactttatagccatactttataaccatgagaatgtttatttctggcagttactgtctgggctgtagcagaggactgggcaaatggcagagtgcacccgtaggatgagtgctaatggcctagctagctgtccacagaggaggcagcaggcaccgccccggcttactggctgtgggaacacagctatggaagctgaggcaggaagcaaggatgaggggaaggggagtggcagccgggccacctcctggagcaggaactggggcctggggggtgttggtcaggggtcaagagcaggatgcagtctctactgcaagtggagctttctcagtggagctggctctcggctttatggacaaatcaaagaagataaataaaagcattctggcttatcacacaccatatggctagcagacagtggggccagcatgaggggctgggcctgctttgtttaggctatctttaggtatttttttctttttttctttaagcctattccaatctttttttttctccctctccttttccctggaagttttcttgccatatatggtgataagtgactttatcatggaagaccgcacaggctaacacctgttttccaggctaactgtcttgtaccagactttgttccattcaccgtattggagggcacctccggagggtataggattttgtgataaggcacatcctcctgaggggagggcaggtactttctcacggcctcactgtggtcagcagagctgaggcagctccagccacttccttggcttctctgcctcagagttcacacaccccggcttatcttccctcttccccgagaccagcccagttttggggatggggcccctcccactagccagtcaggctggaggcctctggtggatctcacagtcacaggcgaaagcccaacacctcccctcagcatcgggctctccatgccctgcctgaccttacctttctagacccatcttctgccaccacatcccctgggccccagctcttgtcatgacctgcccctttcctcctggaacctgctccttacacttctttgccttggttcttatgctcacagaagtcagaggcctggtttgtgtcatattcatgtagaaccatctaccacctgcatgatttttacatttttttggtcttaaactcatactgcctgtgatattttctttcatatttttctctttaaatcagccaacttttggtctcaaataaaataatttaaaacagaaactttgtacctttctataagcagaaaaccatctaacatgtccccaaaacagaaagtaactgtaaaaataaatatattgaagacacaacagtgtcctagaattctagctggatttcattgtttgtcaaagttgctgataaagcgcccactccattcatgtgttagaaagggaaatgatcaagttctagggaaggcttaaagacatactagcaccgcgctggaactttcttcctgatgcaaccagaaggactgcaggggaattgactgggaacaacttttcaaatatgagagttgttttacagagtcatgcctatgtgccatggaaatccaccttgtgggcccagtctgggaagccctggccatgctctgctttgatcagatgtgccttgccccatcctgcctgctgaaggcttgctgttgttcaaggctcagtccacaggttttggacatcctcagtggcagctactgtcctaggccctggggatgccactgtcatcttcctgacttcttggagcttgttccatgctgcctgactcctgctttggggatacttgtcaggcagaaccttgttggagtgactaattgggttagctggagtgtggggtcacaaaggcttctgatatggagtggggcctgcttgcctctgtctggactgactgctgggaagtgatggcttgagatgatggagaagagaatttgggatgcatggtgtgtgccaaagaataaatgcaggtgtcctgttgttactccatctgtttctggtttatgtgttcttacctggatgacagctgtgctcatcctctaatcctgtacaataccttgagagcacaggccttttgtgagatcaaatgcctatgcatgacaggcaaataagcaggctcttcaggaccagggaaacgatggcaacagttctgagtctgatgcagggatggcagagaagcccaggcagagtgcaggggcagtgatgtcattccctattgtgaggatcagtgacaccctctagaggcatttagggaactttttttgaacagaaccatgtgtcagacactgtcaagaaggccaataacggtattattgttaaaaacaaaacaaaacaatctacactagacgagggaatatgcacatcagcttttctgagaagctgcagatgttcataagattgttcttctatgttcctgaaggatttttcaaggaactttgaaacctaagtggctgcagctccttccttgcttttgtgggcagatgctcatcctggcctggcgaagggtgggacatcaccctggccaccaggtctcctgagagatcataccctgggatctgcccaggtgttttggcctgtttccattttcatatccaacaaaatgcgttgggaccatggcttcaatcacattacatgctgtgagtttagagtgttggatgctggttttcagaggtgatcaaacctttttttttttcttgtttaagaaacagatagttaagaaagggagattaagttggagttaataagaactctgagaaagaggagaaagaaaaacagcaaaagtttcttctttatctggaaaataacatgctaaatctccgggtcatcttgagaaatcaaagaaatagctaagaaaaaaacagttgcagggtttggcaaaaggggacaccaaccttagatatgaggtcttctgaaaacttttaaaatttgtttattttttgaatcagtagtgtgtatagttaaaatttttaaatggttataaaagttgtcaaagaaaggatgtctttcagctatcctatttttctcccaaaggcaaccacagttccattttcttaacgtgtctttcaaaagcttgtcaataaatatagaaatctgtgtgtgtacctccttttattttatgcaaatagtagtatactgtgtgcacactgtagtaaacttacttttcttttaaaacatccaacagcagaatggaggaacagattttggcaaatcgcacaaaatctagctgtaccagatgaaatacaactcagcaataacaatattatgttattatgatacacacaataacatgaatgacttttgaaagcattaaactgagtaaatgaagccagacacaaaaggctacctactggatgattcatttatatgacgttctggaaaaggccaactaaggagaaagcagattggtggttttcagcggccagggtttgggggaagggctgatgatgattgacttcaaagagggatgagacaactttctggggcgatgaacatattctaagatcgtggttgtagcggttgtatggttgcatttattaaaacttaacagagtgcacacctaaaattagtgaatgttatgtatgtaaattatatctcagtcaaacttattttgttaaaaaaagtttcgtggagattattccatattggtgcatatagagctttcctgttctttttcagtagttctttttcactattccttgatttatttaacctgtccaggtggtcttctatatgtcagttccagactaacctgatctgatgcttgtagactagttatcttagtttgcttctccagaagaggctcctcttctctcccctagatccatagtatcctggctgaggacccctgagagggcagcatggaggggccctggtgctctctaaggtgaccttggacatatgtcctacagaggacaagcctctcagctatagggtgcccaaggaaaatgggagatttttcttgattcctgcagttggctttgtgcccttggcaggctctcctggtctgtaggtagcatagatggcctgaatgtttggtaaggggtgctggaaactagggcaagaaaagaggggaaggttgggatgcatagaactgatgtgtgggaaactaccttcatcatccagctcaggtgtgaagccgctgctcatgcgatatgctctgctcacacagatggcactaaggaaccgggaagctgggctttggagaccacgctggaagtcagctcactgagtgtgggttgccttgaccatctcctctgggaggccatgttgtgcatagctggagaacaaactggggatgaatcaagaagggaaagggtgtggtgaatgttcagcatgggagctgatatctccgatgagcactgtttggccattgatttatttcttgggtgcaatgaagggctcttaatcttctgcatttggacacttgccacagaggacattgtgattagcaaaggaaggcacaaaaattctaatccaaaggctttgcccgccttaagtccttttttgaaatggagctgatttaaatatgtaagtatggtcacagcattgacacttcagtggttatcgtaagcttatttgtacagtatgtgagatgcagtttgtagcaattgctatgggtaaaatttttattttaagaggtgactttctatttacagttattcatttacactgggttcatctattaatatatactgttgatgcccttttaacactggtattctttgaagtcacacatgataatgtgttctgttttattggttttgtctttatatttgagatgtgattataaagatcccttctgcctcaaaccttgaacttagatattcattataagcatgattcccttcaaagtaatcaccttctagtcattcctgttttgaaatttcttccatggtttgtttattcacttttatcatggtccatttttactctaggagttaattcaaattttggaagcagcaagatttctctgcaatcctctctagtagataatagtgtgtttggggaaaagtgaggtataataatacaggaattagtattaaggaatgtagtaattaaactccttttgaaaatgattttaaaagaattcccatgatattcaggtaatagcgataaaagcagctaacactaatcgagcatttagtatgtgctggttactgtgagtcactacatgtgagatagttactgtttttatcctcatcttactgtttcaaagacaaggcatagaggagtgaagggacttgctcacaaccttacagttgacaagtagcagaggtaggatttaaacccgcaagtctggctcctaagacttgggtttaaaccactacattgtaacacccctcataaatacaagctagaactattagtaactagtacttattatatgccagatactcttctacaggctttacatgaagaaagagaggttaagtaacctgactcaggctatgaactagtgagagacttcactgcctcttcataatagagtcctgggaccttctctgtgttaagcatatggcccccagaggtgacagcttttgggggtttatgttctagagcagtgatgtgctgctaatgtttaacaactagctcttggaaagaggggacatgacttttgtagcattttgcaaatttccctggtgtaaatattcttatcatgtctgatttcaagctaccaatgagacatcactgaatgtggagttaggaagagatgcacaatagcacacagttgtttagtatttccaatagctctaaatatctttaagagcatagatgatagtaaagtatggtaaaataattaggaagttatgagtgttgagtatttattacatttatcttaatataatttacttatttttaagtttattcaatttaacttttaataatggctgtgtttaacaaccctggctcataaactttctgaaaatttaacagttggcttttggaaacccactgcagcaagctccagcacacaactgaatatgttgagggtttttttgttgttattgttgtttttaattttagattcacaaggtacaggtgcttgtttgttccatgggtatatcgcatactggtgagtattgggcttctagcatgtttgttaataagttggtcatatcactcaagtcatgcctgatacacagatgtttgattatcagagtcttttttctttcttgtttcctgtggctttttaagttgatgaataataggaaagtaaatttgtggggtcagttaaaccaccagacgacagcttttatgtttgtacattggttcagaggtactctgtattttgactggatttattggatagtgtaattgtttccatttaaaacaatggaaaagatttcatttaaatttattgagatcttatttttcaccctcattccgtgcacatttgggattctgttcgccagcccctctgcactctgaagatgcacagcagcctctctgtactctgaagacgcatgaattgctgactgttgggcttgcttggaggggactgggggttattacctcccacaggactgtttaagctctggaagttttcctacctcctgcaactgaatttagtcttaattagtacagagtgaactagctgtgaacaatctggttttcttgctttgtgccttgatcatgtgagacctaagggctggtcctgcccttttcttatccattgctttaatcagaaataacatatcaaggtggcccaaattgtgtcactattctttcctttgtcttctccacccattcccacggcatccattcctaaggtcatttggagaattctctgttccaataagtgggatccacatggctcaaggagcaacaggccttggaatcactctttgagtagtagctggtccctcagtctaccccaaagagctgcctcgccagacctccccacctcccggacatacagactccagatgtggaaaaagcccttgccatctctatcctccaacacagagctttggtgtccgagacacatccaagtgacaggcccaagagggcctctgaatgaagacggatgagccgtgtggacacagccacactatgttttcgtgaaggcataagaccatgggccaactttctgggcatccagggctggctgcagaggctggagtgagtggctttcaaggcaagactgataatgaaagtcgtgtttgggtgggaatcacaagcaggggaagtgggggagccagcttcccttcgtgctgtgtgtcacaataagataggacacagatgcaaaagcagatcgctacagctggatctgggtaaaggtggcagtgacgcgtcggtgcagagaattcctgttttgaggaaagattcggagccagctaaggttttctgagggcccgtcatgtctcagactgtcacacttattcctctgtcatgtatgcttaagtctgttttagatgaccccttgtaaagaaaggaagcctggcccctgaagcctcattgcgtgggataaggggactaacatattctgtggttgtaccagcaaattattatttatttcttattttataaaagtatagattttattcatgcctatattgttagagaaaatcattatttttagtcaacgtattagtattaatatcatggcctcttttcttctcattttggaaggggaatatttttagactctttaatgagagagtcattttctcagtaaatatttgattggcctgaagttaagtgggtaggcgtaaaaaattatggaagtattggacttgagcaaacttttgacaaatagcgctctctttctctcttgggcgtatgcgtgtgtgcatgcatgtactccagctctctgtgtatgttacacacacacacgtttttcgcataaaacatttttattttgggccaggtgtggtggctcacgcctgtaatcccagcactttgggatgctgaggcaggcagaccatctgaggtcgggagttcaagaccagcctggccaacatggtgaaaccccgtttctactaaaattacaaaaattagctgggcatggtggtgggtgcctgtaatcccagctactctggaggctgagacaggagaattgtttgaatctggtaggcggaggttgcagtgagccaagattgtgccactgcactccagcctaggagaccgagcaagactccatctaaaaaaaaaaaaaaaaaatctttattttgaaataatagcagtcttacaaaaaagtcattaggatagcacaaagaaataccgtaaattcttcacccagattccctaaatgtcatttgctttgtaattttctatctattcgtacttcttacctgtttgagagtaagtcggagacgcgatgcccccttatccctaacatcagggatatttcctgagaacaaggacattcttttacgtaaccatagcacaattattgaaataaggaaattaagtgatacattactgttagcttatctgcagaactcactcaaatatcaccagttatcttcatgtccttggtagcaaaagaaaatcccgcactattgcatttggctgtcacatctctttagtctggaaaagtcactcagccttgctccttcatgtccttgacatttttgaagagtacaggtcagtttgtctgtttcatcatgattagattcaggatgtatattttctgcaggaataccacagaatacttgtgtcctatatatttaaaaacatatacatccaacatcactgaaggtatgtatttttaactcctcctttaaagtggttttccaaagttagttgccatccccaaaagggagcttttagacattgagagaggtgattatgaaagtacgatagcttgctcaccacctctctcctctgctcctgggagcacaggggagtttcaactctggggaaggtgatcatttgggtcattagtagcgctttgagtaccatggtgtctgcagggagttcccagttcttactgctgtctgagaataaaacataatatctttggtcttcacagaggtatcagacaggaattccactcagcttgcaggaattgagaccccaggacaggggcttaagcacatcaagataatttctctctcttctagaggaagagaagttgctgatgttggttcagtgactcgaggatgttctctgacctttcacttattcaggaaatgtgcattgcatacctattatgccgtaggctggggggccctcagctctgctgtgaagagacaaggatccttgtccccctgggagtttatatcccagtagggggagacagacaatagatataataagaagaaaattaaggtgcattagaaggcgatgaggctatggaaaaaaagaaagaaaatagagcccagtgaagcgggtttgggagtgcaggcatggggttatgggggtcagggtgacctcactgacgaggtgtgatttgagcaaagcatggaaggaggctggggagttagcacagcgggttcctggaggagggctcagaccagtgtctgagtgtctggtgtgtctgaggaggagcagggagaccagtgtgggcaaagaggtcagagtggcagtgatggttgtgagcgggtcatcttgggcttcctaggccttgggaaggatttgcctttactcagagggggatgggagtgtgtgagggatctgggcagggtggtgacctggcctgccttccatttttacaggcccctgctggcggctatgttgggaaggcctgtaggaggcggtagagcagcaggaacggggttaggagactgagcgttacccagggaagagggtggctccactggggccatagtggtaacattgtgagaagtggtcaaattctgcgtgcattttgaagggggatcctacagcatttcctgagggtttgattgtcagttgtgagggaataagatatcaagggtcactccaagcttttcagcctgagtacctaaaaggatggagttgtcactggtggtgttttcaacggaaggtgcaggtgagcaggttgaaagggggaagatctggagtttgtttttagacacactggtagatgtttaagtgtgtatgcgtatgtatgagtcttcagtttgagtagtagtctgagtaagaagtatcaatttgggagtcgccagcagacagatggtatttaatgccaggagatttgatgagatcacccagggtgtgaggggagatagagaagagagggggaccaagggctgagctgtggacactccaacactaagagcatcttttcctcctacccctaaaatggctctggggctccagccattgtatgtgtttttcatgcaggaagaagtgggacatgcaaaggggctctttataatctggtctgaggcccctgtaaagagcctccagtgacttctgcttataacgcattgaccatccatattttaaaagaggttggaagatgtctaagtaccagctagacatcttataaatcctatcactatagagttttgctctccagcagaactttctgtgatgaaggaaatgttccgtatcagcactgtccaatatggtggccagtgaccacatatgactgtgagcacttaaaatgtggctagtgccaataaggcattgactttttacttttctatacttttaattaatataaattcaaactgaaataacacatgtggctagtggctaccatgttggacagtgcagatattgaagtttgatttttaagaaggagagggacagacactggacagacaactcacagctcctgccacagtacagcatggagcctcccaaggcactagtcacacagatcaagccacacagccaaatggaaatacaaataatagattgaggtcacattgactgtttcacgttgtacttagacatgctgattaaaacctgagttgcaagtgtgccatggaacataatctctccctctagtgttttggaacaatcacacacaaatgtttatatccacatacaggccccatatacaatgggggaaacagaacagaagaaggttggatggttcaccaagttgagtgggtccttcaaaggatgtcaccatcttggatgtgatgttttctgttttcagtggcatagaactagataaaaggtggcagtgcagaggatggaagtggtattgctcagtgggaaagggaaggcattttaggtttgagacatattacaatattgccttttagcgtagaaaagccctccttcctgatgctcttgctagtgctgggtggaaagattccctttcaactcaacatgtgtgaagcacatgaactgaagcactcttcctgcttagcatggcaggggctgggccaggccagggtggaccaggtcttgctctgatcaaccacatggtctcaggcaagttgcttcacctttactgctgagcttcagtgtcctcagctgaaatggggagcagaatactgacttcttagtaggggtctggtaaacactgggccccttttcccttctgctctaccctgcaaatcttttcctctttctaactgcctctgcatttggaaggggtcaagactcgtttcatagttttttgggggattaaaaaatgattagaagcagatggtgagaagaaaatagaaagtatggagcaaataagaaatgtgggaagagaagagggcaaatggtaaggcagctctcggagctggcacgttctttctctctggaccagagcaagccagagcctctcagtcatcttcacgggctggttgacaaggactcctcacgttagcgtgcacacgaagaacctgggaccttgttcaatgcagatcctgatacagcagatctgaggtgaatttctagcaagctccctggtgacgctggtgctgctggtccatagaccacaaagcaaggagctcgaagacatagataccaaaagttacaggggaaaacggacaaagccaccagctggcagttgatgcaggtatcagaagcaagtgggcctcggaggggccagatgcctctctcctcacactgaccgtgagagcgagtgctcctcatcaacaacgtggggccaggcttgagtcagcagcactgactttatgtgacctagtgcagctcgccagcccacgctgatgtgtgttaatggagggggtgccccttataggagggtggtgtgggctataatttcttctgcattctctgcctattgcttgaaggacagtgttgtcagcagtcaactgactgagcttgacttttcagcagtttttttaaacttcactgcagtgtttttggacacagctatgtcagaaatctatttccccttctcagagaccaggaagctcttgaggtacaagctcttattaagcagaaaattttaaagtggttttccttctccttttcttgggtctgctttcttggggcaaacagaatacgagaagccagcttagaaattgcatgggtccttcctgcattttgtgagaaaatggtggcctcctatatttcttccctgacaggttactgtgggccaccagcctccttggtgacttctgttttgcagatggggaatttgttgattgtagtgagtacgctgtgtgcggcagaaaggattctgtcacctacagagagctagggaagcgcccaggctgaggaaacccaccccttcgaagcagccatccataggtagcctgggggtcttttcacaagacagccctagccccagttcatgggagttggaacaatggtgggtccaatggtggatgaatagtttattcacatgcatcccaggagatttgtgtgaagagggtgacagagagttgcttcttttaaaaaaaatgtattaagggctatgtaaataaaaagaagaaattaagttgtaacagtaacaataatagctatcttttattgagcatttactatatgctacatgttttacatgtacatgaagtccttataaagaatacaattacatatgttaatatgtgattatatacagaaaattgtatcagaattatatctacatatataaaaataaaataaaatctcattttaccattgagggatctgagatttagagcatttaatttatttaagatctcacagctggtaagcagccaagtcttgggtttgaatcccatccagcaaccaactagttctatgactttgaatgcaaaagatgatggcttttctcattattattacctagttagtctgagaaagagaaaactccattctggatggcccatttctgggtggattggtgctaggtttctcctggtcttggacgaggttgcacttttcagccgctcctgtgcacgtgtgtccgtgctctgaggtgggaggaaagctcaatgtgggtctgtgagtccagggcaggcaggagtcctggggactggaggttctctgcacttctgtttgatcttccctgcctgtctgtggcctctgcagtttaaacaatgactgtcacttaaacctcttctgaagagcttgaagtctggtccatgccttcagcccaccagcgtgtgttgagtacctgttgggtacacagctctgtgtctggtggaggggaaacaaagattaaaaagactgggccctgtcctccaacagctcaggttatttcatgcctgcattcggggcactgtcttacttggcctagtcccacacttgtccctcccaccccttgcttctctattttcaattcacttctgtttctacacacatcagtgatgcagtgtcctatgtacaggtgtgcctgggacagtcctggtttatgcctgttgtcccagcataatcattaatagttctctatttcactctcaagtgttccgatttggatggcaccctatttattgagtgctcattgtgtgccagacactgtgctgggcccggggcagatggagactcgtaagccataaccgctgcctcccaggagctagtctgctggggcatccgttctgaataccatgacttggcaagtgaagcattcccatgccttccagactcctggctctgcctgtgtgaaacgtactccatttccagagccagctgccgagctttttcccctgggctgactttccaccaccctgacctgcgattcctctctgctaaccctcctctcaccgttctccccagggtgggctgtgggccttctggtgctgagctccctcacatctgagctgtcttagcaccttctttccgcctgtatttgtgttacttggatatttgtgttttatcttctgtaccagagcataggttattttaaagcagggagcttatggcattcaacactgtcaccctgggaataggacccccaaaacactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgagcacacacacacacacacatatacaccccataaccattttgaggtcatttaataagggattgctttctggataatctcgctccttgggtataaatctaatgtgaaagggcaggggtcagatatttaccccaaagggttggtgtgaggataaaatgaggcattgcttttaaagtgctaagctcagcccactgaaaaatacgcaaatgcatcagaagagtcctctgtaaatccactgagctggaatttccaagcaggtgtccttgctgcctcttgttagccttttgtgagttaattctttgtttaataacaaagagctgccagatggtaattttggaggctcagatacactctgttgcacgtgcctgtccagcttacttaaaatatgtcagaaagaatgagggaatgactcaaacaatttcaggaaatggttcaaggctgtgtaacctttaaggaaaaccacacggagccattaccttgtgttgaaaggcagctccctggctccctgggaggcctggtggcaagcagtgagacacttgatttaggtgaaggggggccccaaggcagtggtgcctcccttccttctgcccagaattgaggtgttgtccctacagtggaaactcaagagcagcactgtctgatagaaatataatgtggtcacatctgtaattgtaaatttccttttttttaaaattatgctttaacttctagggtacatgtgcacaacgtgcaggtttgttacataggtatacatgtgccatgttggcttgctgcagccatcaactcatcatttacattaggtatttctcctaatgctatccctcccccagcccgccaccccccgacaggccccggtgtgtgatgttccctgccctgtgtccaagtgatgtcattgttcaagtcccacctatgagtgagaacatgtagtgtttggttttctgtccttctgatggtttgctgagaatgatggtttccagcttcatccgtgtccctgcaaaggacatgaactcatccttttttatggctgcatagtattccatggtgtatatgtcccgcattttcttaatccagtctatcattgatggacatttggattggttccaagtctttgctattgtgaagagtgctccaataaacatatgtgtgcatgtgtctttatagtagcatgatttataatcctttgggtatatacccagtaatggaattgctggatcaaatggtgattctagttctaggtccttgaggaattgccacactgtcttccacaatggttgaacgaatttacactcccgccaacagtgtaaaagtgttcctatttctccacatcctctccagcatctgttgtttcctgactttttaatgatcaccattctaactggcatgagatggtatctcattgtggttttgatttgcatttctctgatgaccggtgatgatgagcatttttttttctagtagccacattgaaaaagttaaacaggtaaaactaatttcaataacatatatcagtttgctagagctgccataatgaagaccacagacttgtggtttatatgaacagaaatgtatttgcccacagttctggaggttggaagtccaggatcaggtgtccacaggtttggtttctcctgaggcctctcttcttggcttgtagatgactgccttttccctgtgtccccgcatggtctttcctctgtactcatatctctggggtttctgtgtgtccacatttcctcctattctaaggactccggtcagattggattagggcacaccctgagggcctcgttttaatttaatcaacccctttaaaggcccagtctccaaatacagccccattctgaggtactgggagttaggactttaacacaggaattttgggggaacacagttcagcgcataaaaatgtatattatttagtccaatatagccaaaatgttattatttcaacataaaatcaataaaatgttaatgaaatatttgccttctttcctgtactagggctttgaagtctggtgtgaatattagccccattttatgatctcattaggcacacgtgggtagtggtgaccgtatcagacagtgcaggtctagtgtcgaacctcctaatctcttgggagaccttgggattgtcgtaaggaggcctgagtgaattcataaaacatatgcagttcctgaatcaactaataagtaaaagtataccttttatcacctgaggttctggtaaatattttggtattataaaggttgctttcacacttacaaaagttaagaagcatggttctgactttcctaaactggggtttctagagcccaagctccattagcatggtgatgacggcctgcaaaatctttccagcatttcagaaagcctggtgggatcacaggggttgccattcagctactgacaaggtcagcatcattgctttcagctggcgttttagtacagtttttctggtgaccttgtgctgatcaaactttccgcgtggctttttatgacactgtaacaattactggggtcatgcctggagaggtggcccacagttcatgcacaggctcgagtacaagccttccggggactcatctctcagccctgttattattctcagggatttggagggtgcagaggtagatgaagtaagcaagcactattgtgcttcctgtgttgaagtcagggaataagaatttcctctgtgccacaaataatgctccccacctgtatagaatgcctgggaaatgcaacactggccatccttcagctcttctgcttacagctgttgtgctggtgggtctcctcctattctcagagcagagagccacgaatggggcactcggggccgtgacaggcatcccttagctctggccttctggttgtgggcagactctgctgtgtccggcagcccatccagcgttggatggcatcagcaacctgaaagccctttcttaggctgaaccagagtctacctccatgtaatcacacactcccctcctatttctgccccggagcacctacagatatctgtctgtctgtccccatccccactgcctacttcctccagactcagcatcctgagttcctttgggttactagttcattttggaacttattccactattgaattatccgtattctttggttttatacctttattcctctttagttgaccttttagatacttttctaaccatgccccctccccgctgccccgaaagatcagggaaaataagaagaaattcaaacccttgttttgctcctcatcagcgacagtggtagggaagatgcccacggcacggaggttcagtggttgttttcattctttcctgttagccagtttcctcaaattggtcagtataatcctacctcttggagcgatagctggctggattcttctgccattttggcagttatatattggtctggatttaaaagtgatgtttattccatagctctcctgaatctgacatttgttcctctttcatcctatacttccctgggcatgatacccttctttccatcagctgtgttggagaaatgtggcatgtggcagatgtatccttgcttgtttaattaatgagccaaacagtccagaaacttaggttacaaccaaggtagtctggcaagaaatatacatgaattcaaagaggtttgggataattttattaatgataaaaccataaagaactcagaaaatattttaagatgcttggcatcaggaactatttcatttgtctccatatccccagcaccacgcagagtaattgacattgactaattgcccaataaatgttcactgaatgttaggagaagctggagtatttccaaaatgaacatatgctcaagatattctactagaagtttacaatgttatcttttacatttagattagtgatccattttgagttaatttttgtgtgttgtccaggatagtttcaaacagttgtgcaaaacaattctgtttgttggttatcatgggtagactaatacctgtcagatcatataacccgacagtcagctggaaacacttggtcacatgagattgcctatctacattttaaatttggcttcagagggagcagccagcaactcccttcaaccccctaaattttggattgtcctaatgaaatcttggactgaagcagtacatttttaaccaggctttctcaggagatttggttcggctggcactcagcccacactttgcttaactctgagcaaaggtgtccgtgggtggataatcccacctccccattctggatgtgccagcacttttcctactcatccccagttatggaatgtctaattctttctcattttctcctgtcactaccatgctgcagtgagcatcttgggtcacctaactattaattctggaggacagattccagccgtggctttgctgggtcaatgttacagccatttatgtcccctcagatgttgggttggtcctggatgctgccctgtaactccatcacacccatctgaagtcctgcctggtaggcagcagacactgggtgtggcttggtttctcatacctttttatttcagtccctggtgtttttgtcatcttgtgtggcagtggcagtgctccagctgatcatttttatgggacagtccttccttgatgagacccagatccctgtcacttgacaacataaagaatattattcttcataccagcatttcccaaagcattttttcaaaggatagtaacgacttttatgtcaaaaaacaaaacaaaattttgaattcaaattaattttggaacataattgaatttaacgcaggctttttattgcaggacttcatggagctttagaagcccaggcacgcaaggaggatgcactgtttggcatttcctaaatgtacttgaccacggaacaccatttttctcctgaggtttaggaaatggtgctatgatatagattagttttctatgaataacttggctttatgccttcatataccttttctctctactcatgtagaaactcttcttcagcttcatgttttaataatggaagaacttagtgatgtttcatatgtagagatttttctctaggtccttctcatcgataagacctgtttcaagatatggcaagccctagttctgatctctggggtcctcaccatttatagacttccattagtcctgttgtgacttaattgttttgttatatttttggtggcctcctacactatggaagactttctgaaagcccatatctcatgctaaatttagctggatttttaacagccttgattgattgctggtcttaatggaagaaaatgtgatcctttctcttcctcccttgtcattaaattattactaatctatgaccagaggaagcagccactgcatacgtgggtgtatttttaaaaattgtgacacatcatcaagatggatatacttgcccctttaattcaacaggcacctgttgaatgcctgtgcatgcaaacatgatgctgggctgagccctggggcttcccctgaagagctttggagcccacagcagaactcccagccaggctcatccaccactacagccacaaccatccctacctggagaaaggggctaaaagaagcccatgggattaacagacattctgaaacaccaacccttaggaaaggagtagaaatgggagttgggattaaaagcagaggtgaggttaaagggtttgaacaaaatgggcctgatcttgggcttctgaagtcctgtatagtgtaagtgctgacctgagggcctgtggctctcctgtagtgagggaggatccaactggagtatgacttccacctctgcatggccagcctggtgacgtgaagcacatttcttatgtcaggttcccagtttcctcttctgtaaaatggaggcagcatgggattgtaatgaggattaatggagctcatttacctgaacgccccagagggtgcttagcaaatactttatgcttcttgtgggtccattactttcccttgcctgtttttttagggaccctggagtgttaccttggcttctgattaaaagctaggttggcagatgcaagcacacatgcctcctatagtgttgtcctagactggggtggtgttagtggtcaggcaaataattgatcactctgtgttctcaagacaagcaatgggtaagaagacaaggccacggaggtcaaagatacagaaagataattgccatatatgctatgcagccagtgcccctacctcatgtgattgtagagtggttcttacactagggtggcatagaatcacctgaagggcttgtttaaacagatcatgggtggtgggtacagcatttcaggtgcggaagatgaaaggttctggaggtggatggtggtgatggttgcagaataatgaaaatgtacttaatgccatagaactggacacttgaaaatggtgaaagtgatacatcttatattgctctccctgccccatcacaaatagattgctaggctcactccttatagattctgattctgtacctctgaggtggaccttaagagtctgcatttgtaacattcccacgtgatgctgctggtctagggaccccagtgtggaacccttgctgactgggttgggagtgacgttgggaactgtttcgccagaaatactggggacccttgagtggtaatggaattggttgtatattttagtatgatagttcttatagatgataaagacctcagaaaaatctcactatgtccatgcccaagagttccaccatgagcacatgccttgagggcagtgaccctggctcctattgtctctgtctctctatatctataacttttaatcttgaaatagtttaagattcataagaagttataactcataagaagttttaactcataaaaagtcaaaatagtacaatagtccccccttatccattgggaatacattctaagacccctagtagatgcctgaaactgtgggtagtcctgaaccctttatctgctgttttttcaatctgataactgagacagctagtaagggattaatgggtagtagtgtaatagcatggatgtgccggacaaaggtgtgattcccatcctgggcagtatggcatgagatttcatcacactactcagaatagcatgcagtttaaaacttgtgaggatgaggggaactactctatggaaagattcaggtaccctttacccggcttttcccaatgataacatcttacatatacatagtacattatcaaaagtaggaaactgttattggtttaatactatacattcttttaaaagagtgctcaactcaagattaggaatctatttttcaactaccattagccccactttggcaaggccaggtgggataagtgctggggctcctatggtgggtgtgctgcagtcttcagcagagcttggctacagaggagaaagatctaaactggaccaatttcatatggtcattgcctctggcttgtggctgatcatcttgttctttggaattgactgtctcatgaaatagtgagtttcttgtcaccagagagatttaagcaagagccatggaatccctgtccccagcactgagaaggaacatgaaccatgtattccctgaatgtcttattccttaaaaatcctgtgattctatcaattgttttgttagagtttgtggctgacattgattacactatgagtcatgtgacattccatgttgatgtagttgccaaaatgctcgccttcctgggttctgctttcattagtttgagagaggagctgagccacagaaaaggggctggagtctgctagattaatgaagatttgggatgtgtagtctgttttcacactgctgataaagacatacccgagattgggtaaattataaagaacaagaggtttaatgaacgcacagttccacatgactggggaagccttgcaatcatagcagaaagcgaaaggcacgtcttacatggatggtggcaggcaaagagagagaacttgtgcaggggaactcctctttataaaaccatcagatctcatgagacttactcactatcatgagaactgcatgggaaagacccatccccatgattcaactacctcccactgggtccctcccatgacagtgagaattgtggtagctacaattcaagatgagatttgggtggggacacagccaagccatatcattccgccccggccccttccaaatatcatctcatcacattccaaaaccaatcatgccttcccaacagtcccccaaagtcttaactcatttcagcattaactcaaaagtccacagtccaaagtctcatatgagacaaggcaagtcccttccacctatgagcttttaaaattaaaagcaagttagttacttcctagatacaatgggggtataggcataaggtaaatacactcattccaaatgggaaaaattggtcaaaactaaaggctaaatgcccccatgcaagtccaaaacccagcggggaagtcaaatcttaaagctccaaaatgatctccttttacttcatgtctcacatctgggtcatgctgatgcaaaagataggctcccatggacttgggcagctctgcgtctgtggctttgcagggtatagcaccccacctggctgctttcactggctggcattgagtatctgtggcttttccaggttcatggcacaagcagttggtggatctaccattctagggtctggaggatgggggccgtcttctcacagctccactaggcagtgccccagcaggagttctgtgtggaggctctgaccccacatttcccttccacactgtcctagcagaggttctttatgagggcccccgtgagggccccactcctgcagcagatttctgcctgggcatccaggcatttccatgcatcctctgaaatctaggcagaggttcccaaaccttaattcttgactttgtgcaagctgccaaggcttggggcttgtgccctctgaagcaacagctcaagctgtaccttggccccttttagccatggctggagtggctgggacacagggcaccaagtccctaggctgcacagagcagggggaccccaggcctggcccatgaaaccattttttcctcctaggcctccaggcctgtgataggaggggctgccatgaagacttctgacatcccctggagacattttccccattgtcatggcgattaacatttggctcctcagtacttatgcaaatttttgcagccagcttgaatttctcctcagaaaatggatttttcttttctatcgcattgtcaggccacaaattttccaaactttaatattctgttttctttttaaaactgaatgaatttaacagcacccaagtcacatcttgaatgctttgctgcttagaaatttcttccaccagataccctaagtcatctccctcaagttcaaagttccacaaacctctagagcaggggcaaaatgccaccagtctctttgctaaaacagcaagaatcacctttactccagttcccaacaaattcctcatctccctctgagaccacctcagcctagatttcgttgtccctattattatcagcattttggtcaaagccattcaacaagtctctaggaagttccaaactttctcacatttcctgtcttcttctgaaccctccaaactgttccaacctctgcctgttacccaatttcaaagtcgcttccacattttcagatatcttcacagcaatagccccctcctggtaccaatttactgtattagtccgttttcacactgctgataaagacaacaataccccactcctggtaccaatttactgtattagtccatttttacactgctgatagacactgagactgggtaaattacacagaaaaagaggtttaatggactcacagttccatgtggctggggaggcctcacaatcatggtagaaagcaaagacatgtcttacatgggtggcagcaggcaagagagagaacttgtgctggggaactcctcattataaaaccattagatcacatgagacttattcactttcatgaagacagcacaggaaatacctgtccccatgattcagttacctcccactgggtccttcccatgatagtgagaattgtggaagctacaattcaagatgagatttggatggggacacagccaaaccatatcatgggggtagagttgagggaaggagagaacattccagggataggaaatagcacatgcaaaggtcctgtggcatggcctttatgtgtaaaggagatattgataaaccttggtatgaaagactgtaggtctctgggtgcaaagtaatggctgagcatgaagctgaattagacttggccactagcttactttgctgttgacagaatgttggtacagattgagcatccttaatctgaaaatctgaaatctgaaatgtcccaaaatctgaaactttttgagtgctgacatgacaccacaagtggaaattctacaccttacctcatgtgatgagtcacagttaaaacttttatttcatgccccaaattatttcaaatattgtataaagttacctttataggtcatgtgtagaaggtgtatataaacataaatgaatatgaagtttagcctttagtcccatcctcaaagtatctctttattatatggagatatttcaaaatctgaaaaaatccaaaatctgaaagacttctggtcccttatatttcaattaagggatatgcaacgtgtacttctgcagctgccttgagaatgcatatcattgaataatgttagtgggaggttttaaactatctgaagatcacacaactgtgagagcccagctcccctgaaatgcgtagggttggtcagtgattttgctatgcgccaaagcagctgccttgatccctcagagccccggcatttctgcccggggtttggccacccctggccttggctgacttctcatggatgcagcaaaaacccagtaggatgcacctctcaagtggttggcagcttttactggacagctttagagtcctgtgggttattctggttgttgctattcttaaatattgagtgtccaaaagattcgtgaactgcatctcagctgggtgggaccctttgggacaggagtaggggaataatgccgtcgttaactgcaaagaggagttttgggaccaggttgtcttataggtttattttgaacaactgataggcttggtattgctggaagtggatagatttgggttgcctgtgtctagcaggtggcttccttttccagtatgttgcccactggtctcatctatcagactcacttgagagtatttcattattcatctaataaaggagtatgtgagattcccagaggaggaggatctacttctgtacttgacctgggtgaggaccactgggaacatttgcacctttcaccattgcaaactttgacatgtgagagtttccagaaatacagagattcttattttaatcctttttctttttaactgcagaagggaaataataatgggatagaataactgcagggagtagagagatgagaaaacattagaaaaaatagtacagaagtagagctggatgagaatccaagttatgagaacctattgatgagaggcatgcagaaataaaaagcccaaattcagtgatctaaatcagggctcagatgaggctgtttgtattgcacggtaggaatatatccagaaacagtgggccttttataaattaagcctgccattctccaattgcttaagacactgaggcccatcaggccagaaacatatgacccactttttctgagaaggaactttccctttaggagtggtaatttagaagaaaagaacaagcccaatgaatagtcccttatgggaggcatctcagcagaggccctttttgggggcaggagggattgcatagcaatactgcctacccagagttgttgttcccaggctagggtccaactcagggcagggagatctactggaggcagcgtatcacacactagttgtccaagagatggagagagagtgcaaaatctgagctgtgcttatgggaagctcggagtctcacaaaactacacccatgctgcccatggtttatgtttaatgaatgaaatgatgattaagataggacaattggacaaaaaggctgggccttcttaggtgggtattgagtgggaagtgattcaagaggccagacattctgtctggacattagctggaagtggggctggacaagatgaactagagccctcttgtggtcccatcattcaggcctgtagctttcatttgagaccagtggttcttaaacttttgcagggatcagaatcacctggaggacttgctaaagcacaaattgctgggccccaccccagcgtttctgattcagtgggtctggggttgggactaggagtgcatttcaaagcactttctggagatattgatgctgctggtcctgggaccacactctgagatacagtaatctagaccatgaaggaggtctggatcctggggagggaatccgctttctgctttcttaggcactaggaaggcaaggagatacttggggctggaaggtggcaggggagcatggaagggaggagtccttgtccatcgtgtctcaccatctgaggagctgtcatcctttattcatcctgcccttctgcttgccctcagtctcagaaattccaaaagacagcttatgaccctgcatttttggttaaagaaaggagggaactgaactgtctgctctatgaattctgggctagtggggatcatggggattttgtaaattattttggtagcccgttgagttttgtctcaggatttcagcggaatccaaaccatgtgacatggaccattatcattcagctgccacctcctggatcctgccctgtaaacatgcccaggggtctctgaggatggacgcgtgtcattcacacaccaagtgtgttagagacaacagaaaaccttgtttttttcctgtgttctggtgaaagtcttttctgtctttccctttgtttcttcgagggagcttgagtggcaggattattattaagagtactttttaagttcccaacaattagataggaaatgaactgaatgggagttcacattttatcttcaggaaaatgaccgcaagaaggccttactgtggggtggttaagagcatggcctggctttggaatgcctggattgggaatccttgttttgtcacatcatcgctgtgtgatcctaagccagtgatgtgacctccctgcacttcaatttcctcacctctaaagttgggataatactacaacttatttagtaggattgctgtaaggaccaaataagataatatagctcatgcagttagaattggacctgtcacttacagatagaaggcaatacattttagttcttactgtaagactgagacatccaaagacgtctcatactgtaatgtgtgatatttatgtatatgctttttaaggactacaatccttagtttcctacctactcaaggttatgttttgtagatgctaacagtgtacattctagagaaaatcagctggagggaggaaaatggtacagttctaaaattctttaagcctcgtttaattttttacctgttactgctttcatcatcacctctcactctcattttctaataagcctgaaaagcatgatggagtcataaatcatgtctgtaaaatgaagatgtgtagactttggtaagatctcacatgtgatgttaataacaataccttacatatctggcctcacacttcacttaaactgtcccatttaatccctgaagtggtctcattagcttctgttagtcccattttacagtttgtacagtggagacttcagagaagaacctggcccaggctccacaggcagttaatgacagagctgggatttttttttgtggaggaataggggagacttttctggtaaagaccagaaaacctgctagacaaattctaaaagagccataacactcagagcggggattttaacttcatcttctgcttcagggaccacattgttcccagtgtgtttaaacacctggctggtttttcacttggggttctcattcagattcgtgattctgtttactgagagatgatgtcccagttactctagctctgtaacaaatgactccaaaacttggggctgtgaaataatcattttattttgctcatggattctgtgggttattcagactcagtgttccatgatatttggggcctcagcaggggtgattcaaccacaggagctagagtcccctggggtgtctttgcccacgtgtcccacaggtgcatggttaggacagggacctcagatgggctgtcatccagaacacctacgtgtggcctctcaatgtggtctttctgcctgggctgacttgggtttcctcagagcatggcaacctgattcctagtgagatttccgagagagtgcggttgtctggcacttctgtgatctggcaatagcttcaaggaaggaaatatatttttacattgaaagaagagaatatgagccatgtgtgccaggtacggggagccacctgtgaagatcctgagtagaggcttaggtcactgtggacacagtggcagcagtggacaaggacaagggatgccgggtcatgcattcaccccacaaatattccatctatctctgaactaggcagaatgagcagggcaccaatctaatggctcttctggataatcacttcacatgggaatcctaggactccatattatattcttatcctgttgaaaatttgaccttttaaagatttatttatatttagctcaggccttaaaaattccatgtactatctaaaaagggaaaagttcatcccagtcaatgtcctgtcttgcttatgtttaagttggataggaagaaaaaaatccacaccaggagaagattggttgtaaaagtttattttacatttatgtgaagtttatttttggttctgatattcttcatagggtagatatttcttttaagactgttaatagtgtatttcctttttatttgccactccccaccaaaataaaccctcttttatttttgaatcagcttcatatcttcagaacgtccaactttaaataatggttggagaagctccaggttaagtagagagtaaaatcctattgctttctgacctttgggttaggatcaagtgtggtgtaataaaatatcagtcccaagagtcacctttgctgatttttttcctattattctttcctgttattccatattcatgcaggtcttgcagccaaggattgttacattaagatccaatctgaaattaaaacttatggttttaaccaataagctataaagctgttgaactcccactgggatgtagttaccttttcctaaacttcctgcattgtctccttttagccccacagttgatttcttattgagcctttggaaagttccttgccgtttcacagccatttcccgtcagagtggggaatattgactgtgcaaaccacttaaggtcacaggcaccacagctgtgtttcttctttgcagaaggggggtttctttgggtggggctgtgctcagcccttccgggtggtgaaggtctgaggtcacactgggagagcaggtccatatcgggattggggctccagcaggatcagaatgacttcacccagacttctggacctggaactcattctcagaaccttccagaagaccctgccctggaattgctttcaagggtctttttcatctgtgtacagagtatatttccttggaggcagctttgctgaaggccccttgagtcaagggtaatagggtgggagcagctatacacagttgcatttcagtgtttgatgataaaatggtgtccgttggtgagcatcttggtggtgaggaagtttatacgaccacagatgcttctcaccccaaggtacccgtgccctgtgctgctggtgccactcatcctagggcattcctgcttggcagtagcagattctagattgtcctgtttgctggtttgggggctgcaggggtctgcagagtgccgcaaggaggaggagtcccagatcactggttgaccttcagcgggcatttaacagcatattccatcaggcctcacctactagtgttttgttgaggctgctgtgtaactttgactttctctgctgtctcctatttaagagtaaataaaggtagtgacagtcacaaaaatagcatcaatgatgacaactagcgtttactgagtgctgactatacccaggcaccattctaacctctttacccaagttgtctctgctagtcctcaccacagccctgggaagtgtgtgctgtcatatacccatgaagaaactgaggccaagaaaggaaagcagctctgcccaaggtgttataagcagagagcaccgagacaggacccaagcccaatttgtgttgactggggaatcagtactcagttctcttagtctttggctgttttgttgagtgcccaggtcatcctggtagaagggagacagtgacccacgtgaaaaaggatggctacagatgcatggctgcatggctgtgcgtcatccaccctggagtatctgcttgccaaaaatagggctacctgcaaaatgctttgagcactgtggaaaccagccgttacaactccaaacgtttatttttctgataataggtcaaggttttcataattgagttttaggggggctaattttagactttctgaaaatcagtctcaagaaacaaaacccagagtcaagtaaaaggatgcttttggaactgatgattctcagaagaagccatgaagggctcggccataaccccgggaaagctcactggccagcagcctggagccagtggagcttcaggtggctttaattcttccctggatgctggtggtctccagagacacaggggtaaacaggtcagcgtccttgtcctcaagggcgtcatcctccagggaggacatagctggtaatgacaaaatgtgggccagcgccttcttgcagctgggcacacagggctaggggaactgagaggagaaaaggatgaatttggccttggcttggagcagccttttaacagaaacacgcgtaactttcctgcagatgcacttcctgtgaatgaagagtcttgatatatatttttctttaacaagagaaagccaggcttttgattaataatttatatgtcaatgttgggatcttcattttgttatgagagatttcagttacaacagtgtgaggtgggtggtcaggaaacattccccctgggctcactttttgcttagaaaagtcctgatggagaggttgaggtgggaagagagtgagggggaagactccatggagcatgacaggcatgctgtgcctgccacagccaagcatggaggtcccaaccataatgtgtttttgagacaggatctggctctatcgcccaggctggaatgcagtggtgcaatcttggctcactgcaacctccgcctcccagctcaagccatcctccctcagcctcccgagtacctgggactacaggcgcaccaccaccatgcctgcctaattttttgcattttttgcagaggcaggggtttcgccatgttgctcaggctggtgtcgaactcaagtgatccacctacctcggcctcccaaagtgctgggattacaggcatgagccaccacactccacctccaaccacaattcttgttttaaaaaatgaaaatagagtgaaacagaaatggtagaatcaagtcaccttgctcattcacagtcatgtgtggctaggacaccatgtggtccagtctgacacaggctgatcctttcccctcaggacccatccttggggtcgtccagtccttgggctctgttcctctgatgtggcacaggtggtcagtggggcagggaagacagaaagatgagggccacatccacagaagtcatttccttcctgtggtacagacatgacaccaccctgtgggatgaatggggattcccatgtttgctagttacatatggccaagcccttcagcctttctgccccacttccagtttctttcttgggtgggaatgccttgagcctcagttaattgtttgagttttcttgagtataaaaggaatcctggctgggcattgagtgaatacaatcataaaacccaaatgatgctgttggcctcatctgagctgagagtggtgttggcaccttcatagctgacatcaaatggatctccaagcccaaacactaacagtggaaccagctattgctgcttctggtgtatcatccaaatgggttttcccagccatcttctggtgcatttctaacatacccttaaaaggcataaaaaagtggcatagatgatggctggaaagattaagttctttctggtggcttctttaattttggaataaccagccttccttcaacccccttacatgcattagaaacttctgaactgtttttgttctgtttttaattaggttgtggtacaagaggagcaattaataaaaccttccatttccacatctactgtgaaactctgtgacttcttcccgtgtgatgatggctaagtgcgcagaacatgtgaaatttaagtagatttgtggaaacagaaacacatttttatttagtcgtgagcgtcacttggagtataaatagagccctttatgattcgtgtgctggtctttcttcctggagggcttcagtattatctcatgctgtcatctttatgttgtattggaaaaatctgggattctttttcccttggtcattatttgctttttaaaaaataatgtagttttaaagaattcttgctatttaatctcaagcccaaacatggtttttagtgaggaactgatacttaataaagtttgatatttttagttctagaaagaattgttttggggggtgggaggctgcagttgagaggtacaagaaatgttcaatgaggggaagacactctactgtggttccatttgctctttgaaaacttgtgtttctgttggaaagaaaggtttgattttggaagttttaaatgtactgcatgatgttgctaaattttagttcgttgctgggaagttttggatgagctcatttcataaggatttatgtgccttataggccagtgtggggtaaggggtggagaagcttgcctccttcagaagggtcttcattcctagagggatatggaatgacccactgctttttggtgggaaacgtaaaggccagtcagcttttggatgaattttcaaggaagacagcagctgtccatcttcagtcttgacttgccattcccttaggagttccttcctttcacccatctttttctccccatggcttggccatgccacagtggtccctcggcttcaacagtcttgcttgcttacatctactaactgggcaagagagaccattctcccattggccctggaccaccactctgatttggatttagatgggctcaggaattttgtttggaatccttttggccttaaacaaaataatgatgagagaaatctgcctcccataagtcataatctcagcaggctcctgtgtctgagctatttctgtatccaggtccccaagagggctacagggaaaacttcatcatgatgggagggaagaaagaaggtaaagtcctaagatgtttgcttcctattccttgtaaggtttagccatgtatagtcatgtgccagtcacctagggctgagaaaggggagcaagcagagagggagaagaggaagaagccaaatgagatggttcgtaattgattagtggaagttaaatcatgttaaggataggaggcttgtcccctccatcatgatttagtatatcatccttcccaagagaagttttgagaacttgtcctctggtatccaggaaatggcctccccagcagtgtgcatagtcccagggaagccgtctcatgagcccctccttctcttgactcctctcctaatggtcacatggtgccaccactctttcaagccaagtcaaattgcatgcagcagaaaacccaaataagtttatgcagtagaggtttattctcacaccgaagtaattcagcattggtatggtggctccatggacttcaaggatcaaggatcctttcctctttctgttccaccatcctcagaacatggcttccagtttcaaagttaccttatggcccaatgtggctgttggagctccagccatcacatccaaattccagataggaaaaagaaggaagagagaagattacaaaagaaaattatctcccagctaatttgtctttatttatggagttttcctggaagcctcacattatggtttctgcttgtatcttcttgaccacctcttctccaggggagactagaaaatgtcttttaggtaggcatattgtagattggaataaagttgagtttggttaaaagggaaaagtagagaatggatattggttaggcatatagtctctgccatggtctagaatatatgaagaacctcatgtgtgaaccttaatatattctgccaaatattctgtttataatatctaaccctcctatcagatcctaggccatttggaagccaggagcttatcctctcctctttgtatcaagccaggggcccacatgttggagttatagcccatctttgttcaattgattcagattcagcccttgcctcccatatccctcaccatggatatgcagttataaatgatttcttgttaagcatttttaaaaggttaacttcttcccagagagcttttacataattatccatttaatgtgtttttaatgataaagaatctaatagttatcaataatgttggaaaagtaattctaggcatgaaaattagcagtatggtacatatgaagtacataccaagtactacctgattccagatattaggaaaacaagacagaagggtttcaccactagtcagtatcagtagattgttggggagaaatctttatgaaaaatgccacttttcactctttttttcaagtttgaactgactgtggaaagatgggagatgtctgagaaaacttgtgtcagtacttcatgtttgtaaaaggacagggaatccttctgaaaatctagttacataaatttatgttccaccacaagaaaaatcagtggatggctggaaggcggggctttcccttttgctctggaagggaaggaaactctgacagccagacttctcagtcggaaagtgtctttggtgagccttactatgtgactggctgattcactttgtccgctaagtcttgggagaggtgatgtaaccagggactgcaacttctagggaaaggggaaaaatcactgttggccccaccctctagcattggaagcttaacagggctttggcccacagcacatggaagtttgagctgtgttttgtaattcttttttaaatgttcgccagagcatccattattcttcctcattttctcttctcctcttccctccttttcttctttcttaccttttctcttttttatcctggatgtgctcctgtatggccattctaaatcaactcaggtctgacctttggaaatacgtacagtaataaggaatcctaggggcttcctgctgtatttctgtttttgaatttgattaacatgagctaagaggttgagtagaaagaacttggactttggtgtccaaaagacacgggtatgaattctgactctaccattactggctctgtgactctggacgagttgctttacttctctgactctctagaatctcacctggaacttgaggttaattcctgcttcaaagcgttgttaggaagattgaacaaaataatgtgtgaaggaaaacccagcgagagggatgaagagcagagtgtgctgggctacataggctaaactaagaagtttggattttatttacagtgctctgggaagcagggaagtgacctgatattgtagatattttcaaaaaatcactctgggcctgtggagtgaatggaggacaggagctggagtggaagcagatagcccagctaggaggcaagaacagtggacaagacggctggactagtgtggtcacagagggaacagacggaagcagtgattcttgagaacttttggaggtaaagacactaggagtagctgaagtcttagatgtgaaaaagggagggaaagagaacactcaaacatggatcttaggttgggtcttgagcgcgtgattggtgaggactgtttgacagtgtagcccaggactgtgcatggggatgacacccacaagatgttggctggctggctggattcatgactatctggaggaaagagagaatgcgtgttcttaggccatgttggatgctgaatgcagtgggacagacccggttctatttcttgctttgaagagattgtgttccaattatctgccctgtttagatggcagcttccagaatcaagttggtcagttttgagcaagatctggaaagcaagacaatgtctcaaaagcatcaggacccctgatatccaccttgttaacaccgtagatgacttcggtgccctccctgcagccgtctgctttaattgtcagaacaaagtgaaagcgaactcagagtgggacttgggatgggctttggaactgagcagcattctcaaagctgggtgctgtagtggcatgactattacaggtggggccaggaccccacttccacaaaattcaattggatacatctggtaggaggtgttcacctggaaatctgggtcttaaaccactttgagaaacactgtcctggaggtaagcagcccctgttctggttctttttcttccactttttaaaaaggaaatcagtttggtggcaaaatctccccttcctgtccataattcagactacgacagcaattagaggcaggcagcctcccctccaaggagaaagaaaccctccacgtgttttatgagtatattcctaataatgacaatagcagcaaacaaacaccatagtggtgatttcatactcatgaaattattgtcatggagttagagcctagataaaagtgtttggcaagtctctaaagcatatttcaagagaaaaaggaggccagaatttatagaatctaaaaatagcagttgaagtgcagctgtgtttagcttgtcagagaacctgttgagtcaagatgggcaggggattttatttctctggccctgaggtcatttgtcttgtttaagaaggggcagcaaacatttccaaatagggattgacttttaaggggaggaagatggctaaatgtatatggtatttcttgttttctgctcttactcttcctacctccaaccccattccaaatttcctcttaagaaaaggaaggagagtttgtttttctcagtagagtaagtagtgactgcctaggtggcaggattttggatggtagtggtgatgttacttattgatggcacatttgatgactgttagtccatggagtggtgggggtagactaactatctggtcttagtgggttctgtacaatcccattaagttgaaggaataaacctgtagttggagaaataacagtgtgacttctccaagactgattggctgacttttggaccctctttgtcccatttctagtcaggaattatgtcttctactgttccacaacccacaaaagaagatgtctgttccacttctggcctaagcaatcctcaagcctctatacttaacaacattggaatgtcaccatcttaaaacttgtcaaccagtaggccttcaaacctcctgccctttaatatttattgaaaccttggtggaaatgaattctgtttttggtggagtgcgtgaagttatttccctccattagtttgtaggccagaggttgaaaactagtggcccgcaggctgagtcttcctcaccgtcccactttgcttgcctggcaaagtgttaacctatacaattgccaatattggaaaactgggatactttgtttacaaatctttatttctggattctcctgggttgctctaatatatattcttggtttagatttcttttctggagaggtgtccccagactgctgtgcataggtccttgtcctcccagagtagctcacctgtgggtcatgatgagaaatagccactgtattttatttgaggataataagaaaggggttaaataaattgtatgttgagcacctagaaaacatatgcatgtgcatgatgagcaccctgtaagcattagctattattgctatcatcatcagcatgtttaatgtattttctgttgagggttccattgaggacattgttcatgacataacccaatgtcttatgaggcctcatgaaagacatgtctgtcagatctcagttccagaaaatagctgtccttcttctgaattactggttcatctgtaccttactcatgcccccaatcttatttctatctttgcactagctttgcagaagctcagaggcaactatgtagttcatgtctagcaggaggacttggattcgatttgttgatcccttggtttcacatgccataatttccttgcttctctacttttctcacttattttgttgtgagcattattgtaagcagccttaaatcctgttggaacaaggctgggtgtaaattaaaaaacaaatcaagcatccattcctctgagaggttatataatcactgagaataggcttccacatcaggacaggtttcatgtcttagccttgggactacatgttttctctttcccttctggacactactgacctctcattgtcatgttggacttgattctatcagttgtgctcatgctttcccttgaatctagataacctgtaacttctgttacagaatgagatggcttatttccctgggtagactgactgtattagtcagctattgccacataacaaactgccccacaactccatggcacacatcaagaagcatttatgttctcatggatctgtgggatggttggacagttctgctgcaggtctgcacgttggctggggaagctgttctccatgtctcttatctttctagaaccagttggctactggggcaggttcttctcatggtgatggcaaaaatgcaagaggggcatgcagaaacatgtgagacctcttaaggggtaggctcagaactggcactatcacttctgccctcattccattggccagagcaagtcatgaggcccaatccatcagtagagtggggaaatagagtagaaatagatcagcctctagtgagaggaaccttagagtcaatgacaaagggtaggagtaccaggtggtgggtagggggcagctgataagtaatgcagtctagcctgtaatcccagcactttgggaggccaaggcaggtggatcatgaggtcaagagattgagaccatcctggccaatgcgatgaaaccccatctctactaaaaatacaaaatttatctgggcatggtggcatgtatctgtagtcccagctactcgggaggctgagtcaggagaattgcttgaactcgggagacggaggttgcagtgagccaagactgcgccactgcactccagcctgggcaacagagtgagactccatctcaaataataataatattattattaataataatacagtcgatcacaggcagtgtaattatttgaagaccataaggttgggcatacagcatagagtatctagcccttagtggctatgttggctattctctacttcccctctccagatccattctccaccattatccctcctgctttgtgcccttgggaggctgaccttcccctctgccttttagttgggttcagtcagaggggagcactggaaaaagagggtggaagagtggccagccatagtgaccatggctctctacggaaggccatagcttctgtcaggtggttagttctaataacttaggggttccagtgaccactccccaccttgctccttccgacctagggcattaatggctccctgctttgccacaggggtctcttttaaactgaccccccttactgttgtaaatagtcccttcagtgaattctttttgtctccctggttgaaggaaacatctgcttctggccaggaccatcatggatacagtaggtgctcaataagtgcatggttgattagcaggcctccttgtttttcctctcctctggcctctacatcactaaatggtcacttctcttctagcctgaagagcccatggaatgtcagcttgggaatccctccctctttccccataacttgtccaaccaccatccctctcccaagaacctggcacagtaaattcattagagcgaattcaaataaataaggttttacttttcttctttgggatttcttagcatgcccgttgggacaattagggagggattctttcaagtacaacattttctctagcaattatgggggttttatctcccagatgtgatttatgccatattacactccaagaagggaacatgaagaatgtttgtggctaaaaaagtctcaacacaaggaaactacaggtgaaacgtaacaatagtaattgccttactttatttgcgaaggggtggtgaacactaatatgcctgactccatagagcagtgtatttggttttcttaagcaggaagaagggggcccccccccaattttaatttactgaatgagtttaagaaccatggtgtatttcccaagcttcgctagtgaagatggtattttgttaaaaattgagattcccattgatccagatccagttgggcctgggaatctgttttcaacgtgtatcctgagtcatatttgggaagcactgggctctgcttatgattctcacgttctggtctgtgactgaggagatgtgccatgatgagagtgatgatggtgatggtggcagacaagagcatgtcacatttagaaatactgtaactggttgctgaggttttacatatattccttctgagcttgttttgtctaatattgcctgtgccaacagtattttaccagaattgaatgaaaagaaaggtaccagcagatttttttagatgttctaattgataccagaagcaaagacgtagaaaccgtcatgttataaacatgaaagccccaagcaaacagcctttagcccaccctttgagaaccactacatgacttcttgataagattctttcaactttaccctatgcctggatcatgaaagaggtgtttctagaaagctctgcaaaggactttctctgacagacggctctaggcagggggaagctctgactaactgatctctggagaggaacacagatgttccctcctaaaaaaggacatgctggccttgctttcttacaggtcacgaagtctcttttaggaatgccatttggcatttcaagtttctgcagcagttctgcagaaagccatgcctagaaaatttataattactctgataccagatggctttgcggccttcagtatcaaatgcattgtgattgtgctatgagaattttggggggaaaattccaaactttattaattattgtattggggaaaacatcatgttattgaattttaattagagttgctgggcagcctgggctgccttttaacttacgggtcacctggttattgcctgtgaggctcactgaggaaatgtcttgctggcaaagctgagttcgctcagaatgtggactgttccatttttctgttgtccaacacttgctttgtttgtgacatttagctccttttcttcctttccatcccaaatccacaccctttcttctgtcttttgcaaaatctatgacactgttgaatgaataatataagcccaaggacttggagggatgagagctgtgatgcccacatgttttagtgttggcatgtttccctcatttttggggatgccttgggttgaagctgatttttcagcatccctggtttagcatatgttgcattatgtatctgggaaagtagcatatctattttctcattttgcattacaatagcatctagtaacattcaagcctcaattaattgaaccaataattattatattaaaaatggtatgtatgccccagggcagaggttaggctatggtgggcatttgagaccttagggccatagaccccgaaacatgcattctccagaactgagtatgcaactgtttgctttcgaccttacagcacaggctttgggagaaaacagttacgttcaggtcctaactccagtaatgaatttcaagcttcttgttattgtttttcttcctgaaagacaaagggagttttatgccatggtattttgaggacaatgttgaatcaattgttatcaaatgggaagatttctgaatgctgaatagtttgtaatatccttcaaaaaaccaaaccaagaacccacccacccattcaccatttatctctccatttgtccacccacccattacccacccatccatccattcacccatccatttcaacattcaccagttcctacaaggtactgagtactgcatttatttgctaggggtgcaaaaataaagtctaataataataataaccatcatttattgagaacctactatgtgttgagcagtttccaatcttcaaagcagttttgtgatgtaggaattatgttctccgttttatgagagaacagaagctaatttacttgcctgggtcaccaggcagtcaaggcggagcaggcctgaggcatccttgcaacattagaaccagaacaacatttcattcttttatgttaaacggactctcctgcctggacccaggcccacgttagcatccagagtggcatgcagtggcagaattggagctggaacagccctcatttgttgtcttctctccttgggaaatcttcctgctatcagtgaaaaagggagagggatcagctcttgtttcttggctttgctctttacagcctcttagaaacttgagttctatctggattcatcgtgtcatttgatggtacaggagtacaaatggaggtccacttagcgaatatctaaatatttaaagattacaaatcaaggtaactgttcagtaaactgtgttccatcctaccttgacaaatatacctttataacaacttggaagccctaggttgaattttgatttctcaggcctctcagagtttagtgtagaaatggatggcttggggagagccagcccccagcccacccccccacttccctttccatctgactccatcccgcatggcaatgggccttctgtgcatgcgtgtgtggacacccatccaagcttcgtccaccccctccccacagaggctgcccttggacctcaggtagggtacactcactcatggtgcactttacagtgcaggggacaaaccctggagtagagcccaacatggaccctgaaggaggacttagggctgttggggcagggatttctgttgtcctgggcacacagagcatatctgcaagagggagatgtggagactgaccttggtctcacaaactcattgccccttgcaaagaaataaccaggagggtctcctgagaatggggttcagagtaagggcccctcttgcctgggtcttacccagggtgataccatttctgccaagtcagaggatgaaagggacttcggcggaagccatatgacccacctctgtcattttagggagactgagcatggctggtaaatctcagtgatggctggagccctgggggtccttagtttcccagcaagtgccctgtcctgctcttgcctttctgagcatcatcctcgtggcattctggagcatgaggacccaaggctgggtctgagtggatgactgtagttacgtacacaggctctgctgcagggacaggattacagaagatgtttacacaaagctgtagctttggaaacaggctgtggtgcatatcttagcagccccactgaccagcttggtgatttttgttcaactggagccttggcttcctcgtctagaaattggagataaaatggtatctgtaggtagagttgtgtaggtggaagatgagatgtttgtagaaatcttcatacagcacttggctttcccaaagggaacatcagcgaattgtagccactgtgactggagctgctactattgttcaccaggtgtcctggaccccactgagaagacgctgccattcgttcattcactgattcacccactcaaatattcatagagcacctatcatgtgcaagtactattctggtagcatgggacttaccagtgaacaagagaagcaaaattccatgccatagtggagctaacatcctagcaggtagaggcagagataaaccataaacataattaacatggagatatagaacatatggaatatagagtatggaaacacgaaagctgataagtgctatggaaaaaggtggataagggaaaggggtttggttgacccaaggtgggctgtaattttaaatagggtggttagggtaggcctcatgaaagaggtttttaatcaagaacttgaaggaggtaaggggagagaaccatgtggagggatctgggagaagagcattccaggcagcggaaacagccggtgcaaaggccctgaggcaggagtgcctgttgttccagggacagtcaggaggccagtgtgtctagagcagaatgagggtgtaggtattaagagacgaggtcagagacatgacagaggcctgaccgtgtagggcctagtagaccattgaaaggacttggcttttactcattgcaaagtacggaggggacaaatgacatgaccttctgcatctcctcccacgccttgggcccacaggctgcctctgcactgttagtcctccctgacttcctgccccaggctcactgcccccatccatgttgcacacccctctctacctgcagccgccatcccctaacaggtagaggtgtgccctgggtccactccctcaagtcccagctgcattaccagccaaggatgtgatgcatagtattctggagctcctttttaaaaaggagttacattgctttgggagttcaggacacaggcagcctgggggtgcttgcttcatttctgaaaaagcaggttgtggccaccctttcatgagccttgactctactgggctctccctgctccccatggagcctcatgctgtcctcaggccaccctagccccctgttctcctggctggctttatcccgctgagcagtgggacagaggacaggaagatgagaggaagatattccagagctgggtggagagtcagggtggagtagagctgtgtgagggtgtgcatgagggagccaacaggaaggagggctgggttcttgttctctgaccaattcccagtcatggctctcccatggggtttcacagctcagtccgaagacacattgttcctgtgcatggtgtagccaagcccaaatatttagctacggccacaccagcccttgttctgcttataactgtggtgtagacctcagtccagacaccctccaagagatacccaccctgccccttggcactggcttgggcggccttgtctggtgctggaaggctctcttgggttctttgccaaagttcagatgtccccctttcccactctgtgggtgggccctagtgggggatggatgagggctaaggcatgctttacccctggctcccaggcacagagatgagggtggcctctgggtcagagggcttcctgttgagtcagagcctccagccgatatgcctactgtcccacccctactccacatagatgcagggcaccctgcagctttgtttcaggaggaactctgccagtggaaaccccatgtccttagcgcagccctgggggttatcagggtggctcagatgcaggaagtcctcgcctctgctgtcctgctctgccccaccctgtcctgcagaggggaggccctgcccatgggagagtctgcctccactgggcagtgctggcctggaggaaacttccatgccacccctcctgcccctgggctccagggctctcgatttttggggtaaacagaggtgctgggctctgctgaggataagctttgtgatctgggaaggatccctttctcctcattttttccccacctccttttcatcatgtctgtgtgaaaacgaaagctattgtttatgtaaaaggaccatttgcctaatgtccctggaatttatttgctggagcattttccattttcatattcagtttagaccttggctgaagtagggaggttatgtaactgggatggaacaaatctcattggcatctggggaccctagtgtaccccacccttagccattcctgcagtggactgagtgcccccctggctgtatattcaagtcgcctctgtggctgccagagttggggagctggggagctggagtgatagagaaggagttggcagcatttagaatggagtcaggaggaagatttctctggggggttggattcatagatctgctttggggctgtctcctcctcctcagctgtagacctcgggggtccagactttccttgcacacaaagcctaggcctttcctatcagcctgtctgtggaccttagccaacagcctgagcctcactgcttgagccttggctggattagggaaatgtctctggcactttccttcttggctgtctgtggaacctgtctctacattctaacccatccccagcagcactggccttgagggccatgtttctacccctgattcccagcctgagcgccttgggtttctcctcagaagccttgtctgggtctgcatggaattactttgacaaaggatgggatgtttttctaggttatgagggcctggacatttgcctgcctggggttttaaaagaaggcaaatatatagagtgggttttggagccctgaacttagtcatgggtggataggggtgggctgaggagggggtgcaacctctgccttccctccccacgcccccatattctgagatggtagagaaccctttcattcctccagcctgtctctttcatccctctatggactgagacatctccctttacaccagttttttacttaaacatgcttattagcctccattaagaaaaaggtaaccctgtgtatacctgtattaacacaatgctaactgctgcaacaaaccctcagttttcaattacttgacctactagatgtttgttcattgctcatgtgtcagtcaaataaggctattcctcgttgaaggtagcttcctccacgtggtgattctgggactgcagttgctttccattgctgctgctgcaattccttaggacctccaggatttctgcctcctgggggcaggaggagaaagaagcagtggagaaggcacacccaccccttaaacactccagcctagaaatgacccacatcccttctaccgactttccattggtgggaactagtcacatggccacagccggcctcagaggaggctgggaaatgtgggtccaggctgggcaccaccttgggaatgactccacatatcagtggtaggagatggagaggagggggtgtacttgggaaacggcgaggtcaagtcagcagggtggattgagaatatgtagggggacgaagccaggagtccaaggaccccttgggtttctggtttggagaacagggtggatggtgcctctgaaggcaatggagttaacaggaagatggacgatgctgagagggaaggctcatctgtcaagtgcccagcaggggtgggtgctgtaagaatgttttgtgaatgcaggaatgaggagaaacagtagtgaatgaacttgagtcccttctgccaaccccttgcagctatagtggagaaaaactgtttggtagctgtactccatagcctgaaaccatagcacctgatgaaattggaccaatctgttttcaaatacaaagctagtagttagaataaccagggggaaaaaagcataatcagtagccccatgtctttgcacaggctgccataaaaaaaggtacagttgtttctcagtatgcatgggagattggttccaggattcccaatggataccaaaattcatagatgctcaagtccctgatataaggtggcatcgtatttgtatataacctacatatatcctcctgtatactttaaattatctctagattacttataatacctacaacaatgtcaatgctatgtaaatagttgttatactgtattttgggttttttgttgtattgttatttttattgtttttttcctgaatatttttgatctgtggttggttgaatccatggatgtggaacccatagatacagagggctgactatcccataaattgggtgggttacacaacagaaattaatttgctcacagttttggaggctgaaagcccacaatcaaggtgccagcatagttggtgtgtggtgtgggctctcttcctggcttagagacggccaccttcgtgctatgtcctcacatggcagggagagagagggagaaagctctctagtgtctcttcttatataccatcatgaaggctatgacctcctctaaaccgaattatatcctgaaaggcccatcacagtgggagttagggcttaaaaatgtgaatgtggtgttggaggacacaattcagtccacggcatccagtggcgatgtctccccaggcatagagtcctcttctgtgttgggtattgtctctctaagctgcggggaaagggaaggcagcagattggtgtcctggcccatccacttcaggtgagaaggatgcctgctgtcctcgtgtggacacaacttcctctgctctccttggccttgccttggcctctttgctttaggatatgatgcccagaagggctcgaaactggagtctgaccaggggcaagcaggctgcctcttgctcctccccagaaagggagagccagctgagggtgacaccttgggctgcagccacaggccactttgccactgggctcacccacgctgctgctgccacacgtggggccaagggtgacaaggctgccagggagcctgggatcggagttccagggccatctgagctctgggtcagcagcagtcattggagcagggatctggggaggcttttcacgtgggggttgttgagataggggtctggccccattcctgcctgactggcagtcttcattaatgtacgtttataccaggagcaagtggagctggggaggggactcacatctctgtctgtgggaagcagggcagagtgagggagagtatggcctgctttctagctgatatctccccttgctctcagcaagctcctctgcctcttcctttccttctggtaaagcataaggagaggactcaacagtaaggactaatatttgacagtgaggagcagatagagttttttaggcaggggtcactgttaaggaagtttgtattttttttttaacttccaaataaagcttgaagtgtctgagaggctgcataacagaggtgaagggcacagacttgggagccccatggccaggatttgaatctgaactcttaggcaggtccctgaactgctcagccctcagtttcccatctgtaaatggtgataacagtaccttcctaaggtcattatgaggactaaatgagtaaacattgatacagtgctaacaacgcttaatagagtacttacaacacttcacttaataagtgccatatggtgggtgttaaatatatattttggggaacggggtctcgctatgttgcccaggctagagcgcagtaactattcacaggcacagtcagagcccactacagcctccaactcctgggctcaagcagtcctccttcctcagcttcccaagtagctgggactacaggcatgtaccattgcacccagctaaatttttaaaaattaagtcttgttgaagagtgagtagaaaccagagtggtgataatttctggttctccctagtcatctccctcaagaatttcccagttacttctcctggaagatccgcttccttgttttgttgtttttgtttttgtttttgtttttttttgactttgagacaggatctcactctgacacccaggcgggagtgcagtggtacagtctccgctcactgcagcctcaacagcccaggcccaagtgatcctcccacctcagctttccaggtagctgggcagtgtcagcagctctcctatggccagctccaccaccaggtcagacagtacccttggcaacctgtggaccaggctggggaagaagaaaatctaggaagaaaaggccacacaaggaagaagtgcagatggcaggggattccggtggccagggaccagatgggagtccgaaagctacacagagcaaacaaccaaaattgaaagcaaacagactctgagttgagaaacctgttctccctatccagagcatacaattcagaaaatgccggaacagcataaacactgcaaaacaaatccagctatgtaatccctttattttagtaattagaggtggcactgggaatgctggtaacagtggagtttgactcagatccccttgacctcacttggcttttcctccatgttccaacaacttgttaagtctgcttctccattccattcctttcccggcgtggtgtttgggtttgtaggcaggatggccatgtatgcacaaagaaagctttggggcagtttcctgccacccagtttttatgaacattctctttgccccatgtgtggcagcagaaggcaatccagccctcagcctggaccgccgaccttgtgtgtttgtctccctctgtgcctaggcccgagaggccattagaagccccatttgtgtgtctcagcatggcaggaaggtcaaaccgctgcttcctggttggaaatggtttcttcattgattcatcaggtcagtcaagcatttactgagcacccactggagccagcattgtgcaaggtgctaggaatacagtgatgaggaaaagcagacatagaccttacccttctgaaagttccactaaaaatcaaataactgtgaacaaatgtccccttcctgctgtgatacctgccataaagaaacatgttactattaaagtataaccagatactcacatgtgacattctcttgttggttttccctgagtgcaaaagaggtggtgagtctttctaaatcctgagtcaagatgcttgaccacttattaggacttggacccttagttttggacccttagttttggacccttagtcccttatcaacatcgaaggtacagaaggattgacatcagagaggcccaggaagtttgacattggagagaggcgtttttggagaaggctgatgggctggggggtgttttccgacctgagccccttggaggagagaaaagggtgttcttcctccagcccagagaaaggaggagaccagacaggtctagctcctgagagctagcctgactttcttccagagtcttggagagcacaaagatgtgtgttgatgtacagcttaaaggggagttaatggagccctgagaatgtcctgctcccccggaggaggacatatgagtgcatctcagggtgaaagctggctaggagctatttaaaaggggttgtaccttaggtgaccctagggagaggtgatgggaccatacccaaaacacaaggggtctggggccagcggaggagaccttgttccctcttgggagttgcaggggagtgtcccaatgctcaggaagctccagggaaccttcagtgtgcctgaaaaaaagtcaacctggaatacccaccaagctaagggaggtcagcgtgcaatgccacaaagccacagaagtctctagagcgactcagctttaaacagctgccatggccagagaaaagccaacacccaaagacaccagttccaactaggtgtggcttctcctcccctcctctcctcccctcaaaaggtgttctaagcagctgctgggaaagggggtgagaggaagtgactgcagcttttttatctcccacttcccaccctctagcaaccttcaaagcctgaagtagggccaagttggaagaggcgaggaagtttaactttaaatgaaatttggagtttttcactaatacgcaggactggtcattttgatactgaatgggattattctggagattaaagcaatggaaagacttttcatgatctaagagtgatccaagagatagtgggacctgctcaaggtttcatccaggaggccagggagaaagggccaacctcagtatctaagggttaagggtgtgcaagagagtgcaatcagtattgcatttcagcagatcagccaagctgcaggataggtgacagatatgaaacgataaatgtggaggcagggagaccaggtaagaagtctgcggtggtctaatggtggaggtgaagagaagagggcaggctgcagaaaaggcaggatacgaggtagaactcccacagtttcctcatctctattgtacatagtaatcagggtctaacatagcttccctttcccacctacgacctatgaggtgcacctgtccgtagtaagtactcagtaaatgactggtgaatgaatgtgttttaaataaggtatatagtgagaaaagtgagcattggagtctatttcagttatgtgttacaataataatgctgcagaacaaactcaaaacctcagtggcatataatacaaagcatatagtttgtgcagctgggattagcagtggcttggctagctggctctgctgatttgggcagggcttgttcatatagctaggggtcagctagctgttggttatctagactggcattggctggggtgactggggcaactcagcaccgctccatgcatatctcactgtccaacaggccagcctgggcatattcacgtggagactgagaagcacgagaaggcagaattgggcccttgataagatcatcctaacacagaggcagatgtagatttgaaccctatttgcaacagtcactaatcatgtgatcttcggtgatttattttacactttgtggcttaatgtctttatctgtaaaatggggctaggaaaatttatctcactgggtagtcaggattacataagagtaataacatctcattcccactataccatcctgagagggtaaataattctgcctatgacgcaggtatagaaataaaaaagactatgaaaagattaaaaagagctcaaatgaagggaagataattctaggcagaagaaagagcatgttcaaaggctgtgtgagtgaagaggtgggagagtgtgctgaaaggtgggcagaagcctctctgccctgggggaggggatggtgccagggagctctaattgtattttgctggcactggggagccatggaaatttctgtaggaagggagagatttattttattccacaaacatttatttggcacctatgatgtgcaaggtattctttaagatgcttgggagacagtagtgattaatcaatgtccagtgggagagtcaggggggtcaggaagatcttggcacagaatgaggtcagagtgagagaggtcaagattggctggccaggggtattagccctgagatacactgctgctctatgggattttgcccctcattcacaagcagagggcctacccttaggccccaagtgtgtcaagccccctctgcttacaaaactttatttttcacaaccaaaggtggttcataatggtgggctgaggaggaagcaactgaagtaggggaagctcagaagtctctgagggtccttcccaccaggaatctccccacttgaacctaaggctgggacactttggcatgtgtgttttaaaggatccgtgggtttgtggggagggctgcaccagtgaccagttaagcccagtgggtgatgcctttcctttgttacttttcatgcagacatctggaaagaatttgtcaagaattataataaagaataccacggaatgaaagcaaatgtggtgagaagcagagttgccttaagactgagaagccagcaggaatggctgctgctaagaacctcattcttataggaaggattcagttctttccctgagcaacagaagtgcataggtgcacggcatagtgtgtcagttagcatttgctgagtaacaaaccttcctcaaatttaatggcttaacacaacagccatttattattgtgtataagtctctgggttagctggatagttctgctgatctgggtggggcgtggctgattttggctgggctcactcatgtgttagggttcagcttgcaggctggctggaggctggctcagtcagatgttttagagttggctgaggtgacagtgtggctgggccaatgcctatcatcatccagcaggctggcctgggcttgtttacatggttaggaggttctacaagtgagagtggaagtaggcaaggccttttgaggcatgggcttcagaagtggcatgatgtcatttcttacacattctcttggccaaagtaagttcaagggatgggaaaatagcctcttcctgatgatgggaggagctactgtatcatcttttcatgacacatatgtagggacaggtagaacattgtggtcatatgcagtggactgagcccatgggctttggagtcacatggggctctcaagccatgattctttacttaaccttcatctataaaatgaaaacactgatagaatctatctcacaagatcattttgaggtaaatgcacatgtacctaatgcatagtaaattctcagtagaaaataacattttatgtattttgcatgtttctcataaactgattgtgcattctaattatttagtttggaaaatgtagtctctgtaggtttacccttccctgaggcagtaggggagatcatcacctctgtaatggtataatatgaactcaggagttgagattcgtaaagcagtaaggaatgcatagtcagctatactggaaatttgggaaagggaaatggactatgtgggaaagcgggactcttatccttgcagaagtcactatgaaatgaggctttcagtaaacagaagatgggcatttcatcctttctcattactgagccttcctcaagacctccttaacatcctaacattataaatacaataattttagaaattacttagtcaataaaaaataagcacttattgtatacgagactctgttctaggagccagagatacagaggaataaggaattaaggtatttctcccatattcaaggacttcagtttcattacctgtccagaaaactatgagaaccacccatcacctctggttatagattcttaagtgggatgtcaagccccttccctaatgatctcagtttaacctgctgtcctattcctctgtggcctattcctgtgctacactcgagccaaggtggcctcttccctagccccacacatactctttgtttttccattcttccaagcaggcccggagaaggaatgggctccacgatgcagggcccgcggtagagaacagccaggcagagcagggggcctggctggatgtggccagcatctgcaggggttcagcattgagatatgacactgtcacctccatctcaagaagcccttacggatgcctcccttcccttcatgactcactgtgatctacaactcctcagagccagccttaaagtggtctgtggatcagtctcatctccccactggagctccatgggcagaaagcactctttctcttctgcctacaacatcctcctcccatcggtatgcaccccttcctaggagccccacaggcaatgacaggaacccccaaccccatgtgtgcacatatacacattcccacatgtgtggggaatgagaggctacatagcctgctccatcctcttcttttaacctgcaattactgggtgaaaagagtaggatatagtaaaatgcaaatgctagtttagtaaatggcataaagacattgaagtgtccctggacatcagtcacgtggctgtggaagggagacttagggtgtggctttccccatggaccatggtgggtctttgggatccctctcttccccaccccagtcctttaaagacccaccagcgactttgtgagattctagactcctttccctcgtacctcctagccttattggatggaaaagagggaacagtggttcctttctttctgccacgcctccaccttccattggagactcctatttctccctccgtgacatctttgctgaacagaacagctcttaaaccagaccttatctgttccatgggtgcagaagggtgcaatgtgaacagaaacagcaagtctctggaaaagagctccttcagctgcaaagaacacagaggtcaggaggaataaagctaatgagagagcagagagtcctttgtctccccaggtgttattcccagagggcaactagggaaaatggagatggggtataaacatctgaattcactgttaaacactccatgaactgttgataattccctagaagcagcatattcctgaggtagcttcatatgatctccagaagcaacttacatgtagacatttttctgagaattccagaaagaatattgataattttcagacaccatggcttccacgcctcatcaacatgagcagtattagtctttatctctgacatcaatcaaacttgaacaccatcagcatgggctttaatgaaattctcacatatgtatcagaacttgtattttttcctttagtcagtgtcttgatccatttgtgttgctgtaaaggagtacctgaggctgggtaatttataaagaaaagatgtgtattcggctcatggttctgcagggtgtacaagaagcatgatgccaggcatccgctttgggtgagggcgtcaggctgattctactcatggtggaaggagaaggggagccatcgtgtggagatcacatggtgagagaggaagcaagcggggagtggaggtgccaggctctttttaacaaccagctgttgtaggagcacagtgagaactgactcactacctagagaatggcaccaagccattcacaatggatccgtccccatgacccaagcacctcccatcagacccacctccaacactggagatcagatttcagagtgagacttggtggggccaaacaaatcatattcaaaccatagcaattagaatcttaaaatcaaaattgatggctttatttttctaaaaatgggaaaatatctccaaaacattgttcaaaaacaaaacaaaacaaaacaaaaatgtttgttcttatatcccatcagtttattcaactaacattcactgtggactttttataaggcagtaactgttttatgaataggagatataaaactgggtgaaacagtgaggttcctggccactgtattgtaataatagaggcacatataccaaagagctaaaatacaggcagcaaactctagggactgaagtaaatttccttaatttaatgaaatgtatcaagcagaaacccacaataagcatcatacttaaaggattcatttgaatttttttatttatttttattaaatcagatatacttttctagtttttttaatttttattttttgcatttcttgatcatttcaaagtgaggtcagttacagagtgaatgggttcatcctgtcattgtaaataacagtttttcgtttaataatggcattttgtattaccaagaccttgcttcacattaggtgttttgtatacattatctcatttaatcaaaaccagcactctatatcatgggtgccaccattcctctgatttttgctaaggaggaaactgaggttcaaaaagggtaaataagttgtccaagaccacacagccattgtttggcagagctggggcaaaggtctatactgctgcaaagcttgtgatttttggctactaccctctaatgttctgtgagggtggaacacctaacctagaatttccctgtggatcactcacccccaatgatggcatgtcttgctctggacccatgatataatgatctggatacagccaaagtcactaagcacgctacaccctagcctttcaattcctttattacttcatggagaatcatgtatttcagccactcaagtatctttaaggtctaggccttatcgaatggggtttagtcactcagtacagtctgccctttgtactcatgagttcagcattcatggatttgaagaactgtggggtgaaaatattccaaaaaaatggatggttgcatctgtactgaacatatacagacttttttcaatatttcctaaacaataaagtatagcaatgatttacatattatttacattgtattgggtattataagtaatctagagattaaagtatataggaggatgtgtgtatgttatatgcaaattctacaccattttacatcaaggacttgtgtgttcttggggtttggtgtcagggtggtcctggaaccagttccccatggacattgaggaatgactgtgcttcccctacccaacagaagtggttctcccgtcaggttataatagggaagggatgtgtgatctttcctgagaactgaggcatgctattaagctttaaatggagcatctctaagtttccttaccaaaaagtaatcagacaaagggccatgtggcaagagctcttgcttcaccaaacacgtagtgatggacccccctatacccagtgtgccagacatcatcatgagatgtaactcctttcacatatctcttcccttgccagaggaaggaactgaggctcagaaaggttcaattcctcacccaaaggtttccaacccaaggtttctgacctggagccctgctctttcctccacaccctgctgccattattttgtcttgttgggctggggaagggcaaagagggtgcccactgctggatgaaagaagcagctacattcccattcaaggtgtgctgagcccagtcctaactgctcaagtctttcttaggtcttatgatggaactgaaaagcaggctacctattttatccaggaagcagacagaggatacggatgggcaagcacttctatcagatgctggttctgttgtaagacatcatcaaggttcctccaacccctgctcctcatcacactgcacagccctttggcagagacagggagaagcttgttgtttgagacatctggagttagaaagtatctgagctttaaatggagaaggagtggggagaaactgacagtgaagtgtagacatgaggcttagagagatgctaactaagtagtcatgagtcgaatctcccatttagtcagacacatttttctagtttttctagttttctacccttcaaaatactttgtgttaaactcaattacagagatagatccttccattcatcaagtgaattttagaagccacacctttgggtgggtcttaaaagcagttcatgggaatctataggctattgtgtataactggagggtagcagaaaacaagttccttgtgagatcagacacatgagctaaacatttaggaaaaccttacagaagcaaatctttaacggaagggtttccacactgagggccttgtgttgcttttgggaatggtgtagaaatcacgtgcttagtcttgaattatgattcacctttactgaatgtcccttctcttttctttactcactgtcgaacaggaacccaaaggatgtagtttttggcagatgtcctttgtagggttcagtatttctcactcacccctttaagaccctaaagggagagttattaatagtttcagaaagttgagggaaatcatgcagaggttctcagatgttcagagaggcttcctctccccttccatgaaagttctaaggctcatgggtgaggcctaagaaaggcatgtcagttgtctatcaagttcattagtttattcagcttatttctgaagcttttgatgggccggctattcagaggtcaatgaaatagacatgagtactcttcacagaccttaccgtctaataggaatgatagcaagtgaatgtataataaataaataattaggggttgattgttacgagtgctatgaggggaatagccagggtgacatgtttgagaaggggtcagtactgctaagtgttggtcagggaagcattgcaggcagagggaacagcaaatgcccatggtttggaggcaggaatggtgttccaagagtagtagggagcctcgggactagagtttggaggatgagcggggagagtgggaggagatagtgggaaagtctgtggagccagttccctgaggggcctggtgggccatgctcagtgggggtttcatttgacgagccatgggaaggcttccagcaatgggggatgtggttttacttgtaccttaagaagatcacactgggtcttgtttggagaatggacaggaaaggagcaggagagcaagcagagagtctgaggggcaagaaatgccctgtcctcccagcagactggagcgaattctaattctgcctctgctacttcattcctatgcaactttgggcaggtttcctaatctctctgcctctcaactgttcacccctcataaaatgaggacaagtattttctcatgtggtttctaggacaaataagtattcgtaaagtcctctataaacttgggccatatgcttatctgagctataatatgattcatattgaaaggagggggactcctgcaatgttgggaaaacgactcagctgcccctatataaggaatatgttattacagtccgagactaaaaagatgcttttgtttctttactgccatcagtgtctctctaagggagggcggctggttaaaaatcacatggtgtgggcatttataggggtaataacttgaaatgattaaaccctttttttttaaagcttcatgtctctgttctccatctgtaggtggtgcatgagtatgatatagtgtgcatgtgtgacatgctgcgagtgtgaggaatgccagagggagacccacgaaactgccctgcaggcagaaggccacatgctctcagcaccagtcagtggtgctcgctagtccggcagattgctgtattcttgcaccctgtaccacaacattgttaggataaagtttcataagtcttatatggctttgaacaaagcaagtctatttttcatcatagtatgggttatttagaattcatatgttatgaggaaatacactgtttcaaatgcagttttctttgtggtgtctcagcagatactgagttttgctgccctgtcatccaagagggcctcaaggtgcccagagagaccaactgaaaaatgttcactggaacggagctgcaatggtggaaacgttctgtgtgtgccctgttcagtacagcagccactgcgcggctgctgagcccttgaattgtggctatcagggtagaagaactgatttttaatatattgaattatgagtcatttaaatttaaagagcacagctgtattggacagcacagctgtagaaggatgttttctctcatggaaaaccccaactctgagccccaggggtcctatggatccatgagctcacagactcccctaacgtccatgaagatcatcaccaggatttgagggaatgctgtggtgcatactttgtgttggacagttatgggggattgcttttgccgtctcagcatttcaccgctgtcctcggtatgagattatggtgatgttgaatgggggtcattagaaggctgtccacagaggggatcagcccccctcaatgaccactactccgagcatgggctttcttctgtttgatctcgttgggccctcagctgtgactgtggagaacagcaagtcctcagtgagagtatttgtcacttcctactcttggtgtttaatatcatccctctggcacagatgcttgaaaatcaatggtttcttgacacatcttggcttgtgtgaggggccataacaatagcagggctcatggctcctttttttttttttttttttttttaaagagatagggttttactctgtcacccaggcaggcaggggtgcaatagagtgatcatagttcactgtaacctcgaactccaggtctcaagggatcctcctgcctcagtctcctgagtaactggatctatacacatgtgcccccgtacctggctaatgtggcttcctttatgttcagcaaggaactctcagtgtttgtccatttccttaggaacatgagtgtttttggaaggcctttgatgagtggcagttgggtggatggatgagctaatacatccatcatcctatctcaggaggatgcttggatttgtgtttagaaattgggtaactcagttgttcatggaggaaaaagttgaacattactcaagtgcagatagggaaacagtgtaagaacaaaaaactttttttctatctacaagtgaggaaaaaaatattgacagtgtgcccaagcttcatggtaggatgggtgttaattgggaatggcatgtaattctcttctggaatccagtgtctgggcaagtcctgcctctcagattaaggcaccagcattcagcataagagggtcctgcctctcagattaaggcaccagcattcagcataagagggagtaattgacattctacatggcaaaagacccttgaaagataacagatgaatgtctcatggccagtagcttggtttttttgcatggtgtagatttagaatataacttttacagggaagaaaggggttaaaatgtctggtgccatctgtcacagtaatgagttgtgcaaagcccaatgaaccttgtagaaacaacatcgtgcccagaaatagcctagacctcagagtgacatcagggggcagggacctgatagatgtggtcctgcaaaaggaccgaaggttcttctttaacaattcaaattgaataggaaccatttttaatttgggggtaactccgtcttcaccattaatggccattcttcaaagctactttcattcctgtgagggatggccagacacgagaaagccaagcagggattttcagttacaggtgagcatccgatctgcagccagggctttttctaccgggcacatctttgtgcgcagcctggtttgagctgatctgcacataaacaggcactctgggtgtggatgggggcatctgtgtactctttatggctatatttccagaatatgcttttaaagactgtggtcacatttaccttggttagggaagatagtgacttataaaaacctcaaacatttatgtttccctttccaatataaaaagtgttaataatttacccacttaaaaggttaagatcaaagagatcataaacacacatgaatactatttcaggaacataaaattcagctatttctactaacagaaagtgagtttatgggataccaatgcaaacaaacatagatttagtggaaaatgactcaaccaagtaagatttacaaaacaaacaaaactgttttcatcatctttggttgtagttttataaagaatgctggttcatggactccagacacttcattgaaactgtgtgaatcattttaaacaggtttgtccttgggccccagatagtacattggcatttgtgaatcattttagatgagtttgtcctcagtacaaatcgtgctgtgtttaaagttcttggagacacttctctcttccaataaaaggcttttactagatgtttcagtgacataaagttgaagacataaatactgttttatattgtaagcaggaccaactcttttatggtgtgttttatacgtctagaggatttttgttgttgttgtttctttgaggttttctctgaaacttcagattaaggtagtccttgaagtggaggctattaagacctagtgttatctgtttcagggaggtgggggactaggtggactgatggaccccagaactccagattccttgcactggaagctggtgttttgtgtttggaagagcctctgccctctgtgtcatgctgcagtaaagtatgggtcaacatccccaaaatgtgtgactcgcccaaattaagtggtgtcatactctgatccttcttccactgaacatcacattcttcatgagaatcacaccattgtcctctgtctgccctgcctgtgagacgggccatgctctatgcttgcccgcctcttccatcaggaacactcacacagtcattctcctcacataccccactctcatctgctgcccctcacacctgcccttctatagaatgttctaccctttaatagggaagggtttcttcttcctatgaatttttacctcactttgtgtctttttaggtttgtattggaactatttgcaaacaggtcttggcttatctaaagaaaaattgtaagctccccatgacgcaagacagtatcttatttacctttgaaaacctcatcacactctgccctgctcagagtacaatctaaataaaagtctattgaatgactgaagtagagtttcttttttaacacttatatgcacattcttgtgacaggcacagtgaaagatttatcaaggaatgacatggtccccacccatgacactgttaaatccataatttgtgatgcattgtttttagttatctagtgctgctgaacaaaccactccaaacttaatgatgtaaaacaacagcaattttatcatgctcacagacattgtgggcaaggaattcgggacagggcacattggggatggctggtctctgctccatgatgcctaggacctcagctgggagagacttgaacagttgggggctggtgaatccatgtctaagcttcttcattcacatgcctgtcaccttggcagcatggcctagaagcctgggcttagctgggcctgagacccccagcattctcttcaaggttggggaattggaccctacatttgatgggagaattagccagttcatgttgcagaagagcatgtggagtcggagatactttacaagcatctatggaaaatacagtctgaagtgaatgcccaaatgagtggcaccaacactgattattactgggtgacagaggcacatggagaaaatgtcatgagggaggaaatgctgggatttgccttgacctctggctgggggacggggagggatgagaggtccaaggcaagatggataagtgggaataagcagccttgttttggggaaaaagagggacagacctagaatggctggctgggtgaaatggcttgttgtgtctcctaaattagattttacatttttgagggcagagctacttaatattgtatttaccccagaggaagattatttttttcattctctaaattgtttaattaaaactcatagttcatgttaaatttgttcaaactttccatctaatggtgaggtggtaaaggaaataaaacttaccaaaatagaagagggagaaatgaaaaggaaatatgatcaatgatttctgttctttttacttcctacttgcaaagactctggaaatgtaatgatggttcagagtgttctgctataaatcctaacagcttaaacaatctcctgggatcatattggcaaactctaagatgatacaagtatagacttagtttgtctgagcccgaggttcagtgtttggagaaaaataatacctatgtcgagataatatcagataacctataaaagcaggtagcccagtcatgcacattggtgatcaatcaatgttagctgaatccaaatattacgagtgcagatgctgaaaggaacaaaaggaaatctcactcagtcatccatctgccagtatttccaccctttcccgcaaagaggagctcagtgtctgtctctgttattgcatcaggatctcacattatccagtaaacccaaatgctgtaggtaagagatgtaataggtggtatttattaagtggttttaataaagttttgtggataggtatgacaccatttcttttgagcttaaagatgcttaaaatagctaaggttaaaaatgagggaagatctgaaaagaaaaacagtaaagagatgtgagatgtaaacactgaaaggaagtaagggtagagcaaaaaaaaagtaaagcatcaggtaaatatttaataaaatgtttatacatgtatattgactgtaggtgtagggttagtctattgaataaagctgcctttcttaggaatggtggtctcaaaatgcaccagtgccttcctattggctgaatgtccacttctgttctatgcactgtgctaaagggtggacatgctgagatgagtgtgagtggcctctgcaccaaagagttcagtctaattctgggggttggggataaatatgttagccagtaaatgccatttattgctttagatgtcatctcagaaggataaggagcagtggggacaggaggagcaagccatctcctgggggagtcaagaaagatgaggacagagagagaatgtcccttggatccaatatggtggccattagtgaccttgttaaaaccagtaggaatggggtggcaagaaggagagtagaacagactataagaaagaatgagttttgatgaaagtattggaattttgatgaccttttttattacaggtttgggagcaactactttcttcactctctaaactgcaaatcattcagggtaattgtgctggttcagttagcccccaagctgagaagacaggcccactgtggtttgagtaacttggaaatcttgtggggtcagtgttttgactctcttcattttggtcatggttcaggattttcacacaccactaaggtctaggggaagcttctcagctttctggataccctctcagggctcatgaagtggcaggcctgccctgggaaggtcaggattcttctgtaaaagcagagaacactgcatggagcccagagagcccactctctgcgctcttcccttcctatgggctcacacggggaaacagatgctttcctataactctgagcactgaagcagctttgctctgccttggccgaaacatctatccaggaccaaattcttaaaaccccaggggccctggggtgattttcagcccaggccctgaacctgtcataaaatgtaatggatgatatatttttaactgctgagaccagagagttcacataacctatgaagactgaaacaacataatgtttctgcagttttgaagcatttcaaaaaccagaggatggtctctctcattaggcattactagtaagacaaaagttcttaaccatttctgtgcgtggacgcctttggccgttgggaagcgcacgtggatcctttctcagaatatgcttttacatacatagaataaaatacatagaattacaaagaaattcagttatactgaaatggagttatcaaaatttttaaagaccactttatgatataataatataccagctttttcttgatgcatgaaataagaagatctacagacattttgagtactgttaagcataaacaatatttcaaggtgtctacaactataatatagtgtgtaatatctcagatttctatcgacggtagagtcacaggtctttctaatacttttgtggtttgatgcctacattttataatggaaggaaatgctaaatttcagttagaggttaataaaaataaagaaggaaaattcttttcctctatctaaatccacagatgccctgaattctcttcgaggttaagaacttctggtttaagatatgcttttggttgacagtagtaaaacaagccaaaagaagttgaccatttatgtgatgtgcagtaataaattagcaattcagagttgaggagctcattactaatctgtggatagtcctaatcccagcccttttctttctgagctttgccttttgtaaatctcagtgcttcacacacatcagacaaagatattttgtgagtggctctaaaaatgggggcaaaacatgaccctgaggaggcctggggctgatctgagccttaagacttatttgtggagaccttgtgctgttctttttttttttttttaattatactttaagttttagggtacatgtgcacaacgtgcaggtttgttacatatgtattcatgtgccatgttggtgtgctgcacccattaactcgtcatttatcattaagtatatctcctaatgctatccctcccccagccccccaccccacaacagtccccagtatgtgatgttccccttcctgtgtccatgtgttctcattgttcaattcccacatatgagtgagaacatgcggtgtttggttttttgtccttgcgatagtttgctgagaatgatggttttcagcttcatccatgtccctacaaaggacatgaagtcatcattttttatggctgcatagtattccatggtgtatatgtgtcacattttcttaatccagtctatcattgttggacatttgggttggttccaagtctttgctattgtgaatagtgccacaataaacatacgtgtgcatgtgtctttatagcaacatgatttataatcctttgggtatatacccagtaatgggatggctgggtcaaatggtatttctagttctagatctgtgaggaatcaccacactgacttccacaatggttgaactagtttacaatcccaccaacagtgtaaaagtgttcttatctctccacatcctctccagcacctgttgtttcctgactttttaatgatcaccattctaactggtgtgagatggtatctcattgtggttttgatttgcatttctctgatggccactgatgatgagcattgtttcatgtgtcttttggctgcataaatgtcttcttttgagaagtgtctgttgatatcctttgcccacttgttgatggggttgtttgttttcttcttgtaaatttgtttgagttcattgtagattctggatattagccctttgtcagatgagtagattgcaaaaattttctcccattctgtaggttgcctgttcactctgatggtagtttcttttgctgtgcagaagctctttagttcaattagatcccatttgtcaattttggctgttgttgccattgcttttggtgttttagacatgaagtccttgcccatgcctatgtcctgaatggtgttgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgttttcgtcaggtttgtcaaagatcagatagttgtagatatgcggcattatttctgagggctctgttctgttccattgatctatatctctgtttcggtaccagtaccatgctgtttggttactgtagccttgtagtatagtttgaagtcaggtagcgtgatgcctccggttttgttcttttggcttaggattgacttggcgatgcgggctcttttttggttccatatgaacttgaaagtagtttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgcacattgattttgcatcctgagactttgctgaagttgcttatcagcttaaggagattttgggctgagatgatggagttttctagatatacaatcatgtcatctgcaaacagggacaatttgacttcctcttttcctaattgaataccctttatttccttctcctgcctgattgccctggccagaacttccaacactatgttgaataggagtggtgggagagggcatccctgtgttgtgccagttttcaaagggaatgcttccagtttttgcccattcagtatgatattggctgtgcgtttgtcatagatagctcttgttattttgagataggtcccatcaatacctaatccattgagagtttttagcatgaagcattgttgaattttgtcaaaggccttttctgcatctattgagataatcatgtggtttttgtcgctggttctgtttatatgctggattatgtttattgatttgcgtatgttgaaccagccttgcatcccagggatgaagcccacttgatcatggtggataaggcttttgatgtgctgctggattcggtttgccagtattttattgaggatttttacatcgatgttcatcagggatactggtctaaaattctcttttttggttgtgtctctgccaggctttggtatcaggatgatgctggcctcataaaatgaattgggaggattccctctttttctgttgattggaatagtttcagaaggaatggtcccagctcctccttgtacctctggtagaattcggctgtgaatccatctggtcctggatgttgtttggttggtaagctattaattgttgcctcaatttcagagcctgttattggtctattcagagattcaacttcttcctggtttagtcttgggagggtgtatgtgtcgaggaatgtatccatttcttctagattttctagtttatttgcgtagaggtgtttatagtattctctgatggtagtttgtatttctgtgggatcggtggtgatatcccctttatcattttttattgtgtctatttgattcttctctcttttcttcattagtcttgctagcggtctatcaattttgttgatcttttcaaaaaaacagctcctggattcattgatttttttgaagggtttttgtgtctctgtttccttcagttctgctctgatcttggttatttcttgccttctgctagcttttgaatgtgtttgctcttgcttctctagttcttttaattgtgatgttaggttgtcaattttagatctttcctgctttctcttgtgggcatttagtgctgtaaatttccctctacacactgctttgaattgtgtcccagagattctggtatgttgtgtctttgttctcattggtttcaaagaacatctttatttctgccttcattttgttatgtacccagtagtcattcaggagcaggttgttcagtttccatgtagttgagcggttttgagtgaatttcttaatcctgagttctagtttgattgcactgtggtctgagagacagcttgttataatttctgttcttttacatttgctgaggagagctttacttccaactatgtggtcagttttggaacaggtgtggtgtggtgctgaaaagaatgtatattctgttgatttggggtggagagttctgtagatgtctattaggtccacttggtgcagagctgagttcaattcctggatatctttgttaactttctgtctcgttgatctgtctaatgttgacagtggggtgttaaagtctcccattatattgtgtgggagtctgagtctctttgtaggtcactaagggcttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgccattttttgttttccgtttgcttggtagatcttcctccatccctttattttgagcctatgtgtgtctctgcacgtgagatgggtctgctgaatacagcacactgatgggtcttgactctttatccaatttgccagtctgtcttttaattggagcatttagcccatttacatttaaggttaatattgttatgtgtgaatttgatcctgtcattaggatgttagctggttattttgctcattagttgatgcagtttcttcctagccttgatggtctttacaatttggcatgtttttgcagtggctggtaatggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgcaaattcttttctttaagaatgttgaatattggcccccactcccatctggcttgtagggtttctgctgagagatccactgttagtctgatgggcttccctttgtgggtaacccgacctttctctctggctgcccttaacattttttccttcatttcagctttggtgaatctgacaattatgtgtcttagagttgctcttctcgaggagtatctttgtggcattctctgtatttcctgaatttgaatgttggcctgccttgctagactggggaagttctcctggataatatcctgcagagtgttttccaacttggttccattttccccgccactttcaggtacaccaatcagacgtagatttggtcttttcacatagtcccatatttcttggaggctttgttcgtttctttttattcttttttctctaaacttctcttcttgcttcatttcattcatttgatcttccttcactgatatcctttcttctagttgatcgaattggctactgaggcttgggcattcgtcacgtagttctcgtgccatggttttcagctccatcaggtcttttaaggacttctctgcattggttattctagttagccattcatctaatttttttcaaggtttttaacttctttgccatgggttcaaacttcctcctttagctcagagtagtttgatcgtctgaagccttcttctctgaactcatcaaagtcattctccatccagctttgttccgttgctggtgaggagctgcgttcctttggaggaggagaggcactctcatttttagagtttccagtttttctgctctgttttttccccatctttgtggttttatgtacctttggtctttgatgatggtgatgtacagatggggttttggtgtggatgtgctttctgtttgttaggtttccttctaacagtcaggaccctcagctgcaggtctgttggagtttgccagaggtccactccagaccctgtttgcctgggtatcagcagcggagctnnnnnnnnnnnnnnnnnnnnaacagtggatattggtgaacagcaaatgtagctgcctgatcattcctctggaagttttgtctcagaggagtacctggccgtgtgaggtgtcagtctgcccctactcggggatgcctcccagttaggctactcgggggccagggacccacttgaggaggcagtctgtccattctcagatctcaagctgcctgctgggagaaccactactctcttcaaagctgtcagacagggacatttaagtctgcagaggtttctgctgccttttgtttggctatcccctacccccagaggtggagtctacagaggcaggcagacctccttgagctccggtaggctccactcagttcgagcttctcagccactttgttaacctactcaagccttggcgatggtgggcgcccctcccccagccttgctgctgccttgcagtttgatctcagactgctgtgctagcaatgagcaaggctccgtgggcgtaggactctccgagctaggcacgggatataatctcctcgtgtgctgtttgctaagactgttggaaaagcgcagtattagggtaggagtgacccgattttccaggtgccatctgtcacccctttctttgactaggaaagggaatgccctgaccccttgtgcttcccaggtgaggtgatgcctcgccctgcttcggctcacgcttggtgtgctgcacccactgtcctgcacccactgtctgacactccccagtgaggtgaacccagtacctcagttggaaatgcagaaatcgcccgtcttctgtgtcactcatgctgggagcagtagactggagctgttcctatttggccgtcttcgctgttatttttaagaataaattttaaaaggacaaagtaaaactccaagttgaacttaatggcaaggaagtgtcaaaatgagactctgcatgtaactccccatgcctctccactactgatatggatctgcctggtccacatcatcctggagtgctagggtgaccctagcactgtatccagctcttctcacctctttaggaattttaagcccacaaattaagtatggaatttattacatggtatcttgcatttcagaagcagaatctgagatggggatttttgccagagatttattgggggagtgctctcagaagtgaggaaaacagaaagggacagagaaaaaaatgttgagtaaggatgtggtctcaggaaaagtctagcctcagcctgatcccgtgcagaagctctggagcagagcttatcccacccagcagcaagggggatggggtgttatcctgctgcatctgccagctagggaatggggcaggtattagttttctaggccacttcaaaaattacaaatttagcagcttaaaacagcataaagttactatctcacagtttttgtcagttaggagtctgagcatggcctgcttagcgtttcacaaggccgtactcaaggtgccagccagatcttttatgcggcttggggtcttgctccaggctctcatggccgttgctggaattcactcctgcagctgtggagcccagggtgacttgcttcttcaagactagcagaagactctttttgctgcttctagtctcttagctcagccttccagtctcttagctcagccttccagtctcttagctcactgctctccaaggattcttgacacttgcactccaacccactctgggtcagaagctattcctccctgtgaaaggggtcacttgagtaggccaattcacgccatcctttctgattcactcaattgagctgattcagaactttaattacatctgcaaactcccctcacctttgccatttaatgtaacatcacaggagtgagaaccatcatatgtccagtccttcctaccctcaaagggagaagattatacaggggcatgggtcactggcatcattttaggattctgcctgtcacagggcgtcacttgcaggcttcgctggaggagatggctcctgtcacccaagggcagttctcctgagaaagttgtgggcataagcaatgcatgtagcggctagggcactgaggtcccgtgacctggttccagcctgctctccttccctgtccatagtccctccctgcccctcccccgtgatcttgccccacagacctttctcaggtggcggtggtgatggtgttgtaggggcaactggcttttttagagtgtcaggagctctccaaggtgcttgacatccatttctctaatcttcacaacaagcatgcaaggttgattctgtcatcccattttacatctgagaaaacaagctcagagagagtaagtaaagtggccaaggttgcagtttgcaagaaatggagcttggaccccctctgaccttgaactggctgacatcaaagttgtcgctttgcctggtcctgtcacctctcttcctcagatgtctagtgtttattagacctccatagtatcttcaccaactgagaaggtgccccatcagcctgaggaactcccagggtcacccctctacaaggattcttgacacttgcacttctacccactctgggtcagaagctattcttccctcattggattgccaccattcttgtaagggcaccttctctgcaccacagttttttgctcacactcctcctatttttctcttctcagcttccctatgcctcatgatgccaggcataaggcacacagcaaccaagtgttggcagaaggcaaattatatggtttggctgtgtccccacccaaatctcatcttgaattttagctcttataattcccacatgctgtgggagggacctggtgggagataattgaatcatgggggtgattttccccatactgttcttatggtagtgaataagtctcatgaggtctgatgcttttataaggggaaactcctttcacttggctctcattctctcttgtctgctgccatgtaagatgtgccttttgccttccaccatggttgtgaggcctccccagccatatggaactgtgagtccattaaacctcttttactttataaattacccagttttgggtatgtctttatcagcagcatgagaacagactaatacaccaattgaggttcctccagagaattaacaaaatgtccatgcactctttcgttgttcccccatacccacagacctgccatccctggccctgcctggatgccggtacctggccactgctgctatattccatgcttttggacaagagcatgttcagtattgtccaggagacccagggagctcaagacagagctgagatccagttcctacagccacagttaacaccccagcccccgacacacacacagacttttcaatgcaaaatcaaaccattcccaaatatccagctacatattgttttacctttgaagagaaaaaagcatcagtggggttatgtgattttcatagatgaacaatttttgcaaatatgttaattgaagagtaattggtgctttcttgaccctcctgagcactgatgcttgccaaagggttatacatttcagactaatgatgatatccattactatatgtgcaattgcttataaactaatatatagtcatattaaaatctctaatctgattgagaaattttcagaaacaaggtacactgattttctcaccacttatttcctgctctcatgacagaatttctggagttctttgaattcacctggtttttggagctctgtcaagtcaatatttataactgaactagttcaaacagttcaagcattgtctcttcctttctggttgaagttctgtcttagaagactgttgtagtcagctgtgcttgtcataaagttttgtttaaaattattttagaattttcttctttggctttaatttaaatttttgtttgtttacttttttttttttttttccccggctcactgcaagctccacctcccaggttcacaccattctcctgcctcagcctcccaagcagctgggactacaggcgcccgccaccaggcctggctaatttttttgtattttttagtagagacagggtttcaccgtgttagccaggatggtctcgatcttctgacctcatgatccacctgcctcggcctcccaaagtgctgggattagaggtgtgagccaccgtgcccagccttgtttactttttaatttataggattgtaaatgaaactatacttggcctcagtttattctctgggaaataggttcttgctacaggtacagtttataataaggatttatttcataatagggagctttttatagattttaatatcatagttgccatttaaaaaattgtattaaaggccgggcgcagtggcttatatctgcaatcccagcattttgggaggccaaggcgggtagatcacctgagattaggagtttgagatcagcctggccaacatggtgaaaaccccgtctctactaaaaatacaaaaaattagctgggcgtggtggtgtgtgcctgaattcccagctactctggaggctggggcaggagaatcacttgaacctgggaggcagagattgcaatgagctgagattgcgccactgcactgcacagagtgaaactctgtcaaaaaaaaaatgcattaaaaatggtaatgatcaccatttattgcttgcctacagtatgtcagtcattatacaaggtatattttataattataaatattatttattatctgattacaaatatgttataccttgcactgtgtcctgtatgtctgttatgtttatttctgaattttccttcctttttcctctccatgctttgatctggatatttcctattgagagaatacactgaggcccagtgtgatttcattcacaatcctataaattaaaaagcaaacaacttctgggtcactggtcgtcttttctgctgtgttcaatctccagtaaaatatgtcagcaccttaaccactgtcctctgcctggtttcttagtctcacagccccgtgctgctgtagaattggcagatgccttgaggacaattgtggcgtacagtaaacatacctcaatatacttatttctgtttgggattttcgcccctcaagtcctcattgcgttattagccctgagctcttaagttttgtcttcacagagtcataagacttccagaaattcagcttagaaactcaagaacttagctttttagccactgcttcactttcagtttcatagcctctcatcccacactgcttacaaatctggaaacacctcaagggaaaagtgcccataaatgttggggttacctccacattctttccttctctttgggaccctatactctgaagtcctggctgtcttgatagttagttccctgataactttatatatttttaatttttttaaatgaacctggcatttcaaacataagttccatgataattttaaacaggggtgtgtgtgtgtatgtgtgtgtgtgtgtgtctgtgtgtgtgtgtgtgtgtgtgtccagcttttcgagttgtccgtgggaggacggtttcagtaagttactctatcattactggaaatgcaaaatcctgttttcttttaaaagagtcttcaagctgatgaaaattttaaagtagcttataacattttaactgtgatcttatttattatgagtatagagataaaggaaaaggcatcccacttctgaagatttctcgtttctaggagtgtctacaagattatcataggtgaaagtagggttggatgcagagaaatagtaagaaaggatggaggatggaggggataaaaagatcacatgtttggtgaatcctcttttaaaaacacttagaagattttccctaaactaattatctggcttaatgctaactgcttatttgctgaccttctgctttatttacaaatttaaagtggggccaacccttcctgttttcctttaatttaccccggcagctgctggttagctaaggaagaaaaaaaacccttttttttttttttttttttttaatggagacaagcagcaattaggtaggcttctaggtcaggtggccagttaggggtgccagggttcccaggtccagctttcttcgggtcatagagtgagggtgggaatcaagtcactcagatatttctcccgaattgaaatgcgtgtcttcctttggctgggcagatgaggtcccctcttctccatctctgctgctgggtcctggtgcaagcccttactctctttccactaaacccatgtggcagcctcctccttagcctgtttctccccagtcctgcacccatcagtccactgccacacggcagctacagggacctttctagaacacagcctcctgctgcctccatgttggcctccctgcccctgtcagagggatttttatttattttatttatttatttttgagacagagtcttgctctgtcacccaggctggagtgcagtagtgtgattgcagctcactgcacctccgcctcctgggttcaagcaattctcctgcctcagcctcctgagtagctgggattataggcgtgctccaccacgcccggctaatttttgtatttttagtagagatggggtttcaccacgttggccaggctggtctcaaacttctgacctcaggtcatccgccttcctcagcctcttaaggtgctgggattacagacgtgagccaccatgcccagccaagagggacttttctataacagcctctaggatcatgctacccccttcccagctctccctagcttttaagatcacataacctgcaaagtgccctgagatctggttctgcatgaatcttctctaccctattgctgcctatcaacttgacttcccacctttgggagtcagatgcagtccgctggacagcccatgccctctccatgtggctataccacccctgccttgcccctgctctctgcctgatgtcctactgtcttttgactgtgcccaggggcatttcctctgggaagcctgccagccctcagtctgaacctttgggtccccaaagcctcccctgtcctggtatgtgttgcactgcgttgtcatctcttgtctgtttcccctgagactcattattccctgaaggtctttcatctctgtttccctgtggcccagcacattgcctggcataaagtaagcacccaataaatttcagatggagcatatgttaagttccctataaaacctcagctgctgcaaattctgccaccagcctgggtgttctcctctgtggggactccttcagttttcagagacaggagactcccatagatttttagcaggaaaaggtagattcttgccttttagtctgtcagaatgacactttattagatgctttagaactgcagaagcttcaattttagaattttcagtttgtagcgttattttttttaagcagtaaaatttcagcgactatggtctgtgccagagccctaagcctctttctccatcctaaggagtttctctgcttaattgcagtgctgagctcagggaagctgcatatccaaaaatgaaaaggaaaccgctaaattgtgctgctacttttcctttgcagctcagataaaacaggcccagtgtgggaagaaggggctgtccttttgggggtgttggcctgtttctaattgctgcaccctcctctgcctccacccatgcctcagtgtggtttgggtcccttctgcccagagctactgggacatgtaataagaagctgcttttcagacttcttaattaaaataggttccggcagccattgccaggaagcagcattcgcacccctacatgtccaaatgcattactcatccaaaataagatatgccacgactcaggtttccctccttagccaccatggcttgaatggctgcatttagaaacagcccttacttcaagcccctatttcttaattatttgtcacttattcgcattcatccttgtgtgtgaaacatttttcccctcaccctatatgctgttatgtaaacaagtaattttttaggatgatgtcagaacctgatgtagttggggtggttttaaaatagtattttatggacagcaagaaaagtagttttgcttctggtttcacttgctagctttgggatggagggacatttatttgagcttctgcacctctgtgatcttgtctataaaacggggggcaatggctggtgctgtggctcacacttttaatcccagcactttgggaagatgaggcagaagaatcacttgaggccaggagttcaagaccaccttgggcaacatagtgagaccccatctctacaaaataaaaaataaataaaagaaataaaagaatgaaagttagctaggcatggtagtatccaactgtagtcccagctactcaggaggctgaggcaggaagattgcttgagcttaagagttcaaggctgcagtgagctatgattgtcccacttctgggaaacagagcaagactctgtctcaaaaaaaaagtggaaggtgggggtcaataatctgccagctcaggtattgtaaggattaagaaagacagtgtctgtgaagagcttggcccagtctctggaacacatttggtagccaggaaatagtaaatgacttctgtttccctacccccatcttcacctcctcccctagaataacaacatcataactgacttatttcatcattaaggatttaaatgcaaaaccttaagatagtcagccttagggaaacactgaagaatttatttttaaacacataaagattgcattcattcatccttctccacaccgcgggcagtcttcaaattctggttagcagagtcagcgggcagggaggatctggatcctggggttgtgtgctttgctcccagaggacatgagtatcaaaggtctgccccgatatctggagttcaagaggcgttttctggaaacaatttgtccaaaggctcccctatcactctcttggagaagtcctgtgttttatttatgctgaatgattgaatctattcccagccgaatgttttcctgaacaccagtaaaaatcatctgccagtcactcgggctcccaccccgggagtcatctgtcccctttgcctggtctcccatgcctcacagctcagcagccacaggcatggccatatctgcctctcttgcccttgccactccacttcatcatggccgtctcctctctggggctgctgcgggagatttccagtctgccctccagtgtctctgcatgcattctactcacctcctctccccccgcagccccgaggaactctgaagaaacacaagcttctgtggccccgtacacgtaggactaccaccgcttacttggaggcagtggcagtaaaaacggaaacaacaaacaaaacagaataaaatcctctttaactttgtttaacttggtgtcccatgcagtctatttaatttcagactcttatttaccccagtcctagggaactgaggttcataggaccaatctgggtgaatgctgctacagtttgtggatgggctgctccccatttgcttgttcaggtagctttgagcccaaacattggtcagcaagggcatccatatagtgacatgctgtatgtcatcaaaaagaaggtgttcctgacatagacaatttccagaatatatgctaagtgactaaagcaaagtgcagcatgagatgccaccatgtgctgcagatgcttggactggatggatacctaagtacccccaaactggcaggcacatctgcctctggggaagggggctgggtgtcggggaggggtgggagcaaattcctccccgtgtgcctcctggggcctttagaacctctacttctttgaacacagtgctactctgctccaaacgcccccaaacttcacacagagagtagtatgaagtcctcatctctgcacttgtggccctgaggttggcctcagcctgcccgcccagcttctcttctcattcttccctgctgccactctcctgtctccccagggactcggctgtttgagccactttcctttgacacgtctcagacttgccctgctccacttggaagtccttggagcagcccacacgcacccccgccgagctcactgtctcagaatgtgggaccacctaccagctttactcctgcgtctaactctaacttgtgagattgtgggggccagagtccccaggaggcagtgacgctgtgtgcagaaaagccaagagctccagggctgaacagatgtgactgaaaatctttaccagccatgtgccctggggaactgagcctttcatttcccctttccttttctgtatattggaggataacaagccttcactcacagggcgtgggtgtgtttctcatctccttgcagcacctagcacagtacctggcatctcatatgttcagggcatgtttgctctcctcccttcctttcccatcgtgactgtcaatcgactgttcccttggggcttgagattcttggattccaaaggaaagaacacagggccaggagtcagaatttcatccttgcctccgctgatgtctaattctgggataacgctgggccactcagtctttggattccctgccctaacacaaaatccatatttatctcaatgcaaaagagatgtggtcatcgaaacactgaatgcaaagggttagcagagtgagcacagatgttctcccatttgccaactggtttctaagaatatttggaggatgagtaaagtaatgtcttccatatgctcaagagaagatgatttagcaccatgcaaggtagagaaggagagcccccacccatcaacagaatgaccttggacaagacactagctgccctaggcctcaattacctcatttaaaatatgaaagtcataaaaccctacctcacgagggtgattgtgaggattatatgaggcaattcatgtagaaggtctttgtaaactgtgaaatgctctacgactgtcagccaggattagtagttaatgcacgtatttgtttattgtttcagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcaggtcagaaccttaaagctcatactcagcacccaaggtggcagctgcacagagcagaaataatggcccaaaagttgagagagccgtgggcctggctgctcaggagaccgcagccaggacacacctcctctctgggtctcccttttctgatctgcaaaatgataaaataaacagtcttaggggttacttgtgactactgtgggacttaaacactttcagacaattctcaggctgttagaagttacaatcccctcgagttcgtgaactggctggccacttggtccctgaacttgcctctgttcctagactgttttcagagcttagattggtggatagtaggtgcttaatgaatgttttattggtgggagaatgagtgaggtgaagaagcaagaatggtagcttgctgaattggcagttgagttacagaatgctcaacccaagagtccctggaaaccagagcactggggcaagtacaggtggtccacactcatcagattctgggatgtgcggctgtgtagagaagctttagtgcgatgggtgtatcactcgtatgaagtaggagtgagcctgtgcctgattttgtgcagcagcgctggccagctctgaggcgtgcagcactgagtgcggtgcaggaatatgcaaggaatctgcaatcccaagtctgtttcaaatcttttcttgaaacccaagatcaccacagattcagaaccctgtggaagatcaggaaaaactgtgggctaacccagcctcctaggcagggttggggcaaagctgtggaaccacctttcacagtgcttcagaccactgtaagtgtaggggaaaactagcagattgtgacccatgccttgtagattagagttgtagactgaaccacagagaagggtttgggatttgagatatccatccaggtgttcacgtaagtgctgagatttttaccaaggcatcgcattatctcccaaagcctctttcccatcatcctaagtggggttccctagaagcagagcctgagaaagggaattgggaacacatggtctaatgatgctgtgctcttagggaaaacctgtaaaggaaaggcatgggggctcaaaatggttgtggtctcagataaagtctggctgagggactctggaacaaaaattacaccaaagagttgtcctcaccttgaggcaagaggggcttcccttttgtgccccatatcattcagccattgactggctgtgggggggaagggaagtgtaaccctccttgaaaggagatcccctcagctgaggatggttctctagagaagaatgcagatgtgagccataagcagcctacacacacatcagccaggagatgggccacagttcacagtgcccactacacatcaaaacacaccctctggggaatgctgccaagaggttttgatttaaaacacgaaccttctttcacaacacaagtgccccaggagagtggcctgtaagtcccactggccattgatacttggaacaggccctgggggagtgagggaggacacgtggtgtctaagcaggtgggcagagtagatgggctggccttactctgaggtgtggagaaggctagagaagagtagaagataaggtgaagaggcagggcaggaagctgatggcttctgccttgactgggaagtacagacctgggtcccctcctgacagggaagtggggagaagaggttggcctggggacacagtaaagcatggtattatggtaacttctacataattggtctctagttctagaattattctgctttctaaggtcaaatcttactggactgataaacttacccatacttgggttacggaagttacccagactcggggtcctgggaagaatttcagggtcctctgtgcttatttgtttctgaattgacccagtgaggtagtcatctaccctgtccagcatcttgctagcctggacatactttccacagtgaacctatctctcattcctgcaagtctgtcagtggcacagatgtggactttctttagtgaaaagcatcttggaacctttactgacatttttagatttaagcagcccaatcaaagccagagatggagggacagattagtattgaaatgatgttcttggtcacttctggttccagatggccaaccaagcacaaatgttgatgtctgtgccttctggtaccccattgcaatgattataaatgagtagatcggaacagggaggacaacactgtgaaagaaaggcatcagctaataataagagtccagtaattttctggtatgagtgaagtaaatggaagagtgttagtgggtgaacttgaactgtacatggaagagctggcttcctgcctacccagggaacagagaagctgcagccacagccaggccaacagttacagagggggccagagtaagaagtgggactgcaagtggtggtggtattgagggaggtcagtgaaatgtgaaggttggtatgaagaagggttagagttgacttttcaccattgtccccacccctacaggcttcaggcatgcagaatagcaagcagccaggcatcgccttctctaaagtgttaagtaaactgtttaagatagtgtgggcgacctcgttctcagagaaaagaaagccttacttctggcatttgaagtcaccaacgtaagagctagctttctctcccacaatccacccaaacactttcacagattttctactcagtccttttaccttagtttgaaatatgaatggacaaccaaggaaacccaagattgaggaatatttggtgcatgaaaggaaaggctaaaataaaccaggagaataactaacttaaaaggaaacaaatgatttagggaatataagagattattttaaaaaattttaaaaatgcaacaccttaatgtctatgcagtagacccaaggagatttaggaatatattccattcttttcattttctaatggatgggattctgttcctttttaaagggaggaatgaaaggcaagggaagtgttcttaaaaattaaaaatatatttgcagcaccaaaaactcagtggaagtattagaagacaatggtaaataatttcccaatggaagtgctaaaagacaagtagaaaagaaagctaaagaataaatttacggggtcctatatctccaagtaataagaatactagaaagtaagaataccagtaataagaaaagagaaagaagggggagaaaattatgtaataatagaatagcatgtttcagagttaaagagggagactattttttaaaattggtgtaaacaacaatttacaatcaaaataaaccaaaattatcatagacacatcattttgaaatgtcagtgcttcaaagacaaagggaaaattctaaatgtttcgagggcaaagaatgcaggaatgttgatcatggaggataagtcagcttacaacagaatgagagtcagactgagtagtccattagactttttataagcaagattagaaactaaactatgatgaaataaaggcttcaatgttctgagggaaaatgattttgaaattagaattttgttttcagccacacaatcaaagtatgtggtaaaaataaagtcacttttcagataagcaagaacccagaaagtttacctccctagtaactcttccaaggaaattatcttgtacttcaacaaaacaaaaatgacaaccagaaggagcaagatgtgggatacaagaaactctggaactaactctcaaaagtctaatgacaagaaatcccaggatgataactgcagcaagtctaaaaagcagccaagtctattgagaagaggagatcaattaacttccagaagaatgaagctaagcaatagaatgatgagcaagtggcaaatattcagtatatagtgcagattgaatatgtttcttttatgggtaagaaaaaaataaaagcattcaagacctctcagaaaaatagaaataagataattacctgtacagattctccttgactcacgatggggttatgtcccaataaacccatcatgaattaaaaatattgtcagttgaaaatgtatttaatacacctaacctgctgaatatcattgcctagcctaccttaaatgtgttcagaacacttacattagcctacagttgggcaaaagtcatctaacacaaagcttattttacaataaagtgttgaatatctcatgtaatgtattgaacactatactgaaaatgaaaaacaaaatggttgtatgggtactcaccattaacacacacagctgaaagcacactggacctaaagaatatttgaactaaaattaactgctggattatggggctactagtgtaacagggtcatccatttctctctcttctgatgagtctcaagaatagctggtagaagccactgcggtattaacactcgttgatggcttagcaggcatggtgttctgtagaaagctatcagttgtttaccctcctaatcctataactgactgggacctgcagctcactcccactgcccagcatcacaggaagtattgtaccacatattgctaccctgggaaaagcttttgaaataaaaaatttgaaatatggtttctactgacatgcatactaccttcacaccattgtgaagtcaaaaaatcgtaggttgaaccattatnnnnnnnnnnnnnnnnnnnnttaaaatataaaacaaattaaaatgtgataaaataaccagttataactatcagatgttttttgtaagcctcatggtaaccacaaggcaaaaacctatagtaatacaaaaataaaaataaaaaagcaaagtaaccaaaccataccactagagaaaatcacttgaccacaaaggaagatagcaagaaaggaagaaaggaacaaaggatctacaaaacaactagaaaacaacaaaattgcagtagtaagtccttacttatcaataattatcttaaatgtaaatggattaaactctccaatcaaaagacatggagtggttaaatggatttaaaaaaaaaaaaacaaaaaacaagacctaactatatgctgcttataagagactcacttcacctgtaaggacacacataaaatgaaagcaaagggatgaaaaaaattctatgcaaatggaaaccaacacagagcaggagtagactttaagtcaaaaatagactttaagtcaaaaactgtaaaaacagacgaagatcattatacaatgataaagggatcagttcagcaagaggacataacaattgtaaatatatatgcacccaacaccagagaaactaaatatataaagcaaatattaatagatcttatgagagagttagattgcagtacattaatattagggaatttcagtaccccactttctgcaatggacagatcatccagacagaaaatcaataaggaaacatcagacttaaactacactctagaataaatacgtctaacagacatatacacaacagtccatccaacagcgacagaatacacattcttctcaactgcacatggaacactctccaggatggatcacatagtaggccacaaaataaatcttaataaatttagccttgaaatatcaagtatcttttctgaccacaatggtataaaacttgaaataattaacaggaggaacttcagaaaattcacaaatacgtggaaattaaataacatggtcctgaatgaccattgggttaatgaaataattcaaagggaaatttaagaatttcttaagacaaatgaaaatggaaacacagcatacaaaaacttaaaatgtggtaggattttgagtaagtagaagagtataaagaagaatgttgatcctagaaatattctatctgaagtagaagttgaatattcctggactttaactttgcaactgtagaggaggatgtataatcatgacacttgtcttggctcaactgtgagcaataatcatgaaccataataaaattagcactatttattggttttcaatatttataattaagccaaaatcagagctatggtgatagcataaaatgcaaatgtcattaaacttgattatataaaggtaaaagtagaataagataagttttcttaatatcttaatcttttaaattgatgagtcaagagattgcaaaacttgatgaaacaggaaatcactgttggcttaaaattgcagaggtcatcagtagagcaacacttcctaaagtgtgattcctgaaccagcagcatcaacctctcttgggattttgtgagaaatgaaaattgtttttattttattttattttattttatttttttcctaaatttcttatttccttctctttttttaaagttttattattattatactttaagttttagggtacatgtgcacaacgtgcaggtttgttacatatgtatacatgtgccatgttggtgtgctgcacccattaactagtcatttagcattaggtatatctcctaatgctatcccacccccctcccccaaccccacaaccgtccccggtgtgtgatgttccccttcctgtgtccatgtgttctcattgttcaattcccacctatgagtgagaacatgcagtgtttggtttttttgtccttgcgatagtttgctgagaatgatggtttccagtttcatccatgtccctacaaaggacacgaagtcatcattttttatggctgcatagtattccatggtgtatatgtgccacattttcttaatccagtctatcgttgttggacatttaggttggttccaagtctttgctattgtgaatagtgctgctataaacatacatgtgcatgtgtctttatagcagcatgatttataatcctttgggtatatacccagtaatgggatggctgggtcaaatggcatttctggttctagatccctgaggaatcgccatattgacttccacaatggttgaactagttgacagtcccaccaacagtgtaaaagtgttcctatttctccacatcctctccagcacctgttgtttcctgactttttaatgatcaccattctaactggtgtgagatggtatctcattgtggttttgatttgcatttctctgatggccactgatgatgagcatttcttcatgtgttttttggctgcataaatgtcttcttttgagaaatgtctgttcatatccctcacccactttttgatggggttgtttgtttttttcttgtaaatttgtttgagttcattgtagattctggatattagccctttgtcagatgagtaggttgcagaaattttctcccattctgtaggttgcctgttcactctgatggtagtttcttttgctgtgcagaagctctttagtttaattagatcccatttatcaattttggcttatgttgccattgcttttggtgatttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattggtctatatctctgttttggtaccagtaccatgctgttttggttactgtagccttgtagtataatttaaagtcaggtagcgtgacgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacgatattgattcttcctacctacgagcatggaatgttcttccgtttgtttgtatcctcttttatttcattgagcagtggtttgtagttctccttgaggaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagagtttgctgaagttgcttatcagcttgaggagatatggggctgagacgaaggggttttctacatatacaatcatgtcatctgcaaagagggacaatttgagaaaattcttgggcccaccccagacccactgaatcagaagctgatggggtgggccccagcaaactatgtttttgtttttgtttttgtttttgtttttgtgttttgagacaaagaatcctctgtcacacaggctggagtgcagtgacaggaactcggcccactgtaacctccacctcccaggttcaagtgattctcctgcctcagcctcctgagtagctaggattacaggtgcacgccactatgcctggccaatttttgtatgtttagtagagacaagttttcactatgttggccaggctggtcttgaactcctgacctcaggtgatctgtccgccttgacctcccaaagtgttgggattacaggtgtgagccaccgtgcccggccagcaatccgtgttttaacaagatggctgggtgattctcatgcagctaaagtatgagaactgatacagtagaggagttaaactaataatttgcccatcaaaattatggaggtgaaggagtggggatcgttatgtgagataaattcctgtctatcatggaaggaatttagtaaaataatgtctagatctgataaatcaacgagtagtagtatcagcatgttttctagagatatggaaataatcatcaaaagaaacataaacggacgtgggtaataatgagtaataatggttgcccctggagaggaggactcagtatggcgaggtatgtggcagggggttattatttttctaaccatgtgattctttggttgaaattaaaataaaagaaaaaattgttcttagattgggaagattgtccaggagcctgagagaagttctgggagagcagttctttcttattgtccttttcctgattatggggaaaaaaaaaaaaaaaaaaaagataatcttccagatgttggctcagtttgaggaggaggaaagattctgagagtgaggcccactgcaggaagcagagctgatctttaacctgtgtatatatacacaacagtttgacacagagcatctcacctctttcataggaaggaataaattcatcagaactctctaggtcatgttgccagataacattagggttccactactttaaatgccttgatctcttcactgagcccatgttggtacccaggactatacagaagggtggatcaaatcatgatgaccttttagagttggggtctgcccccactgatggcctaattaaagtggaatcgctgcacagactgtgtgtgtaacatggagatagtgaccagtacatgttaagtacaggcttactgattaatctgaggctttttgctatgagttaggaatgtgcaggacaggcaggagaccaagccttccctctatagggtacatagtcctgggagaagacgggttccaggatagggctttggcactaggctctggtgagtgaatagtgggattgctgctaatgctgagattggattgggattctgggcgctctggggacggtggagcttgaatgctacaagcctccgtacatacagcctgatgggcacacattgcaccttcaaaatttaaggaaagcaaagacctgcatctgtctcatcagaaagggaggcatatttgatagcaggaaaaagacaacctttttttcattaaccagaggagtattttaaaagactataaagctggaagcaattcaattgtgtgtctactttatgtaagacctcgatgaaaaaataaatcattgctgccttcattggagtcacagacagtccaggaataatttacaaagtgagatttagattagtgtgtaagaatttcactgcagaggccacttctggctgaggagaagatgttctatggagaaagggagaattggccagagccttaaaggtggagtaggatttgggtcctcagggaatggaggggctgatggatgctaaaggtctctcacgtggctgaatatctagtgagggaaaggggagaggccatctggactggagattcagtcatgcagtctgaagccacttgttcactggctgaggagttggatgtgattctacggtggacagaccatggcatattttgcagtttggggagatcgtagatgtgcctcagggagattggtgtgcctgggtatggggaggccagttaagaaagagcttgttgcaggggcctttgcaggtgagtccctggggagtctgtgtgataccccccagagagttgactcctaattaattgctagttggtctcagctgctgaaacagagggtatggaactaaatgaaacaatcatgggaagtcctggctggtctgtgtgctgggaagggagcaatgctgtccttggactggtcacctgaaggtcctttatccctcctcctcagctgagcataccaatggtgatgacagaggccctgtcttcaatccctgtacacagaatagcgctctgaaaattataactcttctcacgcttcatcagcaggcccccaaagagacctggctacagcagggcttccaggtctttcactgcggtaggcagaatggccccccaaagatgtccatgccctaatttctggagcctgtgatttggatacgttacatggcaaaagggactttgcagttgtaattaaggtgatggacttccaaatggggagaggagcctggattttccaggtgggtccaatctagtcacacgagcccttaatagcagcaaacttcctccagctggaggtgggaggaatgaggcggaataggaggtcagagagacttgaagcatgcctttgctgatgttgaagatggagtatgtgatgtgacgagaatgtggacaaccttaaggggctgggagaggcttccaggtgactgtctgcaaggaaacggggcctcagtcctacaaccacacagaaccaggtgcttccaaaaacccgaacaaagctggaagtggattctcccccagggcctctagataatcgtccagaccagctgacaccttgatttcggcctgtagaacctggagcagacccagacaacccaccgacctctgacttacagaactgtgagataatagatttgtgttattttgagcagctgaactccggtaacttattactgcagcaatagaaaataatagacacacaatacagcccacacctccagaaccccggggcttctttcctccctgggctctctggggaaggagcacaggctgtgcagtgagatcagggccctggcccagagcactcaccctttagagcctgtttcctcacctgtcactgggggtgccatcggctgctctgcctgcctctgggtggtggtgggattacatgagggaaatgtgagaagcccggaaatgatgaggcagcactggatcctgctgttcccttcctgggaagccggcttcctggtgttgtgaggagaggatgaggccgtcatgggagcaggtctgacctgggctctgaggaagcaggtgctctgctgcctttccacatcctttcctctgaggggggtcccgtctctgcaggcccgtgggtgggctccccggtgggacgcaatggcaccatcttaggcaggagtccccaactcctggatcagtaccagtccggccacacagcatgaggtgggcagcgggccagcgagtgttaccgcctgagcgcccctcctgtcagatgagcagaggcattagattctcacaggaacatgaaccctacacatgtgagggatctagattgtgccgaaaccatcccgccccctccaccgtccgttcatggaaaaattatctttcacaaaactggtccctggtgccataaaggttggagaacactggtctaagggttctggcaggctctcagatgaacctctctggatctttagggtgtctggccctcacgtgtcaggcccaaagatgcctgttagtctgtcgcagagggagaagatctggggaggacccatataaccagaactcgggagccagccgcaccaccatgagcccagatagcatgagtcccttctcttttctccatctctgctgccattccctaggccaggccaccatcatttgtcacctagaccaggtcacatccctgcataacctcctcccgctgaggagctcccttccccctcagaagaaaatccggacacatgctaaggcccacgagagcctgtacagtggggctcctgcctcgccagcgccacccgcatactgcattcccaccaccctcaaacttaccaggcctctgcctgcctcaggccctttgcatatgctgatacctcatctagaaagcactttgccatgcttttcccgtggccagctcttcattttttaggtctcagcctaaatgttgcctcctcaaagaaccattctcccactaccctgtatttcctgactcagctgcctttctttgttttgacacagggtctcattctgtcacttaggctggagtgcagtggtgtgatcatggctcactgcagcctcgactttccaggctcaagtgatcctcccacctcagcctcccaagtagctgggaccactggtgtgtgccaccacgcctggctatttaaaaaaaaaaatttttttttctggacacagggtttccccatgttgcccaggctggtcttgaactcctaggctcaaggaatcctcctgcctcagcctccctaagtgctgggattacaggcatgagccaccgtgcgtggccttagctgcctatttgattccttcgtgacatctaacagaacgtgttatttcgtctacttgttattgtatttacctctctagaatggaagcccagtgagggaagggatctattttatcttatttgctattgatccgcaacacctggcagagaacctggcctatagtggatgcttagtaaatagtaaatagttgaaagagcccttctggaagaacacaaggctagttcctttggcaaaaattgggcatcatatcagagcttcttcactagcagattcagcagagctataaaattaaaagaaatgtgttctgtaatccctctgggaattccccacgggcaagagagcatgatgtgtgatttgcagtgacatatctataccacggtatgtttgtagtgactacttttcaaaagacaagatggaggatatacagctggtgaaagaaaaggtgtcggctttgttgagaagtcttactttgttgtctttcaagtgaaaagtgagctattttagtctaatggtaatttttaactatgttgaagccatacactttgggtctccattgtgctggaaatcgtcactacagctcctcccaccccacacccctcaatgcatgcatataggaatatagctcatgctatggaaatccactgtttgcacagcctggacattaggtaatagtttcccggctgaggtgcccagctggcttaacatgccattatttacagctctaaggtttattttcattattatatttaaacgtctctgcagaaggaatggaaggctaagagggtgggagagtagaagaggagagggagaagagtcactccagacgtcagaaccagacaggctcctgagaccgtgcaaactgggggatttcagattgcacacttggagtcagggcagcagtttggctcagcaggaggggaaaggggtgttagaggaaaaggctcctgccctccaatgttgtttgacccagatcaaccctactcttatgggtatcagcttctgggtaaatactcttttcaaagagggcaccatggcagaacacatgtgaaaaccatctagtttgaagtatgtgtgagaaaaacaactaattcacccttctcactgaccagtggagaagtctggccttatctgtctgtctcaggcttcttctccaaggttaaccccaacgggaaaggagaggggactcatcaaaggttagaccatgtcctgaagtgacctgttgaatttgcaaaacttctttttcagtgttatgttttatttttgcaatttttgtggggggaaaatgcattctaggcttctgaaaccctttttagaagaaaatcatggtttcctcaaactcttcaagcttattgagttttcttctgtattatcctgtcctattgaaaaccttgtgcaaaagtatgtgtggggtgagaggtgtttaaacacacccggtggacagtgtctggctggggaggaaacgttagcctctcttttcttatcttatgagataatttaggaaatcaagtacaaggcccttgctgtgtgcacttatacctggagccttatttaggggatgttcttgcagatagatggggagaagtcttgctgggatcctctctggttttaaggcattttttttctcactcccagttgcctgcccatgtctggtttagcagcttttagaaacgtggctggcatccttttttcttttctctgacagcaccagcccctttatttgaacttcctagctgttttctgcctcttctgactaattaacagcaactaaaaaagaaaaatgaaacatagaacacaaaaaattccagggtgaaaaaggagaatttctagtcctggggtgcaaaagtccctagaagagagttttgagctgaaatgaaaagttgtgattatagagagacatgaaatgtgtcccataaaaggccacctagtcccaggcagatccaggaagagcactgggctgggagtcccatggggccagggcctcaccaagcagtcagccctgctcagttatcacaggggttgaactggattgcctaaatgatgcctttagatggatggaactggagtccattatcttaagtgaaacaactcagacacagaaagacaaataccacatgttctcgtttataagtgggagctaaataatgtgtccacatagaagcagattgtgggatgatggacaatggaggggtggggaagttggagctgggtggatgatgggaggttgcttgttgggtgcaatgtgcattggcccagtgatggatgcaccaaaggccctgactttgccatgacagaatatatcaatgtggcaaaactgcacttgtatcccatgaatatataccatgtttttaaaaatgttgcctttgggcagaggggataattctgcaaactgcagagccatggagtaaaaaaaacacccaagatagcagaacttgtcatttctagtttttccacaggaccataaagcaaaattggtgccgggtttgtatttaaagggaaaccaagagggtttttttatccttccatggtttcaaaatctggaaggacaatttgtacagaccctgagatagaaggattcctcagctttaatttcatgaacgatttgcctttcattgattcttgaggatatgaatgttttagaaagcaacagtgtatgccttgattttaagaggcaatgagccttttccttccttcgtttaggcatggggctgaatggagctgaaattcctgcactcttataacgtgccacatgaagggcagttttggattctgggaaaacagcccattgaaacagaattgggagggagaaacctcttacactcaggtcatggtatttatatgaatacaaaaaaaaatttaaatactgtgctaggtgctgggggttataaacatgaattacatgattagggcctctggaaacttgtgtggggctatagaaggaacaccagttcagaaatgtcactcctgtcatccagacaggatgcttcaccataggggcagagaccttctgctaagtcataccgcatatcaagaaatatattgctaggccaggcacggtggctcacgcgtgtaatcccagcagtttgggaggctgagacgggcagatcacttgagatcaggaattagagaccagcctggcaacatggggaaaccccatctctactaaaaacacaaaaattagcggggcatggtggtacgtgcctgtaatcctagctactcaggaggctgaggcacgagacttgaacccaggaggtagaggttgcagttagccaagatcgtgccactgcactccagcttgggcgacagaacaagactcatctcaaaaaaaaaatgcattgatcaaatcagcttaaaaatagccttcttgtttgctcttcttggtgtgggattattcagtccaattcttctactttttttaggcctcagcatgggatttggttgtcatatcaaccctataaacagtgttgaatccatgtcaataattgtattttttaaaagcaaatatcaccaagtccaagaaactgatcctcctctgaacatgatagctggactaggctaagaatcctatttcctgttagatcagaagtgaagattttctggtacagatttgggtgggagaaatgagctacccttcccaaggccttagcacctagatgacatcctctctgaagtcaccctcagccaggagcggacactgagctgctatttctgaatcacatgtccccaaagctgccctggccttggtgaccatggcactgtaagagaagcacagccagccccagcgtccttactctgactcagaggaaaatgcaacttgagctggattcattgaaatcttttttttcctggcctgaaggaaatgaagaaacatagccaaatattctaaaacaggattcaacaaacagcccataggccaaatccaccactgcctgtttttgtaaataaagttttattggaacacatctatgcccattcccttatgtattatctatggctgcttttgctctacaacagcagagttgagtagtgtgactgagaccgtatagcctacaagcccaaaacatatactgtctcacccttttcagaaaaagttgccagccttgttctaaaagaagtagagtaaggatttagtgagaagctggagaaaatattttcaaagacaactgtattctccagggaaacctgagatgaagaccaaggtgaggaaggagccagcagagaaatcgagtccatgaggctgaggaggccactggatgtccagtcttcagctctctgaagcctgagacaggaaacagttgtctcccgagagaaaggtttgaacctcctttaactagggaggaataagagatgatggcttcttagatctgtttacatttgctggaaaaacttcttccagggaaataactagacagggctttggccaactagcaggtgaagtctggagggaggtggaagagactgcttccaagctgggttccgatttgtctgattgaagcagccaagcttgtgtttgccagaggacttaggaggatgtggataaaatcaggctgaggcctttttttaaaggcccaagctggagctattgggattgttccctcagaggaaaatcaggagtttgggccattggcttcatggagaacctgtactttgtaccaaggagaagtcatttctacttggtttttgaaactgcattgtcatctagtattccaaggctttagtctgtccaccctcctgctccagagagatgcctttcagttccttaggaaacaaattggccatttgcccaaagagactaatccaggactagaacacaggcactgagtttcaacctcaggctccccagtgcgtgactcaggtctcttgattccatggtgtattgtttttttacctattaaacaattgcattcctagcctatggaaggtcttacctaagccaagactttggcagggattggattgtgcagcccatttttgttaatagcattgcccaagttagggaaggccattaggttggctgagtattctggtattctattgctgcataacaaactctgaaatttagtagcttaaaataacatttattttgttcatgaatttgatttcattgttttttaatgtatgtaaggtatataaaatgatgttttgatgtacatttacatagtgaaatggctactatggtcaagcaaatgaacatatccattgcctaacatagtttttttttttttttgatagtaagagcacttggaatctactttattgtcaaatttccagtatataatacaatattgtcaacatagtcatcacgctatacattcaatctctaaattttttcatgctacctaaccaaaactttgtacctttgaccaacatctccccattccctactccctaccccctccccgacccctggtaactatcagagtttcactttctggttctgtgtatttaacttgtttagattccgcaataagtgagatcatacaatatttttctttctttttgtgacttgtttcacttagcataatgtcctccagtttcatccatgttatcaaaaatggcaggatctcctttttaaaggctgaataatattccattgtatgtttatatatgtgtatatatatatatgtgtgtgtgtgtagtatatatacatatatacacaccacaatttctttatccattcacctgttgacaaacacttaggttgattccatgtcttagctgttgtgaataatgctgcaatgaacatggaaatgcaaatatttctatgaggtactgatttcattctctttgagtatatacccagaagaggaattgcagggtcatatagtagttctatttttattttttttgaggaacctccatacttttttcataatggctgtaccaatttacattcctaccaacaatgtataagggttcccttttctccatgccctcactaacactttttatctcttgtcgtttttatagtagccatcctaactgttgtgaggtgatatttcattgtgacttcgatttgaatttccctgatgattagtgatgtggatatttcagcagaaaccttgcaggtcagaagagagtggggtgatatattcaaagtattgatggaaacagtgcctcatacctgtaatcacaacactttgggaggctgaagcaggaagatcacttgagcctaggagtttgagactagcctgggcaacataatgagaccttgtctttacaaaaaataaacagaaaattatccaggcatggtggcatgtggctgtagttccagctacttgggaggctgaggtaggaggatcgcttgagcccaggaggtagaggctgcagtgagccaagatgatgccactgcactgcagcctgggtgacagagtgagaccctgtctctaataaattaataaaataaaatttaaaaaccctactagccaacaatactatacccagtaaacctgtgcttctcaagttgaaatgaaaggacactaaatagcacaagagagcataataaagaaggaaactcgttggtaaaggtaagtatatggacaaaatcagaacactatattactataaaggtgatgagtaaatagcttttatgtctatgaagaaagttaaaagacaaaagtattttaaaaaccattataagtattaactaaattatgttaatgggtacataatataaatagatataaactgaggcatcaatagcatgtaacttggggggagcagagggaaaatcagagtttttatgcaagtaaagttacattgtgaacttataacagactgttacaaattatttcgtgtaagctcctggtaaccaccaagaaaatacctatggaagttatatatataaaaaaagaaaggaatcaaaacctatcgatacaaaaaaaaaaaagaaacaaaacaaaagaaaaccgcaagggagaaaaagagggacaaaagaacaagacacatagaaaatagtcaccaaaatggcaatagtaaatctgtctctatatttactttaaatgtaaaaagactaaccttcccaataaaaagatacagcatgactgaatagattattaaaaaaaacaacaacaaccaggatcaaactgtatgctgtctacaagaagctcacttttagattcaaggacacacagagagatggaaaaaggtagtccatgcaaataccaaccaaaagagagcaggagtggttaatacttatatcaacaaaatagactttaattcaaaaactgtctctagagacaaaggtcatttcttaatgacaaagggtcaattcaacaggaagacataacaattataaatgcacccagcatcagagcacctaagtatatacaacactgacagatctgcaaggagaaattgatagcactataataataggagatttcagtaccccactctcaataatggataggacatctagacagaaaatcagtaaagaagcagtagacttgaacaactggacctgtgtaacaaatggacctagctggcatatacagaactgttcagccaacagtggaagaacattcatttttctcaagtagccatggaacattctccaggatagatcacatattaggtcacaaaacaaatcttagcaaatttcagatcgaaatcataccaagtatcttttccaaccacaatggaatgaaactagaaatcagtaacagcaagaaaatgggaaaattgtttgtgaattcatttgtgaatttgcaatttggcagagcttgatcaacacagctctctgttccatataatgtctatcagctggggcaactcaatgggattggaggacatctctgaggttttcactgtcatggtgactcacgtagcctgcaagttgatgtggcagtcagtgtctcctgtgagcctctgcatggacagcttgtgtttcttgcagagtggctaaattctaagaacaaatgccccaagaaaattaggaggaagctctattgctttttatgacctagtctcagaagtcacatagtgtcacttccactgtagccaaaagtccacccagattccaggtaagggagcattagaccccacctctctatgggagtagtttcaaagtcacattgtaaggagtgccatcatcgagatattgttgcattgatttttggaaaataatttacctgcacagaggtaaattcacatcaattctttgtctccttatttcaccatccattaatgtttgtttgtttgtttgttttgagatggagttttgttcttattgcccaggctggagtgcaatggttggtctcggctcactgcaccctctctctcctgggttcaagcaattctcctgcctcagcctcccaagtagctgggattacaggcacccaccaccacacccggctaatttttgcatttttagtagagacagggtttcaccaagttggccaggctggtctcaaactcctgacttcaggtgatcacccgcctcagcctcccaaagtgctgggattacaggtgtgagccaccatgcctggccccaccatccacacccagccccaccatccattaattaagcttcatggtgttcactcagtcacactgttgtcgctctcatttgccaatgttaaatagtgatgcacagtgcctaagacaaaatcgctatcactgcaagctcctacccctggctaaatgctaatctggatttatgggacagtgacgagtgctattattttcattttataaatgaggaaactgagtcctggagggaagaaaagtcaattttcttaatgtaatacaattaaaataggattacactttgaatttccttatttcttaactagtattttatctttccatgattgtgcttaattttatcttatcagtacaagcactcatataacctgtagggatatttgtgtacatgtgcatgtgtgcatatacacacacgcactgtgtgtgtgtatatgtcaaactcagtgcttgcctttgttggatggaaattcagcagcactggaggactagacagctagaaaagccagtttcagggacaggaaatagtagagttcaaggaaaagttaggacaaggaaaatgagtctttacaaagcaaccaattcctcgtgagaagtctttgcatctcacatggctaagagacagtactttggttaggggcctggagctttggttttgatgaacagtgtgctggtattggctctaagctggggcatccaccatttggctccccatttgagtggtcactctgtctctcagagcaatgtgtggtctttcggtgttgataaagcagcaactacatgccaggccctaagggcaggcacagaggcaagcaagaccagtacagtgccccctgcaatcctcttgggacatcattttagcaggggagactaccattgaacatgtaatgataaaattgattagttatgattgagatgagcagtaggaggaaaaagtgtgtggaactgtgagagctcacgatgggcctgaacttgcccagggactcagagaagtggtctggatttgcttgttgaagggtgagaggacatgtactaggtgaaccagctggaggaatctggggatccacttgtggggaggccctgggtgggaagttgtaaggacaaccagagtgatagctggcatgagaaagccagggtgacagaggtgaggagggcacatgccagatctggcagcctgcatgtcaccagatggatttaggtcacatcctgttcttccgttctcacctctttcacctccatctccacctccacctctaccccttcacctctccatgcctcacaaagttggactgtcttgcctgtgagacaggaaaggcatgtgtgatgaggggactgtacactaggggccagtccaggttttgtgagacctgaggcttatatagtagagggtggggtcttgaaggaaaaaaaaaaaaggtgaaattatgaagacaaagtttgtgcaaggcttccctaggggccatgtcagctggggacctctaagctgaagtttcactagtgtggtggggaagctccctttggcaccttccctctgtcctcaaagctcataaagcccacctttcatcttgcctgagacgttcatgccatccttacacccacttcctcctgttttcttcttagttaagatggcaaagaaagagcaaatatattgaaatctcctggaaatttggctctctccttgaccccagtagtgtccaaaagaacacaggaatttcctctttttgcccaagacttccatgatattttccctgataatcaaggaagggagtgttggctgggacacttttttcttttggaaatgtggcaggggaatatgaattttcataggcgaaattactctgtctggtcgagtctagactgttcgttggccagcacgtttgctggcgcccacactgacactctgaggtgctgcctggacttattctctgggcagggaagaaataacctggaactacattttggggaaaaaactcacgaacatgagcagtgacaaggaagaagtttaataatgagtaaattacaactaaaagttgtcaacaggctcttctctccaaattccactgaaatgagcaaagccatctaacagtagtgaagagtctctgtcatctggaacttggggaagctactgtccatagatctgaaatgtcagagaggttgagacagattgaggggaagactaacaagccctccatggaccgtagaagaaagccctaacccctctccaaatgctgctgctgatctcctggcaagcctccacagataggcccaggcccaggcacagccagcaagctctctggaaatatttgggttttgacatgccaagacttggccccagtaagggctgggtggggctttggctgttgaggcccagtcttggttagagaaaaggcactgtgtccctgttaactgctggctgccccaccaacaaactggaaagaatctcccccagtctgttgtgattccctcagcctgatggcctaattgcctttgccttttcctgttaatactgacaattcaatacagtcccattgctcaggcagaacctatttcatatataaatttcctgcatccccaaggcagagcaaatagggggaaatgaccaaactataatctgagagttctttactcaactggattatcattcatctaagagcatctgaaagacagtctcacacaagcaaagactgaaaggacatccaccaccacgtacctctcttgaaaaaactgcttggagaagcacttcagtagactagggaatgaatcaaataagtaatgcactgacaaaatcaaaaccacagttgacttaggcttccttggagcttggaagaaccccttcccacgctggagagctggctttttggaggtgggagtagaagccctgaggggctcaggggaggaattcccactgatttgcaagaaaggaattggccactgtgtactcgtttgccactcaatcctgccctaaccttcctctcctgtctttctcacagactgtttttgaaaggaattgccgttcagaggactgtgccgcagacctgcagcttcagggtaaactgctgctctccaggtatgtcggtgtttccttcagagcattgttctcaggctcctttttcttgaccccaggtcccaaacctgaatgtgcagatttccccactgaagaggataaacagagttgatgggttacagtaatattctgtggttttaaaaaaatgtatgttacaaaataattataacaaaagctttgttgggaagattgtttaggtttttttgtgtgttgattgcaattccacatatctcacaatgtagcttgtatttctaatttctatgagtatttgaggggtggctattttatgcttgctgattgtattaagttgaatcatatgaaattgccaatatttgaacttttggacaatttcatatgtatgattcatcctattattaaataaaggtttatgccctcctgcctccacacacacacacacacacacacacacacacacacacacacactagtgtatgttttaacaagtaacatttctgtggcaggagagggctgaaggagaggggcaggctgccctgatccaagtgagcagatagtctccttattgtttcagggtttcctcccgcactacatgaatcccccaaggctaaaggtgaaccgtacagcggccttctgtttcctctttgccaaccttttattttagacttcatttaggatgaaggtgctggtcctgatcatttagcctcatttcacagaatggcttccttttgaaacagttccttctgaaagactgttttagccttggggccagaaacccctctattagttttattaccatttctgaaaaacagtcactagttttggtagttatttttcaaaatgcatagtgtatcccttacttaaaactatgagagttaagtttggatgaaatgacatgaatatactattatgaaccagtgcctacactaggacattttttttattgttatactttaagttccaggatacatgtgccgaacgtgcaggtttgttacataggtatacacatgccatggtggtttgctgcacccatcaacctgtcatctacattaggtatttctcctaatgctatccctcccctaaccccccacccctgacaggccccggtgtgtgatattcccctccctgtgtccctgtgttgtcattgttcaactcccacttatgactaagaacatgcagcatttggttttctgttcttgtgttaatttgctgagaataatggtttacaccttcatccatgtccctgcaaaggacatgaactcatccttttttatggctgcatagtgttctatggtgtatctgtgccacattttctttatccagtctatcattgatgggcatttgggttggttctaagtctttgctattgtaaagagtgctgcaataaacatatgtgtgcatgtgtctttatagtagaatgattcataatcctttgggtatgtatacccagtaatggatggctgggtcaaatggtatttctggttctaaatccttgaggaattgccacactgttttccacaatagttgaactaatttacactcccaccaacagtgtaaaagcattcctatttctccacatcctctccagcacctggttgttttcttgactttttaaatgattgccattctaactggcgtgacatggtatctcattgtggttttgatttgcatttctgtaatgaccaatgatgatgagcattttttcttatatttgttggccgcataaatgtcttcttttgagaagtgtctgttcatatctttcgcctactttttgatggggttgttttttttcttgtaaatttgttttagttctttgtagattctggatattagccctttgtcagatggatagattgcaaaaattttctcccattctgtaggttgcctgttcactctgatgatagtttcttttgctgtgcagaagctctttagtttagttagatcccatttatcaattctggcttttgttgccattgcttttggtgttttagtcatgaagtctttgcccatgcctatgtcctgaatggtattgcctaggttttcttctagagtttttatggttttaggtcttacgtttaactctttaatccatcttgagttaatttttgtataaagtgtaaggaaagggtccagtttcagttttctgcatatggctaaccagttttcccaacaccatttattaagtagggaatcctttccccattgcttgtttttgtcaggtttgtcaaagatcagatgattgtagatgtgtggtgttatttctaggcctctgttctgttccattggtctatatctctgttttggtaccagtaccatgctgttttggttactgtggccttgtagtatagtttgaagtcaggtagcatgatgcctccagctttgttcttttggcttaggattgccttggctatagggattcttttttggttccatatgaaatttaaagtagttttttctaattccatgaagaaagtcagttatagcttgatggggattgcattgactctataaattactttgagcagtatggccattttcacgatattgattctttgtttccatgagcacagactgttttttcatttgtttgtgtcctcccttatttccttgagcagtggtttgtagttctcttgaagaggtccttcacatctcttgtaagttggattcctaggtattttattctgtttgtagcaattgtgaatgggagttcactcatgatttggctctctgtttgtctattattggtgtacaggaatgcttgtgatttttgcacattgattttgtatcctgagactgctgaagttgcttatcagcttaaggagattttgggctgagactatggggttttctaaatatacaatcatgttgtctgcaaacagagacaatttgacttcctcttttcctatttgaataccctttttttccttctcttgcctgattgccctggccagaacttccaatactatgttgaataggagtgatgagcgagggcatccttgtcttgtgccagttttcagagggaatgcttccagcttttgcccattcagtatgatattggctgtgggtttgtcataaacagctcttatttttttgagatatgttccatcaatacctggtttattgagagtttttagcatgaaggggtgttgaattttgttgaagcccttttctgcatctattgagataatcatgtgtttttttttcattggttctgtttatgtgatggattatgtttattgatttgcatatgttgaaccagccttgcatcccagggatgaagccgacttgattgtggtggataaactttttgatgtgcggctggattcagtttgccagtattttattgaggattttagcattgatgttcatcagggatattgacatgaaattttcctttttcgttgtgtctctgccaggttttggtatcagatgatgctggcctcataaaatgagttagggaggagtccctcttgttctattgaatggaatagtttcagaaggaatgataccagatcctctttgtacctctggtagaattcagttgtgaatccgcctggtcctgggctttttttggttggtaggctattaattactacctcaattttagaactcgtttttggtctactcagggattcgacttcttcctggtttagttttgggagggtgtatgtgtccaggaatttatccatttcttctagattttctagtttatttgcatagaagtgtttatagtattctctgatggtagtttgtatttctgtaggattggtggtaatatcccctttatcattttttgttgtttctgtttgattctctgttttcttctttattagtgtggctagtggtctcttttgttgatcttttcaaaaaaaaaaaaaccagctcctggatttgtttattttttttttgaagggtttttcatgtctctatctccttcagttctgttctgatcttaattatctcttgtcttctgctagcttttgaatttgtttgctcttacttctctagttcttttaattatgaagttagggtgtcaattttagatctttcctgctttctcctgtgggcatttagtgctataaattttcctctaaacactgctttaggtgtgtcccagcaattctggtatgttgtgtctttgttctcattggtttcaaagaacttatttatttctgccttaatttcattatttacccagtagtcattcaggaggccattgttcagtttccatgtagttgtgcagttttgagtgagtttcttaatcttgagttctaatttgatttcactgtggtctgagagactgttatgatttctgttcttttgcatttgctgaggagtgttttacttccaattacatggtcaattttagaataagtgtgatgaggtactgagaagaatgtatattctgctgatttggggtggaaagttctgtagatgtctgttaggtctgcttggtccagaactgagttcaagttctgaatatccttgttaattttctgtctcatgatctaatatttgacagtggagtgttaaagtctcccactattattgtgtgggagtctaagtctctttgtaggtctctaagaacttgctttatgaatctgtgtgctcctgtattgggtgcatatatattgatgatagttagctcttcttgttgcatgatcccttcaccattatgtaatgccattctttatgtttttttgatctttgttgatttaaagtctgttttatcagagactaggattgcaacccctactctcttttgctttccatttgcttggtaaatattctaccatccctttattttgagcctatatgtgtctttgcacatgaaatgggtctcctgaatacagcacactgatgggtcttgactcttcatccaatttgccagtctgtgtcttttaattgggtcatttagcccatttacatttaaggttaatattgttatgtgtgaatttgaccctttcattatgatgctagccaattattttgcccattaattgatgcagcttcttcatagtgttgatggtctttacaatttggcgtgtttttgcagtggctggtactggtttttcctttccatgtttagtgcttccttcgggagctcttgtaaggcaggcctggtggtgacaaaatctcagagcatttgcttctctgtaaaaaagtttcttcttcgcttatgaagcttagtttggctggatatgaaattctggtttgaaaattcttaaagaatgttgaatattggcccccactctctgctggcttgtagggtttctgcggaaagattcactgttagtctgatgggcttccctttgtgggtaacccaacctttctctctggctgcccttaacattttttccttcatttcaaccttggtgaatctgatgattatgtgtcttgaggttggtcttcctgaggagtatctctgtagtgttctctgtatttcctgaatttgaatgttagcctgtctttctaggttggggaagttctcctggataatatcctgaagagtgttttccaacttggttccattctcctcatcactttcagatacaccaatcaaatgtaggtttggtcttttcacttagtcccattatttcttggaggctttgttcatttcttttcattcttttttctctaatcttgtcctcatgctttatttcattaagttgattttcagtctctgatatcctttcttctgcttgatcgatttggctgttgatacttgtgtatgcttcatgaagttctcgtgctgtgtttgtcagctccattgggtcatttatgttcttctctaaactggttattttagtttgcaatttctgtagcctgttttcaaggttcttagcatccttgaattgggttagaacatgctcctttagctcagaggagtttgttattacccactttctgaagcttacttctgtcaattcatcagactcattctccatccagttttgttcccttgctggtgaggagttgtgatcctttggaggagaagaggcattctgatttttggaattttcaacctttttgtgctagtttttcctcatcttcatggatttatctacctttggtctttatgttggtgactttcagatggggtttctgtatggacgtacactagtacattttaacttatgatggcacatgatctttcattcatcaaaggaaagtaatactaagattccttttcttcagtttgagtttactggaggaagatgatgtaacacacacacacacacacacacacgcacacacacacacacaaatagtcctccaaaccacttaaatattaattagcattacttttacttagggcaatagtggtagattaaaatagcacacgttttgccaagcttacaaaattacttaaaactcatggcatggatattagaattgtttcacattagtacgaaggacctcctgggattattagaggaactgactttaaagaagtttcataaatttgcagctcattaattttaattttaaataggccttccacaaagtgttttagggaaaaaataacaagaaacaaaaatatatggatttgttttgtcttgaggcagactggaaatgctggaaatttattttggatcgtagaaaaacttcatgtggtgggaaaatgttcacttgctccaaggtcaggtattaagttagcaaagtcctaatgcttttgctacccattagtggatgatcaaatccatctctattgaattgtgcttttcttatattaagatgtaaaattcaaggctcagtatagcacctggtggctaaagctgcctccactgccccagtctggcctttcaagtgtggtcagagctagttatcctctgtgggcccagtaatcaataatgcttgaacaactagtgtggtggccaggacccagtccccccatatgtatcagctaccaattgccacaaaaaaggctgaataaaaaagtcaccccaaaactcgatgatatgaacagcaatcactgattcccatggattttcaggtcagctggcccaggctggactcagctggaccttggctgatttgtccatgcatctgggttcagcagagggtaggttctaggcttgggtgacaccattcagctctactccctgtgtctttcattttttctttggaaccagtggacaagcctgggcatattctcacagcataacagaggtacaagaaggcatgcagaaatgtgcaatgactcttaaggcctgggctcagaactggtgcacttttcctccagccttattctattggccacagcaagtcacatggccaaacccaaagtcaagggacaggaagttagtgagaggaattacaaagccacacagcaaagggcctgagtataaggaggaggtgaagacttgggacccataatgcaattgactatactatataaacagcaaggtagccctgtctcttatcctgatgccttgttgttatcagggctatttcagtctttattgcaatgccgtctctctggaattcagacatgagatctggagactgggtgagaagattttctgaacctcagaaacaatgcctttggaccgaagctctcagcctcttaggttgggttatttctcagaggacccctggcctctcaaaatagccttttggccgaatcctccattaaagaaaccttcgttgtacttttgggcccatagctgttctcacaggaaccatcagagaaatgttcattgatacttagataacaaacctgtggttcagttatatgggatttatccagacctttggatgttcactcttcagagccagggacaatgtgagggaagatacaatcagttaagtgctagtggaaaccagggtctgaatttggttggcaaaggcatagtggctccaagcagaggtaaactgctttggttatcattgagctctcttgattcattcttctctgggatggaatgtgccctcctttcttgttcaagccaggcaagtgctaggcactgggctgcagaagtgagcagtatgtgagccctgctctcctgctgtgagcagagcaagaggctgggagatagtggtaccacacagtgagtgctaggtgggttactccagggctctggagcagcttccaagaggtggtgttgagaggaatgaggactcacgcattccgagcagagggaaaatgtgagcagaagtatggagaacaggactcccatgaagatctgcaggtgtctggaatgaaggaggcagtcaggagaacacagtgagagacagggaaggagaaagggagagaaaccagattgtggaacacttatgagtctggacttcatcttgaagccagtgggagtacagccaagttgtagtgtaagtgcttttaacctaacaagaatacagccagggggccaggcgcagtggctgtgcctgtaatcccagcactttgggcggctgaggcagatggattgcttgagctcaggagtttgagactagcctgggcaacatgtcaaaactccgtctctaaaaaaacatacaaaaattagccaggcgtggcagcaagcgcctctagtcccagctactcgggaggctgaggtgggaggatcacttgagcctgggaagcagaggttgcaatgagctgagatggcaccactgcactccagcctgggtgaccgggggcaaaaaaataataataataatgcagctgggcacactccaggagccagggtggggaagggagaggagaacattgagatggtataggtcattttaccctctattcctctcagtgaaagtacgttccagcttgagttttgagtttgctcctctctccaaccataacagttcctgcttccctgccttgggtaggtctgtggggcagctgcccttcatctcagtgcaggagcagccttttcagggttggacttatgagagatgttgtgctgatttccaccatggtgcccccctcccagggcttcacaagggcaacttggacacaatttttgctttccgtgatgtctttagaacttagctctcctgttagccgtgaccttactcactgtacgaaaagtcgaagcaaaggggtcacagagaaagatttctctgatgactgtgtagacagttggtccatggtgttgtggctggaggcctctgaatacccaccagactgaggagcctttgtcttaagacagagggaaggacatctgggagtgattgtgtcacccagagtggccagagatcaagccataggaaatgctgtctgtgaccaggattcatggatgtttttattttcctctctggagagcatgaattctggcaggcctgtgatctcttaaaacaatcaactcttcaattagaagttcatgatctttaatgggcttgagtccagttccaaaacaggccattgtcaaaacgtccaggaacagggatgaaacttgtttaaaagtttctattaagcaggactgaaaattccatttgtaaaaggatgcaactatgttttgtctttttgaatactcacagtacctaagaaagcatcacatatgataaagaaaaagactatggcaagtgagctttaaaaaaattctttttttgatgcattccatcagaaatcagtggaacatttcattgctgtctggctagccaactccgataaaataaggacttttaagggagatggaaagacacagcaggatatctgtaaagccagaatcatctggtggcaacatataattgtcctatggttgtaaccttgatagtgctgttaccatgggggttgggtggtggggcgaagtgcatttcccaaaactgttggctagctgagggatgagagctccatccatgaaaaccagtcttccagaggaggatccccaaacccagagagctatttagagtttgaaacaaattgttctccttctcaaaagtggcagaatggttagaatcatcaactgcacagcctaggtcagaagtgaagtttgtcctgttttatgaagggaaagacacccttgtttagtgagcactgaccaagcactagataccccactgaatactccatatacataaaagcactgaagtatcttaccagctgcataaccttgagcaagttgcttaacatctctgcctgttttctcctctgtgaaatggggaaaataacagcagcaccttataaggttattttgcatattaattaattaatacatatccaagtgcttctaaaagtgcttagcatataaggaaacactcagtagtgaaaactagcattattatttcatttaatcctcaacaacactgagaataaatattcttatactctttttactgaggcggtgcagaggctcaggaaggccaggttacttgctcaaggctcatgttgtatgggaaagttaaagcttggaatgtctgattctacatcgcgctctcctcctgtacattggcttctgttgtctctgggttcagctatcagctggctctagaccagaggtactaaggctagagaccttgggtaaaaagtcttcctctctttgaaagccccaatccagagaggaggtagatgggcaaaaaatccaccagcaaagatagctgccatccctcccctccattctccccatgtgctgtctgacctggaggccttgttcaatagcttttcctcctggagacacaagcaatctgtcctgctgggtcagtggcagtccttgcattgagtcagcacattcttttttttttttttttttttttagacggagtttcgctcttgttgcccaggctggcaatggcacaatctcagctcaccataacctccacctcccgggctcaagcgattctcctgcctcagcctcccgagtagctggtgttacaggcatgcaccaccatgcctggctaattttctatttttagtaaagacagggtttctccatgttggtcaggctggtctcgagcttcccatcttggcctcccaaaatgttgggattacaggcatgaaccaccgcgcctggccgagtcagcacattctttatctatgtaggttgcattttctctccttggagagcctcagattcaatggtgagcttatggctggcatgccagcagtttcctaaaatgtaatatcatcactattattgttattatatgagggaaggtgaataggaactcatcagaaacctggaaaatgttgtcagaacattagccgtgtaatttttttccccttcattgtctgcaccagctctgaagaaaaaatgcagaagtttgttgatttggagtagctggcttttttttttttttttttagatggagttttgctcttgtcacccaggctggagtagagtggtgtgatctcagctcgctgcaaccttctccgcctgggttcaagcgattctcctgcctcagcctcccgagtagctgggattacaggtacccaccatcatgcccagctaatttttgtatttttttagtagagatggggtttcaccatgttgtccaggctagtctcgaactcctgacctcaggtgatccacccaccttggcctcccaaagtgctgggattacaggtgtgagccactgtgcctggcctagctggctttaatggttgctgtttctggaatctctggctataggaatggatttctcaatggtatattcttgaaagaaaggcaaaatgctcaaccaaatggaactttttgaataagagttgacagattgctcatccttgccctcctcagaacaagtgtttgccgtttctctgatgtgggccttctttttttttccgaaaaagtctcactttgttgcccaggctggagtacagtggcgctatcttggctcactacaatttccacctcccaggttccagtgattctcctgcctcactcagcctcctgagtagctgggattataggcgcccaccaccatgcccagctaatttttatattttttagtagagatggggtttcaccatattggccaggcgggtctcgaaatcctgatctcaagcaatccacctgccttggcctcccaaagtgctgggattacaggcgtgagccaccgtgcccagcctgatgtgggctttctaggagggggcagcagatgcctctcctcacatcccagccacgcatcaaggatgaatggacatgtgggtgtcttccgtgggagttacctggcggagggtgggatttaggccccagggaaggtgaggagcagtgtaagggacagtcacactctgggaaagacatcgaagggtgacatgcccttccagagagcccagcttctgttcacctgatgagaggtgacacaatgctacggtgttcattcgtttgacaaatgtggatggagcacttgctatgggtatgccagacctggtggaaatagacacataatgctgcatcacaatgctcccagtctagaaggggagacacacatgaaaacaggtatcactaactatagtcatgatcacgatgggaatatgagggagttccccggaagcacaagggaggcagcactctacatggtctgaggttgagttctcctagaagcagaccatgagacaaggatttgagtgcaaataattgagtgagcagtgcaggaaatgaagaagtaaggaagtacacagggaagcctgcggtgaggatgtgccatagcacttgtatatcagttacttactgctgtaacaaatcaccccagaactccatgacttaaaccagccaccatttgtttagctcctgattctgtggccagctgttgaggctaggctcagctgtttgggtcttctggtctcatttgggccccctcttgcatctgcaggcaacctcgggttggttgggtgcctggctgttggtttgtggttcgctggcgttcctccgcatggtctctcctcctccagcaggctagcccaggattactcttacagtgtggccagggcccaaaatggagagcagcagtgcactagacctcatgaggcctagttccagagcaaatatattctcacttttgctacattctgttgatcaaagcaaatgtcacagggtcgcatggaaataaactctgcttcctgatgggaggagctgcaaagtcacatggcaaagggtgtgatccagagaggctgtcaatcagtgcatcatcccctgctcccacagtggatgattggcactttgtcctgcagggaaacgtacctcttggaatgactatatctgagaagtgaaggagctggagtgtttgtaccccaattcctgagattcactggttgagggctactctgggttaggtgggtggggacagttagctccctggcacttgcatccttgtctagctatgggaaaaggcccttagatacaaaaatgcagacactggcagctgaaagtcagcaaaagcattggggtcagggtggggagtgtgggaggggatggcagggacatggatgatatctcctgtacccgctttcttaaagactctcagttgatgaatttattctgaaattccaacaggagtatcatatcaccttttgacatggaggcttcttcccattagcttcctaggaatactttcatttcatgttttgccaaacacccaacattctccagtactatgataactattctctattgcattcgtctggacccttttttccccttcactagcaagcataacaatatattattgcacacatgcagaagggcatttggctttacagcaaacctatgaaccatgtatagggctccaagttttgttcccattcgctgaggacagcagcaaaggcagataagggatgtgtccacagcacgtccacaggcagagaggataagatccctgagccctgcatcatcctgggagtgacgtgggccaagcctagccatgcagcagaactctgtgtttcttaggagccctggctccagcgcagctcaggcgtaagcacaacccatgactctgggatgcccctcaattgtcttacaaagtaactcaggcattgatgtggggtagagacaagcccagcacacaagttcttccaggttgggggattttatgtgtgtacttggagccagagcatttctggtgcagaataggaagctgacagacagggattagagtcacttatctgaggtcaaaaaaattaaatagcagaggcaggagaaacacctggtgggaggctccaaagcctgatattctagcaatttgacccatgggccctcactttaaataaccattgcagcttggggaacctggcctgtctttaggtggaaacaagttttggaaattcctcctattgcagaaagcatttgatttgcagtttcctgaatgcgaggctccaagtgtagggaccgccacccaaggacgtttttctctgttgggcagactcaaagcactgaggggagcttttcagggcccaccatacatgagcaacagatagctctccctacagataccatatttcagggacagccccttccctcctgagcagacactggctgagattttccagcttcgactttctagatggtgagaggatggggatgctcagagggacagtgaaggcactgaggcagtaactgtggcaaccatagaagaggctggccacgtgctcatagcggccttcctcctgagacacccgggaaggctgagtctacctcacaggtgtgcctgataaaatttttttgggcagtgttttccttggcttccaaacatagccatccattggaggttttatgtggaagcatctttccagcaggcacaatgacatggctatttcccttgtgactggacgcaaggaaaggatctatgaagagaatgtagccccgaatccctcccttctctcaacttggagcagacagggagccatgtgtggtttccttgctaagatttttgcagtttattctgtgtggctgtgtgtgttggtcccttgccaataatcctagactcacccatcccggcacaggcttgttactgtgggccaagccaaattctgaagcagcgcagttgtttgttgtctgaactcagtcttccccaacacatacttttcttgttgtcctgcacacaccctctcatcagcacccctcccaagtttgttctgagccacctgatataacctcaggtgaacaagaaggctgccctgtggctcttcacggatgaaaagccaaaggcagctgtggcttcgctttgtccccagtagtcactggccacggtgagacctgggtttaacatgacctgcccataaatcagtttgctgcaattgcagtgagagggaaggtaccttgtagaaaacctctagattttatgagcttgtttccctgactgcattccagagccacgtgtgagacttgggtttaacgtgacctgtccgtaaatcattttgctgaaattgcagtgagagggaaggtaccaggtagagaacctctagattttatgagcttgcttccctgactccattccaggtgatcttgatccaaaaatgacgaggctgggtggttgccattggtgtcacacccacatcccttgctgtgcaggtgcactgctcccagctgctgtgctggctgctagctgctcacagtggcccgtcctttggtctggaaagtcacccttgccctgcctgggagggtgacttgttagccaatggctggctgatttggggtgtggattaactccctggtgcagtttatgctgcacagctccccttggtgtctggttgaggctagattccccctgtgcccacagccttggtccactcctgccctgtccctgccccagcctggttccctggctcgccaacagatccctggatctctgccacaagctctggcttccagggaagggagcctatcctgagatgcggtagaacctcatgttttatttatctgctcttagatctcctgtccgggcaggctgattgctttttaggattccaagtttcaaaaggaaatcaaatccaatgtatttatcagacattagtgggagagaaaaaaaaacagttgctcattggctttttatttgccctcttggaattgcagaggattttgttatttttatatttaaaaaccagacttgtggagtaatgtgtgggagaccccttcaggctggtccaggggactttgtgtctttagagattgctctggacacctcttccactgaggctttgtttttaaagaggactttccagacccaagggaatggaagggggctcccttgagagaaatggctttcatacaaaatgtccttactggtggggaactgaagacaggtacagtccttactgcataaggggacagatgatgttcagttacagtcataagcctttctcaccaggagcactggactctcctttaagaaagttttctgtgataatgagatttgaactggaagaaatgctgttctttcagttaacagttgtgttttttccaagaaaaaaaagaaatacaaatgttaaaacttttttttttttttctggtgctaaagaacaatttcacctcctaagccaagaaggaaaaaattctcatctaaaccgccaggcttaaaggtggctccttgtcagtcctgaggtggtagaattgaggtgaatgaagtcaaccacagtttctaatgtcttcttatatgccttcagaaacaccatgctcacctttcctcctgctgtcctaggctgagcctgccatccctccttccctctgtccatcacagcctccccttagggtcattaactcagtccctaccactcaccttcccataggacaggtgttcttaacctggagtctatgtcctcttgctgatctgtgaacccggataaggaaatgattgcattttgttttcactaacttcacactgaaatttaacatcatattcaattatgaatgtaggaaacagactacagtaatattaccaggacctgtgactctgtcccaaatagaaatcacaggtattgtcaaatcaagttagagttattgcagatatttcaaactaccatttacattcatccctccttcagagttatagcattagatttacctccagatctttttatttaatatgttttttttaaagcatattgctaaactacacatttgtgctctcccctttcccatagggctacctcacctcccaggagaaaagattcaaaatctaggagattcataatttcaatatattccattgcttgtgactatttatggccgtatttggttcctgagctagaaacagaaaagttatggccatgacagaattacttgtcaagggactatgatggccctgctaacctgggctttcttgagctgtctgccccgctagctttgatgaaatgcacatacactgcttgcattttctgtgcaatggccaagtgtaacaggcagcacacatgtggcagatcgtagcagcgggcccttgccgggtcaagtcatacatcgctgcacaccggggctgtcttaggacattggacctccgagcagcctgcagatcttgggaattcctctgccccctaaagtattctttgtctttaatccagttgttacagtgagtgaacctgatttgttccagatgtcctaagatttagtgattccggaaactactcctaaagtcaaggctgatgaggatttgaattcctctgttagctgggaaccagcagttcttttcacagttaaacagatgaggcaggaggagggagactgagctgccttgagggacagggaggggcccactgactggcttatttgccttgttagaaagaggatggcctttgaagcaaatatcgattctaccactacatggctggggccaaagtcagctgggcagggacatggacgtgctattttttttaaagtaatacatatttaccttaattatctgaatgttgttgctagggaaaccactattttggctcagatcatcttagtaaatgcttttttctctcactttttgagcataaaactggcccaggtgggtacctatgagggaggtggaggtatttctggcttcctataagtgagtttttcaaaccagaaattcagtcccaggaatgatttccctgacccactgtaaattttaattgaggtgcgttacaggggtgcactatgatctctctctggagttaataaccatatggatctgttttgcctgattagaagggatttctaaagcatgatgagatggggaagcacaattcaaactacatggcatagtaactcactcccagaggaagttaaaacatgtatacatacatatagaatgttctgtttaatattattggtttatgcagtatttgaatatataaatatgaatataaagccacgtacagttatggatttaaaacaaaagcagaacttaattaatgttgctgtttggatttttttcaagtgtatttgaatgcagacaagtatccagatagatgctagtggaagtctgggacaagctgtataagggtatcaacccagggttcagctggagctgggccagactactaggttgtgtatttagagaaactagggcaggactgctggagaagaagctgagtggtgccaaggtagggcagtgatatggtttggctgtgtccccacctaaatctcgtcttgaattgtagctcccgtaattcccacatgttgtggcaggaacccggtgggaggtaaataaatcatgggggcgggtctttcctgtgttgttcttgtaatagtgaataagtctcacgagatctgatggttttataaaggggagttcccctgcacacactctcttgcctgccaccatgtaagacgtgactttgcttctcattcaccttccgccatggttgtgaggcctccccagccatgtggaactgtgagtcaattaaacctctttcctttataaattacccagtctcaagtatatctttattagcagtatgagaacaggctaatacaggcgggataggcacacctgagaaggaggacagggtcagataaggtggtaagctttgaacagaagaaagcgtatcataggggatgttgagcttgttgggatgaggagcatccaatgggctagagcaggtggtttagggctgaggctgtaaaccacaggggattacctatgtttatctggggcaagttgcaggataaccacaggacaagactagtagttggacagaaataccaatttttattattctagaatagattaaaatataaaataaaattagattttctctaatatatttagaattgaacctttttgggtacaatattcttttttagtatttcttggtgatttttttttttacaacaaaaaatagagcaatacctttcttggttagtaaaataaatccctaaatatttgccacaatctctagaatcttctaaatcaggaaattttaatgattttcacagcagtgaaaattgatattcatattctaaataattccatgtttcactgaaatctgcaggaatcgaaaacaataggcagtcactaactaaaatgggacagcaagacagaaacagtttcctatccctgtaggaaagagaaatctcggagctttcattgcatgaaaaccgactccattttagtacctcgttgcactttaggctttccttgtccagagttctcacacatgacagtgagctccaactacaacctattccaagctgagagtaatggactgagaatctgaaaacatgacacatcaatccattccccacctttcccctgtgagactcaaaaaaacatttcccaggctcccttgcagataagcttcttgggaagttcagccagtggcatcactggtgtgagattggagaaagggaggaggagaaaagtcagggtgtttctcctcaactccactcactttaagcagcatctctggcagtagctacttctcctccaccgtcttagctccctcttggcagtcccagtcccagtcacaatcacaacacctcctccctcagtccctccaactctaagggtgtcagcagttgcttctgatctcagcttttccttatcttaccttgtttgctcttctggttcttttcacacctttgtacctggttccccattttaatcccttctatgaactacctggcatgggttctgctttcctctctggactctgactaatacatagtgggtttgaatcctggtactgccactagttactaaataagttattaagttgtctaccttatttagtcctcaatgtctttgcaaaatggggaggaggttggtctgtaatgaattctgagatcccttgaagctttgaaaatccgtgagtctctaaattttgatctcataatacatattcatgaaatgagtgtatttttctagctccattacagagatagtttttattatttgctttctaggacatggccttagccttcataatactgtttgtttacagatttcatgaaggcatttaccctggcattgtaccactaaaggctgatgttggcggcattattcttaggagacatagaaatgttgtggttttgagaatgggcttttatattatttggcgtagattattaaagaacagttacctgtgtcatgaaggagaggcccccagactggcactttgaatgcaaattcttctgtgacaaatccaggggactttggaataactctcagatatggcagtagacttaactgtaaaagctcccagcccacagaggtgagcagaggctgaggagtaaacaccataccaacattctgggacaaaatagcctgaatgctgttgtaccttggaaatgcaatagcagctgccttcctaggtggggaagctgagagcagcctcttacaggagtgcatgccctatagacagaggctcatgaacttgtgcttgctgacatgtatatcttcttcagttggtccctagtgagtctacccaaagtgaattgcactggggaaattcagaaatatacacccctcagattcaacaagggtggtatcttgtgtgtttcctttaagttataccagtttatggcaggggcaatgttcaaaatagttaagaacctgcacagcatgagcacacctacctttaagaacagttgccagtcatagagaactggtacagctcccctggtgcaacccactgatggtcagtctggggccaggggtgtctttggtcacccacacccacatttggctggactgtgaggcctgggacttgaaccacatcagtagaaattgaggctatggcacctgggatgtctccttgtgacagttacgcaagaaggaaagtgaacagaatgtggatcccaagggttgggtagggtttgtccagagccttgggtcctttccagaaggagcttgggcccctgtaattcagagatattcagattaactgatctggtctcctgccagtgacaggcctcactcactggaccattctcctattcagaaagctgacataggatcctgtagcaggaatgatcagtgctggctgcatcccttttatatttatgtgctatgctggtatgcagctactagtaactatatctctttgccttttctgcctaccaagtatcttgccagaggtactgggagtagatgtgcagccccccgcctttgcagtagccctcaaccaatgactgactagagtggacacgtaaatattccctcatcccacaaatgggataactctgttctgctcatgtgttgcacagtttcccagagctccccagcaagattaagttccaggtgctcagggagctgactggcttgatgttgctgcctttgctggttgcctgtccttctgtgtctcactctaccccttccctactggtgttttatggaaccacctctggaataaacaacttgctttcaaacctgtctccagctctgcatctgggggcgcctgcactgacattctttattccctagatctgtgtggcttgctacttttttctcccaccacatcacaggtaatgaatgaggctcatttgcacaacatacaactttggacatcagattttggtgaaactcaaaattacttggtgagaaagaaaagcacacatatgttacgctttttttttcagcatttcacaatattcactaaagcattttataagcaagtgagttgtaggagctaaatatgatcaatttttaaaaactactttttttttttttttttttgagatggaatcttgctcttttgccagactggagtgcagtggtgtgatctcggctcactgcaatttctgcctcccgggttccagccattctcctgcctcagcctcctaagtagctgggactacaggtgtgcaccaccacacccagctgatttttgtatttttagtagagacagggtttcaccatgttggccaggatggtctcaatctcttgatctcatgatccacccgccttggcctcccaaagtgctgggattacaggcatgagtcatcacgcccggcccaaaactatttactttcatttttacccaaatttatttcccctggacgtctacttcacaagcagtaacataagcaagtatgtatcattaaagatttatcacaaatcaaccatattatatcgtaagtaaagtaaaactggtgaaacaaatttaatgcagtatatcccaaaagtaattatttgagcatgtaatcaatattaaaacaactgtggagatttttacatctttgagtatctgctgtctttgaaaactcatgtgtatgttaaacttaattcagaccagccacattttaagcgctcaaatgccacatgttatctgtagcaaccatatggggcagctctggtctagcacatgaacttcagagttgtcccactcaataggcaagggagctggggtaattatacagcagttcccatcagtcattgagggttgctgcagagcatgtcagaggcttaattcttaggcactttcctggcctgcagaaaaaagccctctgacaaagagatggggatactgactagatagaactgcagtctgtgcaggttacacagtgataagaccccaggtggaaccacttatagctgactacattttttaatatcttcactttggtgttttattattgtcaaattacttgcaataatgtatcttaagttggtcactcaagaaaacttggttaaattcatgggcctagaagatcaacatcaaatctttgtcttcaagacctaagggaatctggatgtgccctacacatatctacttgcctctcgctaatctttctgctaagagtgtccttctcctgcccctttccatgttatttctgcccaccttcatcctctgatcatgtttatttttctctctggctggaatgtactccctgtttttctgcccatcaataggcagagcattttacaagcaagtgagttttaggatcattctttcagatgtggctcaattgctacctgtctctggaagcttcatgtaataacttcagtcaacagtgatatcttttccctgagtttctcttgccccttgatcttcacctgttcctttggcaggtcttatcaacttcatggtttatttcctgggtaattcatttaccagcatgcattcaggaggtgcctgacagtcctcacttattccctgtagcttaattaacaccgtctcttaattcttcatgttataatcaatttatttggtattttttgctcatatctctcatagaaagacaacagatgagcaattttggttttatggtttactcatgtttgtaattttaaactctgaaaattgaaaagctttgatagttgtcaacaaagtacccagaaagaaggttgcccatgagagtggctaaagacatctagagtcatctcaaatgcctccacaaatttcaaagaaaattgtcaagagaaaagttaagcacctcagtagcatttgtaaagagatgacaccttatgttctaaatattctcccagtattctaaaatattctaaatgctaaggaaataaacacaattttatttataatcttatagccaagtatgtttcatatacattgatactatttagttgcatttttatatgctttaggagcaatgggaaaggcaaaggagcactgactggaccaggggttagagctctgcccttgtctgctgagtggccttggggaagtcatttaactgtctgcctttatctgcaaaatggtgacccaaatgggcccccttccagctgtcaaattccatgtctgattttatgatgtctgccctttttaagaatgggaagcattgtttgtgatttcacattgcaggggctatttacatgtatgatttgcatcattgattttatgatacattgttgagagtatctgtgatttttttggaagctgaatccttactgagggcatgctgcccctagttatgatattgctcctaggaagaataaaatctgcttcacaatgtcctttttggtatgatttccatgattgagaaaactggggattgtatgtgtagtacatctggtttatccacttgtctgtccatggacactttgggttgtgtctacccttggctactgtgaatagtgctgctatgaacatgggggaacaaatgtctctttgagttcctgctttcagttcactgggtaataaacccaaaagtataatttttgggttatatgacaattctatgtttaattattttgagaaatgttcatattgttttccaagcagccactcgattttacgttcctaccaacagtgcacaagggtttcaatttctccacattcttgacaattcttgtcttctgtttttttgatagttgccatcctaatagtcatgaagtgggaaaaaatagtttttaaaaagtaacagatggataaacaactaagagaaagaaggaaggagtgaaggatggacggatggacagacttggctgccctatactattatcctagtcatcattgttaaatatagttgtggttggtagatacaataccgataataataatgatggtgtaatgagaatttttttaatgcaaatatagttggatgcatttgattaacacttgtgctagcctttactcaggctagatttatgatggcagcaaaagaaaaggtcatggtttttatgtctaagacttaaggaaaatctaagtgatccaacagaatattattaagcaccatccaaaaaattatctggatagaagaggaaatttttgctttagttgccttagtgattcagcatatgtggttgatatggaaatgtattgcatttacccaacaaggaactttgaatggtaatcctaatgtacagtgatgaatgaggacagaaaacaagttctacagagattttctggcttgacacagctgccaagatgtcatcagtaacatcttccattgagtatagtgaatgaattggtgctaaacttaagtacaaacccaataacgcagtcaaaaaaaagccagctgctataagatatacttgggtaggatttttaataacaaatgagcaatatattttcagcaggctatatatatgctgtaagataagctttatagaagcagtacactttgtatcttatgttgactactaataatgattttcatttaaaagcacagcaaagagatccatgtacaaagtaatataacccacttaaaagactgcacaagcaaattaaaataaatggggaaatttctcagggaataaaatttcttgaagattagaaacactgttcctcaataaataagcacccctggaatgtttagcacaaaaactctatgcttgatcgttttactatttcagcaggactgtcagagaggttggtctttgtggagtcctgttcctttcaggtgtttgtaaactttcttgccaaagcccttcccgactgagatggagttgatattagagccatggctgggacaaccttcatgccaaaggaggtgtgctgctagttgcaactcagaccctgcatggcccgggtgacctcagttgggtgggttcccctttctggggctcaacttcttcatctgtaaaatgtgaagggggagctgatgatctgttgtggggatgtcatggatgttcattcattcaagtgttcactgaacacctgctaggagagaccaacctctctgacagtcctgctgaaagatgaaaacaatcaggcacggggtttttatgctgaacattccacggtgcttagttatttattgaagaagaatctttctgatattcaaggaattttattccctgagaaattatgtgccaggcactactctgtcactaggagttcaacgataagcaaagccagagaagggtcctacccctgatgtttagattctagtaggggatagacagtcctcaaccaaaaagccccacaaacaaatgcataaccacaacttcgataagtgccatgaagggttgatggggcacatggggggtggggggctcataatgggaggatttatttcacctaggcagggagatcaggaaggatcccctggggacatgatagtcagggggctggagaatgtgggttatgttggagaggaatgagttttgaagggataggagttgctgggttctcataccagcacagcgtcttctctctcttcatctcaatttcctcatctctctaatatgggcctaatatcaagaccctttctcagtgttgtgaggtttcagaaggatgacatatttgacaacacccaatatcatgctggcacatcacattttcatttcatttctaaaaataactttggaagcagagatatgctgttttagtcaaagacttttttagctttggagaaagaatgaaaccccagctttgagactcctctaaaaaaaatctgagttcacattctgccctggaagttgcctggctgcttcccttaatcacagagccttgtttgaatcacttgactttgaaatcccaggaatgactttgctgtgtgattaagtgacagaggcccaaggtttggggattggcagaagtttagatgtccctggcctgatcccttaccctttacatataaggaaaggaagctgatcacatgaacaactaaactggaatgaggaggcagcccctcctccatggtcctgggctcatctatactgtctccctgccaaatattccatggaaaccttggacactgtctgatgtcaggactacttatgaatgcctgtccacttccttctcaagataaagctaggttagcactctctcataactcaagcctgaggtttattcttttaatcttccaaaagcaaacagaagaacagaaataacctatccactgtttaagattaaaatggccaacaataataaataattgccacaatagcttgagatcagggtcttaatttattggaggccgttcaagaatttgcagctcttaagttaatttttcacatcttgtttggatcctcagagcccgtgcttccaaagcaaggccatcatatttctcattgcacatgttattcttgttgatgtgccagacatgcaggagagtgaggtcctctcttcacagatgggtaatgaggattccacccccccagaaattagtatttcaaagtatttttgcctatggagattttgaagagttctcttcttttgcatggtgtattagctgtattaatggttgcaaacaagaaaaacgtatgctggttaatttaagcagaaaaggaatttattaaaaggatgtggggtggttcagagcatagacaagaaggctggggaaccaacacaggcaggaaacagaggaggcaagtcttagtccagggttccacctctgggccctttactcctctgtagctacttcagatgatccctggtgtctctgtgcaaccctcaaaatttgtagccctgggtgggagcatctgttctcacatcgctgccacttgatcacccttagatcacatgatttcacttaggcaagtgcccacaccctagtgatcaagaagaggggaaagagagggtctgccccctttctgctgatgtgccgccccacctatcttgagattcccccaaaacacgaggatgtcaggatgctgagtggccaaaaataacaaccgttcattatacaaacccttatatccttaattacgtcttccattaactggttatccgattaaaactggccactcacatggatttattttgttcaaaggtcgcatcacacaataatcatcagtctctcatgcatcttcatccttgtcatcttcagcctcagccttatcaccgttctcatcctagccccgttcactcacccctgtcctgggcccccatttccctccatctcctcacctctcaaacgttcacctctttctcctccaactcccagtctttcaccctacttctatttcactacaaaatagaagcaatcacagaggaattcccgcatgttcctaccacccatctactaatgcatcttcagctcacctccagccaggcgagaacagtcattcatcagaccccagcaattgttgcctgtcgtgttttcattaattgttgcctctctaatggatcattcccattagcttgcaaatatgctatgataattcccatcttaataaaaaagagcaaaaaaactccctggagcccacttcccccaccagctaccatccaatttctctgttctcctttagagaaaaactcctccaaatagttgtctgtcctcattgcttccatttgttctcctcctacatctctgaaactctctccagttaggctttcctcccatcgtgccacttcagcagttcttatcaaggtcaccagtgacctccagaaggctgattccaatggccagttctaattattcccattgttctggcctgtctgccatattggacaaaattgatccttcctttcttgagactgtcctctgtgaccatgtggatgactcctctctcgattttcctcttccttctctagccatgcttttccagtcttgttggctgacacctcctcatcttcaactcctaaatgtgagtcctcatttctatctatactcatttcctagtgatcgtttctagtctgtcccaaatgtatcctagcccagacccctccttcaactccagactcatgcatccacctgcctcaaaatctcctttaaaacccaataggcatttggattttctctgctgaaccttctcaacccagtctttcccatctcaataaatgacaacttttctcttctagttattgaatccaaaatccttgaagcagtccttgactcctcttttcctaacacccttcatccagtccatgagaaaaatctgttggcatgacctttgaaatgtgtccagaatatgaccccttctcaccccctcagctgccatcaccctggccttcacgttcatcttctcacacctggattgtcacaagagcctcctactcaggccccctgttcctctcctggccactccacagaccgttcacatcatagccaatgcgagcctcctttaaacactaacgtcaagtcacgctgctcctctgctcagagccctgaaggggcttccgagggtcaaaccaaggtccctgtgctggccctcaaggccctgtgggatctgctgccccaactccctcagtccctctgagctcaatccttcctgctctctttatcactcctctccagctgcactgacctccttgctgttacctgcacatgccaggcacacgcccacctcaggacttctcctttgctagtccccacataccgtgtttcttgctccccttctttcttcgggtttgtactgagaagtcacctcatcagtgagacttccctgatcaccttattgtaaattgcaccccacctcccttgtaagtctggcatgttctatcttccttaccctttgtaagttttctccacagttcttaccacaatctgacagacatatttgcttctttctatgtgtgttttctctctccctgaagctaccaggactctgttttctttgctgctacttccctagcacggagtagtggctggcacatggtaggcactcagaaataaccgcatgaattcatgtacaaatgaatcccacgcttaggttgttaagtgccttatagtttttgaagtttgatgtacaagatttcatgtgagcctctaaacagtctagtgagttaggcaaggtagaaccctgtgctttacatgaggaagctgaggccctagagctaactgattgcccaaggacacatggctagttaatggggctcctggaacttgtagttctgatctcggtttctgccccccaccttcaactaccccctgtgcctcatgttatattagtgtaggcctcagggcattcattgctgtctatttttcgttacagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggtaaggagggcatccctgtaaaaagagcagttgttccatctggtgcgcttgctgactttcattattgcctggaataggcaatgattctacaagcactaatcctttctgtggactatcatttagaatgattagaacttttttcttcctgggcttagaaaacatgttggtatagccaaagaagcagccgtaaatgcccacagagtgccagagaagtgtctgtatttatgtagtctcccatcccttctctcttgtggaatcctctccctatggttttacatctggccccttcttggagatgatacagttgctgtctccagcacacacatgttctagagaattccagttttaggtcagtagttgtgaaagtaagggcagatcactgcttgtcgtgttagttattatgtatgatgtacttgatgtttctagtagagggtcactgctttggcctgtgctttggattatttatttatttattttttgagacaagtctcgctctgtcacccaggctggagtgcagtgccacaatctcggctcactgcaacctccacctcctgagttcaagtgatcctcccacctcatcctcccgagtagctgggactacaggtgtgcacctggctaatttttgtattttttggtagagacagggttttgccatgttggccaggctggtctggaaatcctgacctcaagtgatccgcctgcctcagcctcccaaagtgctgggattacaggtgtgacccaccgcccctggccttcctaacatatttgagtgaattgaggtagttaaattatttccacaaattgagtgagtttttttagagtaaattaatttgaatgaagtgaagtttatatagcatgactcaaaggtacagtgctggtattctcccctacccataatcatcccgagtgtaccacctctcagaggaagtgaacaggcttccctgcagacaacaagggggaacaagtggacaaaagtcgactctgctctacccagtgttgctctaactgctgatagctgttcagctgggactgcttgcagctttttaatatttacagcattgaacggggttgccttgttctttatgttaaaatggaaccaaaatcactttctgtggaaaaccttcactctgcccaccgatgagcactgggcatacattgagcaggtcaacggcgtttgttcaggcacatattctgtggcctcaatagtgttgacaggtttgtgccaagcctgcccagcttaggggacagctgaaatgctcagagccaccaacagtagaggcactccaaaactttccaagaagtcatctcagattccctgctgcttcatagcttttaggagctccagggttgagggaggccacaaaagcaatcaaggactgcaggaggggtgtgctttccatccactttctatattctaaaaattaccgctggattaagcccagtcaagagagaaccaagtatctgtatggttcaagtatcgctggccacacacacagtatcttttacagaatcgcatgtgctgtgatgccatctccctgtgcagggtgggttggtaggtgggggaaaggggcttccttggggatttgatctgtggaactcatctctgtggtaactgaaaagatgtaattggcaactggctcattacattacacagatttctctcactcaggacccatgcgagaaatttccttccagcctcatttaagctatttccagacttagaaatagctgtccctttgcctgagaattttggcttgtttttaccttgtgactgactaggcttcattctctttattggctgctagaaagctcagagctgaccccactctgtcagtatataggacttagtcttactattttataaactcactagcctcctgtatcttgctttgctccccctttaccatgcttttctttttagcttggagattgcataatattctaccatatggatatactgtggatttaccttaaaaattcctcttattctgtatttaggttattcccagtttctatattaagtaaaattgtgagaaatgtcttttatggagattagtaccagtaaatgatcatatccttagctctataacttttcagagggtgtgaagtcacatttttgaccacctactatacaccagggactttttgcatctcgtccgcatcccctcttcactgcatgaggcacaatgtgtgtgaattattggaggagcactctcaggagaagaggggcgagggagcagggaggggcaggggatgggctgggagggatgtgctgtcgggtcaaagctagccttggtctgatttatgggctgggaagaggtggggaagccctggagcataaatcactctgcagaattgtccccccttgaagctgctggggacagcatcattttctacccctgtatcgtcattggccactggagggacgcaggcgtggtgagtagcctcccaagcatgctggacaaggaggctctaggaagtcaaagacaatgtgcctgggaaggccacaggtacaagccattggccactgtagctggccatgggaaaaatgggagcacatcattttgatctctttgccattgaattccagcaacctttgaaacctttgtcacaaggaaccctaggtttcagttcgacagaaacttgacaaagcatcaggctcttcgggacgtggtgagtgttagctccagagtggtgatggagcagggaggtatcttgtagctgctgtggaggcagggccagccagaaacgcagatgggcaagacgaccctcagggtggcaggaaaaggaagggaaaagaaacagaaactacccttccaggactccagccacgctgcaaggttgataaacagcggatgtaaatggcatcacccagcaccgggtaggattctgacaggacccagtggctagtgaggggcaccaggagagcccccccaacctgcttaacaacccacaggcctaacaggaccaacatgggcctgtgaaatattctaatgggtaaactaagaaaagcatgactaagatacagagggaaagcataagttttaaaaagattattaatagaaaacaaaagtaaattttacagagcatctactttttgatgaaagtcaaaaaaaatgaacaaagtggaagatcagacagtagaacaatagactgtatgaaaatggaatggactgggaggcaagcaaaaataaatgttatggatgggataaagaaatgttacaatgaaaccaggaaatcagtggcagaattaaaatatgttatagtcaggaaagagcagaatcagcagaacagaaaattgatttaatgatgcggaggtgtttttgagaggctctgagaattcagagaaaaagaacaaagcaataaaaaaggatgacatgaggactatattgtggaaggtagaaactggaaaacagcaaagagaaaatggttccagaataattggaacagaagccattccttagacagcaaaggaggatctccatttcctgaaatgggtgcagcagacaccaggcaaaaatatttaaaacattttaatgtctacaaatagcttcatgaaatttttaattttaaggatatgaaaatgatactattaacacttagcagaaaacaaagaaaccagtttctacagacttttctgtaacattaatgtccaaaattagaacagtatattccattgtgaattttaaattcaacacacagccaacttgccctccattgtgacgtcaaaataaagatatactcagatatatgagaattcataggctattacctcttccagtttggatttccccaaaagcataccctgatacaatgatacaggtacaggtagtttatttgggggtgggcgatctcagtgttgagtttagacaggaaagagaggaaagacaggaaggcgtgcatttataagcaggttactgccgtaggcaccttgggcttgtcttcctcagaccctccaagagactgtgtgtaacaaacctcacatccacttcactccaggatgaggaagctgctggaggaccgatcccccagctcctgtcattcatcatggagaaccattccctgggcatgaactctctggcacttccagccttctctaagtaggtccacactgcctggggccaggaagcaactcaggcagaaagatgtgggaagcctttgacctggaggggcatggcttcaggtgaccagaactgtggctggttctggggaatgtgagcgaggtgctggccacatctgctatagtaaccatgagagcttcctgaaaagtagttatttactgataaactactcaagaatacaaaagtagttgaataaaaagtgtgccacagccaaataagcatagaatgaagcaaaacaatttttataaatatttacaatagtaagcaaatgtaaaaaaaagtattgccatggtaaatgcataatttaaaagattaataaaaataatcccataatctcagttataccaataacaatttgagaagaaagttgacattgtgactcctctgcttcactttcttcaggaaggagttcagactcctcagctcctcatgagaggccgtcctgagcctggtcctgcctgcctgcctttctccccagacccctggctcaccatgcccccacatactcacttgaatcagtcgccacttaataccaaagctgcctttacccaggaatcacccccaccccccatttttgtttaatgaactactatgtccttaaatctcagcttagggagcccgtgtgcaggctcctcacctggctgcacaggatctgtccacagaatagatggatggatggatggatgggtgggtgggtggctgaatggttagataggtaggtaggtagatgactggctgggtgactgggtggatgagtgggtggatagttatgtggataggtgagtggggatggctggctgggtggatgagtgggtatgtgggtggatgggcaggtgagtggatgactggctgggtggatgggtgtgtgagtggatggctggctgggtggatgagtggatgggtgagtggatggctggctgggtggatgggtgggcgggtaggtggatggatgattattcattttgtgcaaagttacagagactcaaggcccaggcctccaaggttacctatcttctctgtcatcacacagtccattagttatgtattagcttctaagactgaatacaaaatatcccctgcaatggatttttctgtcttctaatgcaaaactactttcatagatttattctggattattttttcctttgagggaaggctgcttataaaaacatggggtacacatggatgaccatctgctggcttttttctctcctaaataaagctaacttgaaaacacattataaaagagggcttaatttgttggtggctactctgctggctggcgtgtgctgtccagccagagcacagggtattatggccagcaactgggtttcctcaggggcaggcccagtgcaccgtgttgcctgccgggcaaggaaccagcaaagcctcactacagagtgacaattcctggggtgccctgtgggagcagtgagagggagctcctggggccggggggtgctgcatggttaaaaaggagcataaggaagaatagataaccactgcatcacaccagggtcaccattcacactgggttccatgtaaacgacacctccacagaatataatgtgagtggtgtccctggagatgtacagctctatggccctggagtcaaggtaaagcctcattttaattttttgccctggagccgtttggcacaaaggactttggctcttcttgcctttgtcaaacagccatgaatttgtttggacagcagttgttgaatgcctgctaaatgctagggactgttccagccacaaggagacacaaagatctagtccctgctcccagggagctcatggcctattggggccaaaggcatgtcagtaagcaattaaagcacaaggtgccagctgctctacagaggtgctgaaacgttgtttgaagcacagatatgacaaggtgaagcaagtcattaccacagtggctagtgccatgttggacagaatccttggataagtgcttaaggtacatggatgagcctccaaaggatctgatgtcagctgattcctacattgcagagctagggtgggtggaatgagtcagtttatttggctggtgaaggaggaacctaggttggagcagggatgagagggtagaagagagcaaaggaggaggggcaggagagaacccggtaggatggaaagaggctgcccatgttgaacaaagggccagtaacatttctggtggcagggagatgtcaggacattttagaaatctgatgcctgctgttacaggcctgtcaggactttaccactcataggttctaagaaatctcccctccccacctcattctgttttgtttttagcccattctggatttctgcactcatgcatgcctcatgtgaccagggataggcagggagaaaaactcaaggggctggggttatgtgtacatcttcatggtattgactgttatggcatgcatggaaacagacctggacatgaaaggataagcttcaagccaggtgcatgagggctcccagctgacttttgggtgcaaacaggatgcaacagcttgccacagagtgatagaggaggccatgctaggagagaagggagaacaagcagggcaggcaccctggcccgactcttacacacagtgtgagatgctctcttggtttgggtctcccagatggcgaggaattcagggaaatttctttatttgggagatgcaagaaataatggtagggggttgaagtgatatagtagggaggtgaaacaatggtagggaggtgaagttatataggcaggaggcagtgaatgaaaagtgagctgttaaaccaactactacagtgggcaatggggcttattcctgcagggcaacactaggaagagtaagggagctgggggttttatactcctttccccaagtgtcaagaattgaggtctcctggggctatttatattctccagtactcctgccctcccatatgcatggcaggagagacctacatggttttggaaaaatgctcttgggtgcagagatgccgtaatatagcccctggcagctggaagtgggctggagcaccctgagagtgcaagtaatgtggtcagggctcaccagcctctgccagagaggcccacaggattagaagtatctctaacctgagcacctcactttctagactcctagaagttgtgggttggtctgatagagcctcgctgaggttcttatacaagatctagtagcatacacctcacagtgtgcaggagttgggtgaggcaggtgtggtatgtgggtgaagaggaccagggtggggcaggaggaagcagtgaagacagtgggaagatggagggttccagcttcacccacagggcagcaggctcacagcagcattcagtggttgccaggtgggagtgaggcccagcacactctattttctaataaaaccgagagatcttatgactttggcagctaattaaaatgttttctgaacatcgtatgagccaaacaaaacatgtccagtgaccacctccagcctgcaggccaccagcctgtgacctccagcctggctgttttccgtatgttctagtccggatctgcatttctggtagaactagtctgtctgcagccttactgtgtttcatgttctccccttggcaacagataaattagtcaaagagatgagagtttggggcttcaagtgtccgagtgtctggggaaggagaggagtggagagggtcaaccggaatgtagtgtccatggaatttttagaactcatgatgttttgaaaactatttgctggctggaatatttgtacttcacagtgattgcaagaagcagctaaactggagtttgaattttagaagctgctagaagtaaaataacaggcaaccagtgtgaaatagagggaaagtgtagctttggtgaccagcagatgcagagttgagattccaactctgtttcttgtggccagtgtggccttggctcaagggtcttctctctgtgcctcagtttctttctctataaagtgggattgtgccaaggattaaatgagtcctacaccatcatgtacagtcccacttgtatatgatgggtactaccatggtagtcccgactctgccacacatgagcttatactttatagctcattcatttactcagaagagatatactgatcacctacttcagaccaagattaaatgctgagggggaagaggaaaataaggcaagaatataaaacatagaatgtatgtcagggggtgataactcttccttttaagccaaaaattatcagtcattgtcttaatgaaggattgagagagagagagagtgtgtgtgtgtgtgtgtgtgtgtgtgtgtgtctacatactgtaaaaaaaaatagagacagtgttaaactgacatctcttaatttaatgagttgcttgtacttaagaaaataaaattatatgaaaattaatgtgaagcagtaaatataggtcagtcaataaatgtctgtgttggcttttgtgactcctgattttattaaaataatgcttgttgattttttttttcccatttacttaccattttgcttaagtattggagtttttggtttagggatattgactttttaaaaccaagatatataattgttcaaatatgtgatgcacgtaatacataatagcgaagtttagataatgaggagaataatgccctccaaaaacaatggcagggggctaggtcctgactctttcagactgggcagggaggcatctggcccaaagggctggaggagtgcggtatgggattcagactttttatcaggtaggcagtaagtgaggtcttgactgagagaacagagaacgaagaacagaggctagagacatcttagaggaagaacaaagaaacagtgctgacaggccaggaaggtcagagactcagtgttgggactgctggaagaaagacaagtgaggaagaggggtgattgtgaactcagcagggagaacccagatcctctactcctgatcatgctctagcgcacagagcactgtaagctcgtgaggaatgtgcttcgtacctggcatcggttggccataagtcactgaatttggctaataagatgttgcattgtctctgatctccttgagagactgagatagatggataggccctaggtccttatttcctccatgggagggtattgtgggaggggtgatgatgttcgaagggaagctcatttttgctgtttctaaggagtataatttgagttccaaattaaactggtcttccaagttggggtttggaggcagtaaagcaccaggtcaactttcaaggctttcagtggctaattttttatgacagaaggcatcgagggcttgtaagtttgtttttcttatcaagtgattcttcagattatatctacctttaccacagaaagggtggtccctttctttcaggagtggttctctcttcactttcaaggcaaaccgctcaagatggcaccaggtgataaaacagatccacttgctaatctggatagagcaggaaggacttaaacatttatgtgtttgtatacctttatttgagggagtgctttggcctgtttttagacagaaggttccatacagaaactgcatctgggcaggagaacaaagcaaattgtgttacagccgggaaaccaagcattgagcaacagaatggttcttaggcagaagtgagcctcatccctcagtgctgggacagattacagccttccttcactgccgctttcattcagcgcagggactgattttcattgtgttctgctttctctggtgtctcttgtcaagttaatagtagcctcaagtaaaattcaacccttagatgtttatagtcatcttggcctggccattaagatgatgaatgaacttgctgcttgccctggtaagagagccctgagggtggatgccgatacttagaaaataataagtcttttccgcccccttcctgtctttaatccagtgccccaagccccctggtgactttaccttgaacttcctgtataacgccaggtagaaaagcctcacctggctggaagcccactcgaggctctaacacaacagcaagctctttatcttgctttgttggtcttccccatccgcttatcagatggaaactcggcattcctcagagacccttcagtgtttctcagttgcttctgcaggcccttcccttcctccttgagaggacaagagaaggtggcggggagcaggcacccccagcctgtgtttgtatttcctcacctggattacctgtggcccttgcatcagggagagcccagccttgagtgaaactgcctgggagacaggctgggcgcttcctgcggcagtcggcagtgaggaagtggtggagaaacgcagatgtccatttcaaatcacaaggcggcttcagtattccgccgcggggctcagctttcacgtatatgaaaagcttcatttgtgtattcactgcgtttggaaggaaggctatgttttgctttagaaatgtcaacagagctgtagttacgacaaggatcaattaagaaggacgtttcccagagccgcaagacttgagtgaatctgtggggggaatttagaaaacatgtgttaaacctctagatttctttttttctaactaactgcaaaacagcaatttaataatttcctcttttaaggggaaaggggggagtcttggattttaaatcttcctaaagcagcacagcatctcttgaaaagaaagccatgaaagactactaagctaaggcgaataaaataaaattttcaaaaatcgagaacttcagtgtcctagtctgggtttccctgagcagatcctgagatgagggctcacatgcaagtggttcataaaggatgtgtttccgggggaagacaggtagggagtggagagacgcaggacagggcaggactgaaactcaggcagggtccctcagagcgtggcctcagcctgatgctgcaagggggatcagaggtgtgagttacgccaaggtactgttccatctccagcttaggaagctgagttttgttctcccgtaaacaccagtcattggttaagggccacttagggaggaataagtggtagaaagtggtcctaggcactttccacccaggggtgaagtgtagacagtggggcttcaatagcttaagggcagaagaagacccacggttctggctcttggagccaaacgaagactgaagccacagtgtgcatgtaaagggagtccaaggagcattgggtggggcattgaaattgtttgctacagtcggtttaccttcaactggtttccttcttgttctgaaggatatattacaagcatattgacaaaagtctttgaactcttgaggtgtttgtatgatattctgtgtcagttgcacatgggatgtttctaccagcatctgaattggggaattgacatatacagatgcccgtggaatttaacagagaatgtgaatgtacggctacagtccgtcaccatccagcttgccagggctgtcatttcatccttttgaggccaggcttacagacagtctgggcttccactgcccccatgctctgcctgtgatgtgtggtggcctctggcattgttgtaactcaggcacctgagcataactagtgagcctgtcctgctctcccaagcaagtctgtgtttaaaatcagttaggaatatgttgggctgcatgtaacagaaaagccaccttttttagcagctgatccttgtgagacttttatttttctttggtaataataaaataagaaatgggcatttcagggctagtatgcacctgtgtggtacccacaggaaccccattccttctgtctttcctctcagcctgtcttcataggggttttcatctccatactccaaggctgggctttccctgatggtgctttttggtttccgcttccaacactacagctgcattccaagcaagaaggagaaggacaaagggcaaaaggtctgcctccttttaaagagctttcctaaagctccacttgacattttccacatatatctcattggccagcaccatgccacaaggtggggtggcaaatgaattttctcagctgggcacattgctactctagacagagtcagagttgtgtttattgggaggaagggaagagtggccattgggaagcaccagcagagtcagcagggcagagacctgagagaggtagtttgtgagtgtgtatccctgagatacgtagcagaactggggaaggactgcccagtgagtctactcccttcagtatttgtcagatcctgctcaattataagatgatctttatctgtccgccttatctatcttcactgacgtgtatttcttattttcacaaaatgaagccatttcaacgatgttgtcaatgtgtttggatttctgtccttcaacagaggtgccacagctccatactaggtcaatccatgcaataaagaccaagttccagaacccctgtccttcagaccatttggtatatataatttccaggcccttcttcactgttctgtttatcactccctgtgctgtctctagtttggcatcttcctttttaaaatagaacccaggcttgaactgcaattcaaccagcccagcatagttattattgtcccgagtctaaacatgatatttctgttaatgtggtagccacagcacaattctatttattcttgaggcattccctcttttattttcttggtctttttgtgttatttggaagtgtaatcatgtcatttatacccttgctactcgaatatggtccatgaaccagcatggtgacgtcacctgggagtgtgttagaaatgcagaatctcaggccgcagccctccggggtcaggatatgcattttaacaagatcgttgggtatctgtatgaaaatgaaaaattgaaaccagggcgagatatccagggcctcagaggaaaatctcaaaatggtcagggaggtcccttcttagagatgagaaagtcactcagaggctgccatggcctaagactgagacaaagagaatatgtctgtatacaactaaagaaaaagagaaaaggttcgctgggccagagagtggctagagactcgattgtactcagacttgctgtattaccaacaggtaatgtacaggacagtcatgacctacacctggctaaatccagtagtcatttttcagtcttctttctggacccgtcagcatctattagtacaaataacgactacttctgttattattattattattattattattattattattattattatactttaagttctagggtacatgtgcacaacgtgcaggtttgttacataggtatacatgtgccatgttggtttgctgcacccattaactcatcatttacattagatatttctcctaatgctgtccctccccttgcccccaaccccacgacaggcccccatgtgtgatgttccccttcttgtgtccaagtgttctcattgttcaattcccacctatgagtgagaacatggggtgtttggttttctatccttgtgatagtttgctcagaatgatggtttccagcttcatccatgtccctgcaaaggacatgaactcatccctttttatggctacatagtattccatggtgtatatgtgccacattttcttaatctagtctattattgatggacatttgggttggttccaagtttttgctattggaaatagtgctgcaataaacatacgtgtgcatgttctttatagcagcatgatttataatcctttgggtatacacccaataatgggatggctgggtcaaatggtgtttctagttctagatgaatcaccacactgtcttccacaatggttgaactagttgacagtccccaccaacagtgtaaaagcattcctatttctccacatcctctcagcatctgtggtttcctgactttttaatgattgccattctaactggtgtgagatgatatcttattgtggttttgatttgcatttctctgatggccagtgatgatgagcattttttcatgtgtcttttggctgcataaatgtcttcttttgagaagtgtctgttcatatcctttgcccacttttggatggcattgtttgttttttttcttgtacatttgtttaagttctttgtagattctggatattagccctttgtcagatgggtagattgcaaaaattttctcccattttgtaggttgcctgttcactctgatggtagtttcctttgctgtgcagaagctctttagtttaattagatcccatttgtcaattttggcttttgttgccattgcttttggtgttttagacatgaagtccttgcctatgcctatgtcctgaatgatattgcctaggttttcttctagggtttttatggttttaggtctaacatctaagtttttaatctatcttgaattaatttttgtataaggtgtaaggaagagatcccgttttccatcatatgaatatgccacaatatgttttctccattatcctgatgatggacattgaagttgtttctggttttatcttttgtgaataaggatactaagaacatttttataccagttttcgtgtgcatgttttttttcatttattgagtaaatgctagtgagtgtaggtgctggctcaaagggtcactgtttagctttattagaaactgccaaatagcttttcaaagtggttctgccttttacaccctcaccagcaatgtataagagtttgagttggtccccatccttgtatattcagtattgtcagtcatttttattttagccattctggtgtgtaattgtgtttctttgtgatttagagctgcatctcccatatgactaataaacacgttttcacgtgcccctcagccattgggacacttattttagcctgttcaagtcttctgcactcccttcttctggggatacttttcttctcctgtgctgtggtacactcctcaccccaattcttctcactcgccactccttttctgcttcctttgttggggtctccttatcttgccaacctttcaacattggagagcctcagggtgcggtcctgagaatgcttttcttctgtgtatacgcattccctggatgaactggtcaagtctcataacttcatatcatggacatgctgacaactcccaaattttcccctccagcccagagctcactcctgaactccagcgttgggtaccaaattgcctgtttggcctctccacttgctgtctaacacatttctcacacttaagatgtccaaaatgagttcctgatcctcctgacacctgttccatttgtaggaaacagtaactccatccttcttggctctcccttttctctcatacaccacatctatttctcaaacaccctgttggctgatcctacagagtatctcataatccagccagttctcaccatcaccattggttccatcttggtccaagtcaccatcgtcttttgcctcattattgattggcaatagccttcttcataattggtttccgtgcttccacctttacctcttacactcctcctcttacactcctttgctcagaagtctccagtggcttctcatctcattgtaaagcttagttttttataatacctctaaggccctagaagatctgaccccgttgctgcctctctgaacatgtgtcctgtcactttcttccttgtagcctcagtggcctccttctgttccttgaaacacactaagcttatccctgcctcagggcgttgacactggctcttcccttaaataggcacatagcccactccccatttccttcttgtctgtgcttaaatgtcacctgattagaaatatcctactactccaaacaccctatctgtcctctttatcttgcttttctctatagaacctatgaccatctggcatactatttttttgttttgttttcttgaaacagagtctccctctgtcacccagactggagtgcagtggcatgatcttggctcactgcaacctccgcctccctggttcaagcaattctcctcctcaacctcccaagtagctgggattataggtgcatgctaccatgctcagctaattttttgtctttttagtagagatggggtttcaccatgttggctaggctggtctcgaattcctggcctcaagtgatcctccctccttggcctcccaaagtgctgggatgacaggtgtgagccactgcacctagccggacatactatttgtttgttgctggttgtcttagtcctcctaccggaattaggttaggtttctacatataatatgcaatgacttttttgagacaaggtctcactctgttgcccaggatagagtgcagtgacatgatcttggctcactgcaacctccacctcccaggctcaagcgatcctcccagcctccggagtagttgggaatacaggcatgcaccaccacacctgggtaatttttgtattttctgtagagatgggggttttgccatgttgcccaggctggtcttgaactcctgagctcaagtgatccacccacctcagcctcccaaagtgctggagattacagagtgagccaccacacccggcctggaatgactttttattcattgattcatacctagtaactgcagcagtgcctggatgtgtggtaggatctcaatctttgttgaataaactaatggatggtgggcaaataaatggatagaagatgggtatatctatctttctctgtactttatgagcactctttcaattattgttttatattacaccagtaatttttaagtagtgttaaaaactagtaaacaatgtaggggtttggagaaaaatgctaattccttatctcccggaaaagggaaaccatcaggaatcagaaatggagaaatgcttcccccacctggtgattgcatcttgctgtatgggatcaggcctgaaaagtgagttaagtctgttggtgctggaactcatcactgaggaacagcctatgtctgtgccttcaggggtgacagacagtggaccaaggccatgcctgcatattcctccctggacccctcattcaaagccagaatctctttcctgccagagcagtcctttgtccacatgggtttctgcagtagcccaagtttgcaggcccttgatagggctggagtgtgagctgtaatcctatgggcttgaaataatctctgctatgggctctttaaaataaccccaagtaacactcatgtcttatttaggtatccccagaagcaaaccctgagataagaattcaagtgtaaagtacctgtagtttgtttgggaggtgaagatagggggatatattaggaagtgagacagagaaaagaaaacaggagaaaaggacagagtgtcaagccagccacaactatgggcagctgggcttactcccactggggaaccctgggtccacagagcaagctccttggggttcttctgcctgcgtggtgaggagtctggggcctttatccacctgctcccagcagctgttgattgagggctgctcctgaaggcattaagatcttgacacttctggcctgttgtttgcaggggcagagcagttttatgacaagaaaaagtcctcaggtgaaaaaatgcaggtgtcagcaggtggagacacagggcaggggatctggaggaacatcagtggggtctgcgacaacctgtgaccacctcacagacaaggtgacttctggcttctcagtgactcagccacacttctctttttcactcactcttctttctggtcctcactaagacaaaatacagaatacagagcagcagttcacgggctatagcatttgaggagattaaatacaggcctccaaccacacaggccatctggaagctttggcctccagatgaggacataacgaggtcatctctgctttcagggagctctcagagtctcaggaacagatgtacatggtccatcagagtgtggctcagggcccagggtgggttggggaaaaggtgagttatttagcattggaggagcctgtttgtagccatggctgccaacatgcatgagccacttagaagggcttagggtggtgagggtacaggtctacctgtgaagctgagtgatagtcacggtaattacagtcacctactatagcctcacaatgagccattataaaaatgaggaaactggggctccagaaagatttctcagccccaggacggtgcagccaggaaatatcatagctgggatttgagcccagcttgtctggacactgagcctgtgttttgcacactatgcacacacttctcccagatgaagatttgccttcatccaaggggaatgtctgtgtgagacagtggcagcctctgatgggttcctgccgattggcaaggtggttagagctgtgtattgagaggtcttctccaaggtatcagtttttctctgggagggttaaagaaggaccttgcaaagcccatggcctttgaatagagagctctgttctgtttgcagtgactcccctcaaaaggcagaatgcaattctctaaagggaaaaaaaaatgaggtggctgctctctggggttaagcagagaaaaccgtcaggcaggagaggtggggctgtatttgagagggtgggagtggcccaggagacctcacggtacagtcagctgcaggagaggagctgctaaccctcatcttaagaatatcactctcttgacaatcacagttgggaaatgtgtaatctcagggtgcctccttgcccgggcatcttcattataaaagcttagtctttctaaatgcagccaagctctcctctgacaagagatgtgagaattccgttgacactcactgaccacctagaaaccagagacccagaaacccaaaggtgggtcacatggtcgccctgtccctggggaatgcacaggaaaagagctctgcctcccggaaggttccaggtgttggggtaaatagagatcctgctgctgcctctactcccttactggtctccctggggacatatttgaacatattttactcataaattctcatctcagggtctgtttctaaccagacctaaaacagacaggtcccccccttttttaatcagtaactttggtttattacagcagaaacttcccaaattactgatctgaccaattagatatgttttaatttttttatgaccggaatcttttccttcaaatgaacctgtttggattctcttatctgtgcaatacaacctaatgtaagtctactttgtaagtatttgttctgagattatttgttctgaaggaggcccaatccagttcagttaaatctgaagtttttgatcaattgggttgctgagattacaactttctttttcattaactattagtacttaaaatattgacatgctaagtttttagtcttctcttttttgacctataaaaaaggtcaattatatcttaaaagtttcaccttctatttggctattgtgtatcattctttaaatatctggctgggttcaacttgctaagattttatttagtatatttgtatctatagtcataaacaagatttctctgtaattttctttcttgtcaggttttggtgtcagatttctgctagtgtttgcaaaaataagcagaaagcttgcacttttctctgttctctgaagacatacaaccaacatagttgcaacagcaggcagtgagagctgacccttactgagagcttgtttatgtgccagaggctgctcaacactttttattaacgtgtttaaccctcacagcaacccagtgaggtatgtgcagttaccatctcagttttcctgatgaggaaaccatggcttagcaagcttaaggaggtgactcaacttccttagtgagtggtggggctgggattcaggcacaggcaggctggtacttaatctctctcctacaaataccagcttccttggtgagtattggggctggggttcaggcacaggcaggctgactccagtgtgctctaatgcatcttctttgcataaagaggcttatttacatgtcttttggggtatgctggctgctcacgtggctttgtagacattaccctctggagtgccaggtgctttgtgaattagatctttcttattacatcacggccagttttttgtggaggggggcaatgggcaaggaagcattgatgaattttctgagacagctgcgatttgtctaaacaaggcttttccttcagtacccaaggattctggcacacagacccagctccccaccagcctcccctggaatgagctttcctgaggtgcccgcgtgtctccactccaggtcctggaaagctggcagcagcctcactcttgggttttcctctctggaattaatttgtccccaagtgaactcaaataaaaggaagagcacctatgagagctttgcctttgactggggctgggaaggtggaaatagcatggtctatcctgttttctcatttgcccgttgagcactgaacgactggaagtagagtatgatgtgaagtcttaccctttgtgagtcagggggcttgggctgtctgcacacactgtctccaactccaccaccaccatccaactcaggcccaatatcactgggaaaaacccagatcccctacagaaatacaacaccggtgacttgctggatgctggtggctttgtgctattggcatggtgggtctgaaactcttgtagacaccaaagaaattggtaggttatggaatgattgattatatcctgtgtcagctggaatcctgcgacatgttctagtttcctagtgtgcagagtacaatgtgggcaatgctgggttgtagaacatctgtgattttcatgggataaaagcccttatttttgttttgttttattttaagtcaaaagcaatttctaccagtaagagactgaatgaataacaggaagccccttgtttgcatggttcagaactaggcattgcaaagataaccatttactctgatttcagaggtctaaaggtgttagttcccctcttagaagtaccaaacttacaaatgggaaagtggatgcttagaatggcatgaatgttggctggcttgatcatgagtgggatcacgatggcattcactctttcattcagcaaagttatgtgttaacaggtattaagtataccgttatcatttttccttactttagaagataagccaaaaaatttgaccttaatgaaaatagaggatttttaatggagatcagaattttcacttataaaagtaccatttacacatttcgtcactgctgacagtcattagctagtggatagatccaagctttaaatctgaatcttgtcataggaggatggaagctcaagttgttaaaggcctaaaaggttgcatgttacatatagaacaaggccctgggaaaggaaatggtctgttgaaagtcacaaggccaaatggcataccaggtttttggtccttgtttaagaaaaccaaatgtaggttcagaatagtttcttctttcttccacgtctctgaaagtccagcttcgtgtgggagagctctgaggccctctcccagccctcgtttttcagctcggggttaccacgtgtattccgtgaaatgctctacctgctttctgtatcggctttctagccagttgcagtgtacaatattagttttggctttgggaaatgaggtttctttgacttggctggaagtatacagcaaccattttatttttcttgtgcctcatgaattaatagggcagtgagaggaaagagcatgcatactgagcatctgagcttttttaaagcaacgattcacccagctttctagtataaaaaacttcctctggcccaccccgagcaaaccctcattcactgctcagtcctcccatttgttcatctggaaagaaggaatgttctagtggggccaggccccatgtggtatcttccttttctgaagtcatccattcattctcttcctggtggggacttaaggttggaggcagcaaaaagtggaaagactggtagatagtctgtcagctctgtggggtgggtgtgccatttggggggaaatgaaaccagaggaagtttggctttgcagagtgaggacccaggcaagttcattttttacactctggttccatctccttccccctgcacacatgagtcagctcccaggaggaccccgtgtccttgactcttccttgctgtctcttcaagctatcaatatgccctctctctatcttctccctctggaattctccctttccgtctcagttggactatctggactttttgattctgcttcttcccaaagtgctcttttcagtccattgtttttcctgagatgtaatgactcaagggtaaatggtacctgtcagttgcaacgcctgaaaccatagatgcataggtgcaggtggtttatttgagtagcgccccagaaagtaagaaagaaggaagaaaaggagggtatgtctttgaggtcactgccattggtgctaagacttttttgagaagcatatagaaagtcacctagaaatgcttacctataggacaggagactggagcactcacgccccagctccaatcccaggttgttaagggccacctccaaggaatggattgtcctgccctggccaggggtgtcattgagtttgggtgccctcagaatgctactgaagatggtacaaagctgaaatcatcagagttgggccagaaagaagtgacacagaacatctaaggcatatcataaaccatttctgaccctgatctcggaacaggatcccagaacagttcaacctgtaattgctttctgacatttgagcaaaagcatcagtagctcttctcatgaccacaatcagtttactaggatttttccataggctcaaagaaaagacagtctatgttctaagtacagatgaagaagtaaaagtttgtgttctggaggggtggggcttcaatctagaccttgcctctttctgatcactgttcttgacactggatctaaattaagaaaaacattaaatctaaaaatgtctaaaaagttaggacatttaacctatactatacaagaagttatcagctaagcaaataaaatccagactttgaaaaaggtaaataaggaactgatttactttaatcacaagttccttctgcttacaaaatgattcatactgaaatttttaaaaaatttcttaacagagtttagtgcaattcacataaaaaatgtacttcagtaatttgcaaatatttacttaaggatttagtaatttagtaatgtttagtaattttttcaacaagttcttttctgtttaagtgggttctcagaagtggttgcaccttcagcaggcaaggaaaatatttatttgaagacgtttatgaaacacctcccttgtttttattatgtttgtgttcttcttatatttctttttatttgcagtaccctcaagtactttgaaggtttggggacagtaaataaaattgatggccattttttgtcatgcatcttctgaattggtatgtttttctgtgttcagaatgtcattcctcagcccccaggggacataagtacaaagtgaaatgaggcgatgtcaggatcacctgtgcacattctgcttctctccaggccctggcttctcttctttccggtagatgaacttgagcacatgatctcaccacttggagcctagtaaaatccatgctactgttctgcaattgttcttttattctttctctctactaatgttttcacctatggatgtcagttctacttctccttggggctttaactaaaaaggaagaattgtctgtggcttcttagaaagtggtgtgtggacaggcaagggctgccctgcccttggctggcagcacaggctctgcaaagggggtgggtgagtgaccacatcatcatggctaccccttcccgagtgcttcctgtgggctaggcagggcccaggtagctcaaaggtgttcccatttgttcttcacagcagctctgaattcattagcataacaaaccacccccaaatctagtgggcttaatacagcaatcatttctatttgctcataactctaggggttagctaggcagtttttcagttctgggccaggctcggctgttcttggccaaccttactcatgtgtctgtggttagctgcaggtcagctggaacccaaatgttgtctggaacaaggggagtgatttagctagtggctctcatccccagcaggctggcccaggctcctgtagggttccaaaagagtgagtagaagttccaaggctttttgaaatctaggcctggaacagacagcatcatttctgctgcattctgttggtgagagcaagtcatgatttcagctcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacagctccccacacaacaaggaattatccaacaatgcacaggacagctccccacacaacaaggaattatccaacaatgcacaggacagctccccacacagcaaggaattatccaacaatgcacaggacagctccccacacagcaaggaattatccaacaatgcacaggacagctccccacacagcaaggaattatccaacaatgcacaggacagctccccacacaacaaggaattatccaacaatgcacaggacagctccccacacaacaaggaattatccaacaatgcacaggacagctccccacacaacaaggaattatccaacaatgcacaggacagctccccacacaacaaggaattatccaacatgcacaggacagctctccacacaacaaagaattatccaacaatgcacaggacagctccccatacaacaaagaattatccagccccaatgccaacagcattgaggctgagaaaccctggattatccctttttacacatgagatgagggtcttacaggtcttctaagtggtggagcctaggtttaatcccatttccgtactcttcagcactcactgtgctagtatccctctcaggcgtatgaatacgtcaagccacttcagcatgatggcgtttaagttttagcttgtctacaaagcagcacaatacagtggttaagagtagggttttgtcaccagactttctggcttaaatctgctcccatcccagcaccacttaatatgtgttgtaccttgggcaagttcaatgatgtctctgccttggccttagttttcttcttcttttttttaatgctgcctcaattacagaacagatgcctaagttttcttatctgtgagactgagctaagaataatgttgaccttataaatttgttgcaaagattaaattagacattcatgtaaagcacttaggaccatacctgagacatagtagcctttagttatttttgtctaattcttctttccctgatacagtgcccaccataaatccccagtcatggtgctgacctggcatgtgaagctggctgggaggaaagagatttttctctcccagcaaagtagtaaacaggctctctcaagcattcatccatctggggagcttggcacacaggacagatcctttctcttaagtgtcccaaggccaaccctgaaccatggaagccttcatttaccatcagtttttctttcaaaacttctgcaagggcataaaaatgggggactaaatagggaccaaataagtgagtccatgctttggaaatgatgacctgagagtgtgaggaaggggagagccaggagctgagtggcagcattgcgggagggctcttcctcccttggttggcagatgggcgggtgtgactgaggctcaccatgggtggactgagcagacgcctgccctcacacacaaccccatgctttcagaagaaggcgtcagacctccttgtatgggaacatcatcaccttcacgctttgtctttaatttgagaagcttatgtggaaggaaacagcacattcttgtgagaagataggttttggaaagtccggagtagacagcatgaatccagggtttctaaagtataccctctccatgcttgctactcaggaagcagaggcaggagaatcgcttgaacccaagaggcggaagttgcagtgagccaagatagcgccactgcactccagcctgggtgacaagcgcgaaactctgtgaaactttcattctgacagtaggaagaggaaaagactctggctgactccttgtgatagagcaaaccaagttgagtgttgtatttacttttctggatttattttcacaaatattcagctcagaatgtgccagggaggggaggaacacaggagctgtattggccacagccatgtgcgtcatcccaggggacacttatgtgagccctgtggagcaggaattgttattcccatcttacaggggtgacagcttagctcagaaagcttgcagtttgctccacgttacaaagctagtaagtagcagagctgagattggaacccccgtccgtctaatggcaatgcttcctcttttgctattctgcctcacaattaaatggagtaggacctgatccccgacatcgagaaactgacggtgttgtcaagaaataaatatcccccccccacacacataaatagagaacaataaaagataacgtcggaggatgaacccacgagcgtggtttgtgtgggaggatgtcttgatcctgggctcgcagggctgtccgctgaacatgacagttatcctggcttcacagtaacctttcagaggtgctctgagtcctgaacatcggagatagattctttatctggggagtgactacataatttaaccatttgttattttttattttatcagactgggatcctttaggagctgaaagggacagtatgaataattagccctaggacaacaggcagaaaccgggactgccccaggcagttaagatgcatggtgaccccacttaatggccaaaatacaaggaaggcttggtgtctccgcagcttcctgaagagggaatgaggggcaaggctctggcctcgcagccagctgagggagcgcttctctttccactgtctgattctgggtctctgcttcctcatctggatagcagccctaacacccactgtattagttatctgttgctgtgtcacaaatcacatgtcaaaacctagtagcttaaaacaacattgattagccctcatagtgggttggggattccagagtggttctggctcgaggtctcttatgagactgcagtcaggatgttggctggggatgcagttgtctgaaggctccactggaggatctgcttcccttgtggcccctcgcttggctggctgttggccacaggccacagagcactcaggaccaaggactggagtggtggaaccctcgtccttcattaacacaagcagggcaggaggatgagggtttgtacctgctgttggcaggggggcctcagttcttcagttcttctccatatgggtccctccaacaggtagctcaagtgttccaccatgtagtgactgactttccccaatgaaaccatccaggagagcaagaactgggcagaagctcgcctttccatgacctctcagaagtcacatagcatcacttctgccacattctgtttttcaaaatcgagccactaagtctggcctacattcaaggggaggagaatcatagctcactgtaaccttgaactcttgggctcaagtaatccttccacctcagcctctggagtagctgggactatagtcacgtgccaccacgtcctgctcattttttaatttttcgtagagatggtgtcttgctgtgttgcccaggctggcctcaaactcctggcctcaagtgaccctcccacctgagcctctcacagtgctaggattataggtgtgagccagtgcaccttgcctaggcttcacctttcaaagggaggagtgtcaaataatttgtgaacatattttaaaaccactgtacttagggtcaatgttctacacttataagttaagtaccatgtgtaaagtgcctgcagcagtacctggcacccattaaaaacagaatcttggccctccagagtccagcagctgcacttctgaatgctggtgggcacggacggggtttgatgtccagtaagcctgagcagccctgcaaatacagatgagcccaagtcacctgtacagttggggcctgaggaagttaggtcagttctgaggctcccccagatgtgggacactcctcacggacaagttcagtgttgtatttacttttctggatttattttcacaaatattcagcttagaatgtgccagggaggggaggaacatacctcctatgcggcaggagctgtattgggcacagccacgagtgtcatcccagggaactcatgtgagccctgtggagcaggctctgagcctcccccagatgtgggacactcctcaagggtttccaggtgaccacagagggtcccacctcagtgtggacatttccatgtgtcctcctgaaaccctctggtgagcatccccacccaccctttggtgtctggagccatggtggctggttgtccttcccacttaggggaaccaggcctcagaactacagctcagaggcctactctgtgggctgtccttttttctagggccttgattaaatttgcttctctgaacactgtgaggtatctgtacttgttttaactcttctagtgacagcaatagaaaacctaaattggtgtaggtaaaagagaatgtagggttttgcaaactgaaagtacctggggttggcttcgaccacagcttctggttggacctctggaagttgtcatagtgtctctttctctctctccatctgtcagcttctcttcctccttttggcttcgttctcaaacaggctctctgtcccttcagggtggcaaaatggttgccaggctacagtaaataaataatctcatttcctaaaagttcttgcaaaaatgtcatagagtctgattggtccaattgagttaagcctgggtcgcatgcccacctcctaacgggttgggagtgaggtggagtggggaggggatggctccccagagggaagggtagatggatgtgggtggcaagaaacatgtctgccatggtattgttatcctcatttaccaatgaagtgttggcactcagagcaggcaagtagcttggccagagtctcacagataatagcaggtgcagaccgtcatcctcctgccccactagtgttgatgaaggacgagggtctcacctttccagtccttggtcctgagtgctctgtggccatcttccacttaaagctctaggacagaccagcagctctggaagtgactggattaaaaccccaccaactgaagacagtggcgtgggatgatggctcgctgatgggagacagaatttctgtctctcctgtcagaagccctttgaagaactcagctgtctggacaacaaaagtgggagcttttgttgtctagaagttcatgtgacctttcctttcaccttttagtgctgcctaagtgtaagatttaagcacagcattcttttcccatgtgtcatttttcagcagttaaaaatccatcagctgaggccacacaaagttggcactccctcctccaccaaccctcagctaaaaggttcagtggaagggactgatgctgtctccagatgcagactggggccatggattgagccacagagggaggagggaggagggtctcaaattaaaaagacaagaaacaaacaatctccccaaataagcagaaagtctgagcgtggaactgagctggttggagctggggagggggtgcgggaggtactttcagcactccctcgtgagatcatggaacagggcaggaaatctgaacctgctgccaaagaaaactcgctttgccttttgtaaaaagcctgtcgagctttcttcacaagggagctgctggtggggactcacaaatgggcatgctgcctgccagcaagggtctcctggccagccctaaaggcccgggctgctctgcttacagccacacggctgtttctgagctgaggatgaccctccaggtggctgagattccctccaatctttttatttctggttgggaaaccctacacagaccagtgtctgtctcacggtttaaaaggctgcatgcaaaacatttcctcccctggtagaaatgctgcattgagccacagccctccctctgcagcctgtgcagtgtcaaggggacagtggctgcatgatgatgtgcctagcagggtgtcccccatcaggacagtcacaggggtggaacaaatgcaggagccatggagccaaactgaactgggttggaatcccagtttcagccacttaatagttacatggatattgccaagtagcctgagttctcagaggcttgatatcctcatctgtaaggtgggaagtataagacctacctcacggtgtcagtgttaaataagacagggcaaaatgatgaaggtactctgtaaatgtatgtccattccttcctcctcctctgggttccttttcagcacttcctcaccacagcaccattcttaagttttctagccccatttattttagaaggggaactggaggcagcttggagggaggtaacatctggatgtcgcagtgacagctggtggctggtgaggagtccacaggtcaggggcaacgggccctgcagacttctcagcatcccctgctcagaaggggctctcagagtccatgggctcagcaggctgattcttcccctctcctatgagaccatcctccatgtgggtcccatccaggaagctgcttccctcccaagggaaggaagccaccagtgtttctagaatctacatcagtgccactcaaagcgtggtctcctgaccactagcatccacaccagctggggcctggtcagaaaaacaaccgtgggctcctccccagacctattgagtcaaactctgggggtagtcccagcagtctgtgttttagcaagcctccatgactcgaatgtgtgccacagttggagagccactgtgctacgggcaggttatcccagagcaaaggaaggaaaacctcctctgcacaatgcactctgaaggccccactgaatacgggcatctgtgaggcagcatgggacctgatcactctaccatatatagctgttgtgtgaccttggaaagttccctcaccctctctgggtctctgtgtcctcatctgcaaaatggaacaatcataatactggattgaggatgagaagcatcaatctgttcatcctagcaaaatgtttagcaaaatgccacgtgttcagagctcaggacaggttagctccatcctgttaatgttgaggcagcccacccaggttaagggtctcattctgagagtggctttggacagcttgagaatctacaactgtaggtgacagagcaaagaaaactcttgaaaagtttctcttagagcctaatagcaataaccattaccatggtggcagccaccagagtaactcattatatcattccagcaacgctgtgggttaggagttactatctgtatttttacagggaggtacttaaggcaccacttgataagtggtagagccaagtcagtttgaaaaaaacataatcattgtgcaatgacaatttgagacattttcagggtcccagttccatcccctaggaatctgtaaagaggagagtggcttcaacctgctgttcagggcctctgccctcattccctggaggctggtttggacagtgtgagaggcatccttcccaaagcagacaaagagaaaacacatgggaatggtaattaaatgagtccatgtttaaggggcacttaagtggattaaaatcaatatgtagtcacataagtctgctaagccatccttaatgtttggcgggtggatttctttgtttaaaaaatcctggtttgcttgaaactggctgccccattgaagcatgagataggacgagagattcccaggacctggaagaccacttgctcagagtctgaaatgtttacactgcctctgactggcatctctataccagaaaggagaagagggggactagatgtttttgtgtgatagtctctttcctgctatcttaggctgagttccctaaaacaaaatcctgagatgagacatcatgtaaaaataatttgttaggaagtgttctcaggggaatgggaagtagagcttcaaagggaaggaggccaaacaaggatgtgatatcaagcaaagtccccaggagacagaaagaaggtgggtgactttggcaccgtctaaagtataggtcacatctcactgtcccaatcagggacaaaagagcatggctgaggattcccccaaggggatgtgaattctcaagcacttccatctctccatgttcatgcaaagaaggtgccaggagccccgtggccatcctcccacaaaagacacacaggtggtggcatctggggggtcaatgtgcatggttgtgcatggtagagacccctggatggagctccatgatgtgggatttacatcccgcccatactctgctgtgagagagatggtatgcagccagtccagccatctgaagcagaacgaaaaaatggtatggaaagcaaggcacctgaaaaaattttcaaagggagaaaaagaatgagcaaaactatcctgtagaggagagagacattgaaaatgacatatacagacacagaaaaggttgctcagtcaacaacttctgcaggctcaaagcatgggaagtaatcagtaaatggccaatttatctctccctcacagccaagccaactcctaacataattggaagtttaatatattccaacaagttcagaacaagcatactagatcttaaggcaatctcatggccctgcagctcatcctttttttcaaagaaattaattttcaaaaaatgactctattgagattgaatttagatcttatccattgccataaccaaaagcaacccttactatttgtgtgtgcaagtcgttttaaacagctggcccattaactgaaaaatgtcaaaaacaaatataggagaaaagtaagataatcttggaaggcaaagcctgtctccctatattgttcttaaaaatacaaaagggacacataacttcatcatttaattatattaggaggtccgtcattcagtgctcttgtaaaactgtcttgcccttgttctaattgcgtattgatcaccgaggttcttggcatcgggcttttctttgatgtgtgcatgatcagaacacactaagagacagcctgtgtgctccttcctgtcctcgtgggcatttcctaaagcttcagccctaagctggtatatgtttctctgttacatcaactgccaaggcaattactttacatctgatatttaatggaaaagcttctgaggacagggctatactcacatacctccacacctggcacagtagatgagctcactatctgttgaataagttcgtgacagaacagaagttctactgcagccacaaaggcctattcacagtctttaagcctgatgaagttctgaataagtaaacccttagctacatcaggcagtttatgaatggtgttttttgttactgtcatttgtaatagcttttgacctatgtgtttgtattagtccgttttcacactgctataacgaactacccgagactgggcaatttatgaagaaagaggtttaactgattgacagttccacaggcttcacaggaagcacgactaggaggcctcaggaaacttacaatcacggcagaaggtgaacggaagcaagaaccttcttcacatggtggcaggagagaagggggctggtgggggagtgccacacacttttaaaccttcagatctcatgagaactcactcactatcacaagaacaataaggggaaaatccacctccatgatccagtcaccttccaccagatccctccttaaattcaacatgagatttgggtagggacacaaatccagaccatatcagtgtgcaaatgatgagctaattttcccactaaagtaagcactggtatggtacatagtatgactatggtagtccagtattggattccataatttaaataactagtagactttttagttagttgaaaggtaaaacaatggtaataacaatgagctgtaaaatacgacctgtggggtgggaatggggacagccaatgcttctctggtaaagggaggccagtttcagcccctggtgcaacagcacccccatgcattcatcatgtgagatgataagtgtctttccttgaaccagttcttcttcttcctcctaggctgggaacttctccttggagacagcaggaactgtgttacaaaggcatatggcccaacaaaggacactgaggctactcagtaattattaaatgagagcatgaacaaaggaatgtaagatgtaacagaaaacatacgtgtctcacacatgagaattattgtgtagaagctgtttcccatttgagacaaaataagaaacacttgttgaacgagtagatgggcttcctctgggagcacagcaggtaggcacccatgttggagccagccatggtctgcagagttcatttctctgagtccctgccccagaggcacatgacataggaggctccagacaactgactcaaagacagagaggaccataataccagggttcctcagtcctcaccagcataagaatcccagagaaggcattttttttctcacatactctaggtctcaatctcttaacttcaaaaatggcagtggctacattagctcttgggaccagtgtttcaaaggctagtgtagaacacttgcctcagatgattcaagatccaggtttcctgactctgcttctgctgtaaagaatcccactctggaggctggggcctgcaatctgcatctttaacaagcccaccagagaatttcaatgcagtttcacttttgagggtttttaacttgattgtccatcagaaccacctggggagctttcagcaaatgcatgccgacgccacatgcattgattctgcggccacacagaggggcctgcatctgggtcttttttacaaagcttttcataggattgtcatcgtcacctttccagcactgttatgcaaattggagagactcatgccaaggtgaagggcttggtgagagcagccaggtcttctatgcagtgatcagcctgcacagctgggtgtggcatctctggctcccaggtggttccagtgcacacccccagttaagaaccaatgaagaatgttgcttgttaacaacctttgaaggctttttagcaaaaacaaagtgtcatattgggattcatctgtggcagtttgcagaacatatcaggggagagaggtgtgtgcaaggcatccaccaggaggccgttttgtgctggtctaggtaagaggagattggagctgacctgttgaagcaacaaagagaaagggaggaaggatcatcctagaagtggataccagttctttaagaagagtcctgagatgtacccaggagtagcaaagtggatgtgccaacccgagggaagagattagtaagctgctgccccctgagacagggctccatgagctgacaggttgatctgtggagatacactctgaaggtgctagactaggaagaggtcctctcaggccccatcccttcatcttcagccaaaggaagttcagcagtagctgcccctggcctctgttctcagtccacagctccaccagcccagttgcttgtgcagagggagaggatgtgggagagatgctgtcaacaccctccatgtcccctccacccaccctggaggccgcctatgacagttcgccataggcgaactgtttctctggttaggaactttctctggctacaggagtgtgctgcacccgagtcaggagggctggaagtgcaggatagttaacgtccccagtacagttttctaccaaggagagaccggtgagatggatagatgccccagctttctcacccgttgatgacacacttcactaccctctcctggagctccctgagatcactgcccatacaaactaattgcaccccaatgcttgtcccaaagtctgctcagataagggccgtgtgaatagacaggtcttcagttccagaaaagtgtatactcacacaggaaatatctctcaaataacatgggcagtgtatatgttatttttctggagggcagagggcatcatgaggaaggtggtcttcgtggggtgaatatcatgtttcctccagggagggctcagtgacatggagcagtgcttctcaaatgtccatgttcacagaggttagcttctaactcatcaggtctagggtggggcctgagaatctgcatttctaacagtgagcatgtccagggaccacactttgagtagcaagaccttcacagcttcaagttgcaaaccagttttgaatgagcagagtagaagggggtttgtaggtgagaaggaactcttcaccatgagtacatttctatgaagatttctggccaggattttagtaagtacctgagccccttcaaacatttgactcccgcataaccttttcatccaaacaccattcatgagttgtttttatgccatgaggttaaattctttcctatcatttcaggggaggtccccacttgttgagttttccgtcagcctataaggcaaaggaaaagagtgatagaaaataaaaataacttgattcattagatggaattcaacttgaattcttagtttgttgactaagaatttgcagcctccgaggaaattttttttaattgaagaaaaactaatttttaaaaatctgaaaataattcgtttgtgactatttaacagaaggaaaaacttcctgagtgagcatcaaatactttaattacttcttaggcttcagaagggatggcttgctagtctttgtactttgggctttctgttacgactggttgacttagatttatttgtttatttagcttcttaatttcatatcctgtggtcctgaagaggacaatcaccaggatttaggggagtgtttttgtctttattcactttggaaaaatgtaaagattagtcctaagcagggttgattcaccgcactacagagggacacgttaggaacgagacagcttattcaagtgcttttgaatttgtattggttttttaaaatgtaagattatttttacttattttaaatctttcaaagcacttttttcctcagggccaagtggactctttgggaggagacctcgccgtctccatttgatcacataattgcttctgatgccagccagtctgcaactgccagtgattggcacagggttatttcatgtgcacttcaatcaaatttcttttcttgcctttttttttttttttttttttttttaagaaaaaatctcactgtggcacccaggctggagtgcagtggtgcaatcatatctcactgcaaccttcaattcctgggcctgtgatcttcccacctcaactcccaagtagctgggaccacaggtgtgtgccaccacctctggctaatttttatttttgttgagacagggtcttactatgttgtctaggctggccttgaactcctggcctcaagtgaacctcctgccttggcctcccaaaatgccgggattacaggtgtgagccatccatacctggcctccaaatttcactacctaacttgggagaggaattttgcattagcagttacatggttcatctgcctcaaacatttgttttgactctagcttttgcttgtttcacttttttaagcttggaaagaacaaacttagaatagtgtaggccttggcttccacatggatgttttgacaaaatttcaaggaagcaactggctttgtagtgctttctttgtcctgcttctccaaattccccaagtgcatgggtaatcacctctggttccctcggagtgttcgtggccagctccttcccagccttgccagcccattgtctgcatttggcatctgcgctggagtcactgtgtgctccagttccttaaggatacttttagtttatctgatctgtgctccacacctcttcagactccatttccatgaatgttttgggagaggtgaggaagaaaccttttctgctcattgttgcgcgttccccaccccaggccccgtctgatctattcttacatcacaactaaaaatattcttaaaaatgtgaatcagatggtatgactcccctgctcagaaccctccagtgccttccctctgtacttggaaccaagtccaaactcctgatgagcagcagggctccgcatggcctggcctttcatctgttgcttcccaaacgtgtggcctctggttggtttctggaactcaccatgcctttccccacacatgctggttcttctgccagggacactcttcactctcccttcatgtgcttagccccttcttagcttgcaggtctcagctaaatggtacctcctcaaaagggccttccctccacctataccaggtataatgctgtttgcctccttcagaatgcctctcacaggctgtgattactttaaacagattcgttgagatatagttcagatgccatgcaattaacccttttaatgtatacaattcagtgggtttgagtatattttcagagttgtgcatctattgccagagtcaattttagaacatttcattacctcaaaaagaaccaccatacttcttagctgtcgtaccccttcccctatttccaccagccaaaggcaaccagaaatctactttctttctctctagatttgcctattctggacattgtgtataagtggaatcatttatatgaaatggagccagtcctttgtgactggcttctgtcacttagcgtaatgttttcagagttcatttgtttgtggcatatgtcatacttcattctttttcatggctgaataatattccattgtatggatataccacattgtgtttattcattcatcagttgctggacattagattgtttccagtttttggctattacaaattatgctgctatcaatatttgtgtacacatttttgtgtgggctcatgtttttatttctcttgggtacatacctaagagtgggattgctgggttacatggtaacttatatttcactgttaagaaactgccaggctgcttttcaaagccactatactattttacattcccatcagtagtatgtaatggttccagtttgtccacatctagtccagcatttgttattgtttgtctttttgattgtagccattctaatgagtaggaagtagcatctctttgtggttttgatttagatttccctgaaggttaatgatgttgagcatcttttcatgtgattattggccatctgtatgtattttttggaaaaactattcagatcctttacccatttgatagttaggttacttatctttttattattgagctgcaagactttttaaaaatgtatcctaaagttcctattagacatatgatttaaaatattctcatcctgtggattttttcactttcttaatggtgtcctttgaaacacatgagttttaaattttgatgatatccagattatccagttttttttgctacttttgtaattattattattatttttattattattatttgaggcagagtctcgatgtgtcacccaggatgaaatgcagtagtgcgatctcggctcactgcaatctccgcctgctgggttcaattgatccttccacctcagcctcccaagtagctggggctacagatgtgtgctactacaactgggctaatttttgtgtttttagtagagacagggttttgttatgttggccaggctggtcacaaactcctggccccaagtgatccacctgccttggcctcccaaggtgctgggattacaggcatgagacactgtgccctgccagttatttttcatttccttttgaattttttgtttttgccatctccccgtgtaggctgcatgtgctgcgacggcagcgctgtgtttgccattgtagccccatcccctagaacagggcgtgatatagggcagcggtcagtgaatagctcttcagtgagttagtaaacaaagtggttctcaaaatgtaaaattcttccttgactcactaagcaaccttctgattgcaactgctttccctttttggcctccaagacaggaattctctggccctgctgacaggagccccatgttgcacagggcaactatgtcactcattggaaattaacatgtctgccctctgacttcagtatttctcccaggagcagaggatggaagttcttcacagctggatctgctgtatcattcagaagctggcttcagagcctgtgtagctggaagcctcgggctcacatcaaggaagggaatgccactcagcctctgggcacacagctgcaacttcccctggtgctgtctctcttggtgctaccctatactagccttgtcctgaaacatctaccccattcatttcaccctctctgctactatgtcactgcctctcccatcacagtattccacccaaatgaggcaaattcttatcctttcaagacctaccctagagtcaccttttttgatatatttgcttttttatttactccaccaggcaaagagggtggcaccctgctatgagctcttggaacaatttatttataagttccttatagcctggatcgtattcaaccaatagtttttccccctctattaaaatgcgttaatttggagtctttgcttactaaatgctgtctcctttttttttgagacagagtttcgctcttgttgcccagcctagagtgcaatggtgcaaactcggcttactgcaacctctgcctcctgggtccaagcgattctcctgcctcagcctcccaagtagctgggattacaggcatctgcccaccacgcccagctaattttttgtatttttattagagacggagtttcaccatgttggccaggctggtctcaaacgcctgacctcaggtgatccacccacctcagcctcccaaattgctgggattacagtcgtgagccactgagcccggtcaaaatcccttcttacctgtcatttgtattctccccattctgtgtctgacatcttgtaggtgtttgttagatgattggtgagtgaattaatgaatgtacagatggatgatgtataagtcctttcagagggaaactttgagtatgttaagaccccaggaaggcttatacttgatctttgtatccagaatgttgccaacattctggatacaaagaaaagcaccctctctgtgacttctcagatcccatctgcctctgatctttcatgacccctgctggattgactacatgagcctctttcagaagtttgactagcaaatcaacaaaacagttcaccctctgcatctctgctcagggatcaacaggagtgcttgcttatgtggcttcattccagtgggaggttcatattttcttagttatgtatcatgtagtcttccttgattcaagagtaccatgacttgtgtttgttctgactccaggactatccatgagtaaccctcagccaagagtgtatcatcagggcctgagcaagtggcaggagacaaggtatagtgtgaatctagtacatggaagagaatgtcttgacagctggggtctgtaattcatatgctgttcaaatgacaggccttttccccacacctgtgtgtattcaaagcaccatgtcatgttctgtagggagataggcaggggagttgggtcaggagaaggaagttaagattgaaggagaacatgcagaggagctttgggaaggaatgtgcccggctcacatcctggctccatcatttaccaactgggaaaccctgggcaagtgatataacttcacattccagtttcctcctcataaaaatggaaataaagagaaggtgtacatagagtttttagataatggatttaaaacactacctggcacacagtaaaccattactaagtagaggctatgtactccatcctacacgcatcagcagtggcagtccagcaatactcctataaggcacatgttatgacttcattttactggtaaggaactggaggcttagagaaaggatggttaatttgcctgacaacacattgctggtatatatctgagccaataatcaaaattgggacactaatgccaaaggttttacaatttctatgctgcaggctcaggtgtttttcttcatgggtaggaactttatggctcaagcccgaaggattcccctctgggaatacgactgttctggtaaggttcaagctgactcatcattgagtgctgctaataaagtgtttgctgagaatgttttctgttaactcattgagccaggttattaagaacctgtgctcacctctgacacctcagttgattggggaatttgggatgaagtgcttccaaaatttatttgaattctaaattaactaagtgagttaacgtggaagccgcttttaccagcccacaagggtcacgcttgttgtgtctggaagaaggaaagggtcttagaggaacacaaattgccagactgacagtcagatatggagacaccagggtcatcttcagtttaacaaacacatgtcagaactagaaagttggaagtgagacttcaaactctacctagcattgagcataagcaggtcactgaccacaaagatattctgttcccaaagagcaccatattcgtggtcaagtaaggccagagtctagactgacatcaaatgcttgtatgattgggaggaaggagcccgaaggccaaagaggctcactaatttcattattcgattcttccaaccactgcacgttacaaacagggctgtagcctgggtctactggccaagcttccggggctgggacaggcaaggtatgtctggatgagagaaggtctttgccaagacaagcatctcttgtgccaggcagaccagcaaatgagctgcttcttgcagccccttctttggcatctcccataagccaaggcctattcatttaataaatgcagactcaggagctactaagtgccaggctcggtgccagacactgagaatacggaaatgagtacgcataaatcaagtgtgcttttcatcactgtgtttttaaaaatgttaactgatgatttcctgatcctgagagtaatgtgcagatgctccttgaactatgttggggttatgtcctgataaacccatagttagttgaaaatatcataagttgaaaatgcatttaatacactcagcctacgaaacatcatagcttagcctagcctacttaaacatgcttagaacagttccattaacctacagttgggcagaatcatctggcaacacagccctccatagagtatcgattgtttaccctggtgatgatgtggctgacgaggtgctacagctcgctgcgctggccagcatcttgagagtattgtacagctttctaccactttccactgaatacctattgtttttacaccatcagaaagttgaaaaatcttaagtagaaccatcataagtcagggactatctgtatggtagtagaaatttttaattgaatcttctgtaatcttcagcaagaaaccctgagaatattgaacgtctttgccagacaaggaaaagtgggactggggaaaaggccagttatgtgaatcctcttaaaatagggtctaaaattttataataaaaatgtattttaaaagttttgattgagactttgcctgaaatgtgaaactgaaaattacgaaattaggtttattttatcctgcatttattcagtggcactcaaaacattgtaattataattgtcaaagatatcttagaccaaaggcaaaagattatttgctttattagagtctttaaaataacagtgccctaacttctgaaacaaaagaaggaattgagtgctggataggcagcttttgaatgtgaattttcctactatttcataagataacatcctttgcttcatattttgtctggttttcggtacaatcacaaaaggatcattttaacaatggtcacttttttctaagggcttctcttgatcttttttatttaaatctttgtcttctgaagcatcttaaagtagtatccaggagaattttgactccttcaacagttaactgatctaactctgccagatccagatttatcagtggttttgcagtggttttatccatttttcaacatcactttcattgatttcatgaaagtctgcatcttttagagcaagatttctgcttcactctgtatttgatttgcattgtattgtagtcagataatcagatgtctgcactagcagtcagggacattagatagacagtttgctcactggtccgcgttcccagtcagctaagagtctcataaccatcagccttgataaatgctaatgttaagttctctaagttaaagccagtgtaggcaatgattggaacttggaagcaatcagagcacagaagaagcctggtccctggaatctctcccatatgcatcctggtggataccaagtgcctggcagaagtcataggcaactcccaaccagagcgctctccactgacatgttgcttagagctggggacagcttagattagccatatctccccaaaatttgtatttttaattgaattgattttttaaattgaatccattttaaacatgggattttatttttatttaaagaattaccttgtgggtatgtctgtgactcttgggtgcctgcctggctgccaagaagacatgtggctccatgatgactctgctttttaaggttatgccctgggcatgatctgaaaccaggagaacaaagtgggtactggtgttgccttgaatgaagtgctcccctaatgggggaagccttgcaacctttataaactgcagtcaggactgttttctcttccttagtatggatttaaacaagaatcataaacacgtgagctttctcctcatcctccttttgttgcctctccccacctgggagcaaatgcctaggactttccaagtggttctcggtgccagcagcctcataagggaagagtattatctgagttcaggttcatcagaagcagcacccgagatggactctcatgaaggggatttattggggcaagaggagcgaagggagcagaatgaggaggggaagaaaccaaacaggcatgtgggctcagctggagtctgcttcacccagtcctatgggagctctggaacattaattgtacaacagagttggtcttgtcttgaggcaaaggggacatccttgggtacccacatcaatcagaggctacggaatgcttttggggaaggtgtcataacctcccaggcaaagcgactccattcaagctgttgtacttatctagtaaggggttctgagtggagcaccaccagcatccacacaaggagtggtactgcttgccaaagcccatgctctgatacacctctgggcctccttggaaatcacagtagtagaagagaggggtatagaattaaaaacatttggtcagggcagttgacatggccagtataaacagctatgttggtgctgacaggcagcagaagggtaatccatgacatcccttcctgtaacaccatcccggagcacatgagtcatgaaccataagctcagctctcttgttcctagagatgatgtctttggtttactcttttggcctgtcctcaccaagatccaaccagaattttgaaatttttatttgactgagtaaggtggaagagagaccagaaatagttaaataaatgctgatataaatgttacgttctagcatttgggaattaacaaaaataaggtagctgagcagcttttgaatgatcaaaagtactgttgtcttaggtcaaagctaattaaactgaggtttcctcgagttccagagtacatttttgaagacatttatttcacacatgcaaaaactgaagaagtctttggggcaataaatctttttgatttcttttttttttttttttttttttgagacagagtcttgctctgtcaccaggctggagtgcagtggtgcgatctcggctcactgcaacctccacctcccaggttcaagtgattctcctgccgcagccttctgagtagctgggactacaggcatgcaccaccacacccagctaatttttatatttgtagtagaaacagggtttcaccatgttggccaggatggtctcaatttcttgacctcgtgaaccgcctgcctcggcctcccagagtgctgggattacaggcatgagccacagcgcccagccaataaatctttacttcaagaacagacctttgacttaaaattaaagcttctctcctggtttgaaaggaattcccagtgaggtattgggcattacaagagaaactggaaacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacctcttctgaactctgagctctacgaggacagcgattaacatctctcagatatgttctctcagtgctgaaatgtggtgtgtgatacgacaactcagctacccagtgcatgctcagggcgcgttctgaatcctgtgccatttgcatgttacatacatgagcttgccatccatgagtgtttggggacaagacagaggaagaaaaccttgggggaagggctaaggaaaggtgctccttgacagtgaggacaacttaaacagaggtgtgaacataagagcaggcagggtgtgtgtagaatagtagcatatacgtgccacggggcaggggtggaagaaccacaacagaacaggatgggccaaaatggaagctgggatcttaagatttgagactttattctgtttgcagtggggacagacatattttaagaagcttcctctggcagccagccaaatggactgaaggggaaggaaagctcatagcagcagctaccaaacatcattatccggcagaatcactaattttatcactcaataattttatgtattaaaaatgctcatcccagaccctgcagtctctgtgtctactcagaaaagactcatgctgtgcaattagagtgtggcccaggaatctgcattttatttatttatttattttttagacggagtctcgcactctcgcccaggctggagtgcagtggcaccatctctgctcactgcaagctccgcctcccgggttcacgccattctcctgcctcaaccttaaagaggctcccaaggtgatactaacgctggcgatcctgggtctctgtgtgaataacactggctaagagcacagagagatgttagaaaactaatcatcattgagatcagttatatccgagactggatgctgaaaagatatattagagtttagttttatatttatatatctcttatcttttgtttaattgtatttgggcttttaggggttttgtttcattgctattttctaagtaagagtgtattgatgtttaacaaacaaacaaaaatatacaagttattaagttcccagctcaatgaactttcacaaaatgatcaaacctgtgtaacctgcactcagaactgccttccacttattccataattactgtcttgatttctagccccatagattatttaccttttatcacctttatttttggtgcatttgataatgttcataatatattagaataataagatatgtataattggataatttaagtagatatattatggtaaatgctcacatgtttttaccagttggacacaaaataaaaatgtttttcatccacctgtctagatgccttgaaatgttagtctgagctgagatgtgagtcctggaaattggaggacctctgtaccttctcttccaaaatctgtaaacatactgtttccgcttggcagtcttgatttgctttcagtgactctgagaagccctgtggtttgtgaagagcctcttggctttcctttgaccttggttggaagccatgtgcccaggtggaaagacagcagttccctacagcctttctcttctgtttctctcaagtcgctgtgtgcagagtccagcctaagctggctacacttggaaacctctcctcacccttgtaccctccccacaccctggggagacttgctggtggacagcccagccctcactgcttcaggctttaggaagaaaccctctcttttcttggtgtgattttcttagagtttgtctttcctgaaccaccaagatctgaaaaggcaggattagggtgtgggcttaggagaaaggggccaagaagatgacagggttgccttttcatccaaaccttaggaggtctccagctcagccatggcccagcccacctcaccaggactgccctagggtttgaacccaaagcattagttaggaatgaagagtggttttgtcctcttacctgtcttcccagggaacccatgaaaaagtgggcagctggaagggggctggagacggcctggtcagggcatctcgtcccactggtgcctaccgtctgagcactgctctgaaggactcgattgccccgtggagcctgctcccacacacctgccttttgtgcagccggcccatctgttggtgctttttctttcaggaggagatgggcatctcctgtgagctgctggaatcggacttcctcaaatgcagcgtgggatttcctttcatgaggtcaaagtcaaaggtaagggacacagacgggacccttcctcagcagcaggcccccagcccttccaccagccactgattccgccgcctccctgaggtgaggagtcctcccaccccctgcctcccatagcagctggggcggccactgaagccctgacatgctcctgtccctggctgtgtacaccggggtatactccggaggggctgcatcatatggtctttctcttcgattcacatgatgtaccccaaatgtgaaagtgaaggacacaccacagcctctgcactttagcacgtgccatttagttgaccttcctaaaataattttttttctgagacattctgtgcctctttgagtcccctagacaacacagaagaagatgtggtctgtcacctatagtcctgtcattcccttgggtgctcacagttttctgaagagaactctcaaaattctcaaaacataaatacctgtatcccacttcatttttaagaagagtaaagaaattaagtcactttggtattggtatggagacagattttctaagttcaaatagtatactacagcatcttcagacattcatggaacattgtagtatgtgccatcattataaggagatacaaacataggtaaaaagatgtggtgattggaggcaaaactagaatctaaaagaccaagtctgcctttggaaatggaagctattttccctgccatgaacagagtgagactccgtctcacaaaaaaaaaaaaaaaaaaaaaaaaaaaagtgaaagcttcatccttttctcctgcctgggtcatacactcagatcattttaatctccaaggctctttggtcccagtatctagtagctatttgtaaaccaatggtgagaatattctggtgagggagaagacttggtcatttcttagcaaatcacttgaacccataagccccattgaatgcacctcgatcttggactttccagccttcagaactgtgagaaataaatgtttaaaccacccaagctagggtaatttgtgatagaatcccaaactgactagggcaaaaaggtaataactttctcactgttagggtcaatgttgttcagtgctgtgttcacatatcacccaagataatctcatgaaccacctaaaataatcttagtgtaccactcccagtgtgaacatactgtgatttgggtaacactgccccaaacaaatggtgttcaccatatacatatcaggcacgtgtgggaatgtgggaggaacccctgggtaggggttataggaccaggctctaccacaaactgtgtgatcttggcgaaaccacagtggccaagtggccaagtggcccatgactcctcggatttttttctgcctctcttcctcattctgtccacattcaccccaggaggagggaaacctcaataagtgtctgcccttggaaaatggattacatgtggatggcagagtacaggccaagtcccattagactccaggtagggtgagggtggagataaaggaggacgaccacaatccatggacactattgcctatagtaatgtatgtggcacatctgcacacaaatttaattaaaatcttttgagtaacagataataggcttaactggaaaacttgcaacagtttccatttcattttaaactccagcctatatcacatatcagacctaagatgtgtctttctctctctagtggagtgttacattttgtcaaatttttgtttgtttgagagggagtctctctctgtcgcccaggctggagtgcagtggcgcaatcttggctcactgcaacctccgcctcccaggttcaagggattctcctgcctcagcctccctggtagctgggattacaggtgcccaccaccatgcccagctaattttttgtgtgtttttagtagagacaggtttcactgtgttggccaggctggtcttgaactcctgacctcaagtgatctgcccacctaggtctcccaaagtgctgggattacaggcgtgagccaccgtgcccagccaacatttattagatagagcccacagaagtatgaacattggaatgttggttgttttcccagctggtaatgctaccactttcctcccacatacagatgctgggacctgaagcaagactgactaaacctggggattggggggcatgggagcagagggtgattccctggagaaagcccaacaagtcacccagcagagacggggctccccgtatccgcagcccagcgtgcactcccatgtccttccaaccctgagggtcctcaggctccaggccacatgctaagcctcatggctatactttggcttaccttggatggccatgtatttctctctctcacagcctgcccagtttctgacattctgttcttccaggcctccatccctgattttggcttctcacccaattcttttgcctgtcatctcactgtgctctttaatgtttttaatttaattcagatctcctcccagtgctgactctacaccagtcaagaccctgcctctctcttccttcttgtcctcttcccgccctgtctccatgcctgccccccaccccacagtaagctgaccagtcccacagcaacagaaatttctgtctagaaagagatgtccatgttcactgtagatgatggtccattgtaatggaccaatgtccgttgctttcaggaaacattcagtagaattcagtgttgcaaatattagaccattgcctagaattcaccataatggaacccaaaggtttagacattgtataagttataggctctcaaaatttgatgaaatttaagaaccgttttgtccaacctcctttttttattgaaatgcaaagacagtatcttagccaagatcacagtcagtttgtggtggaacctggtcctgtgacccctacccaagggttcctcccacattctcacacatgcctgacatgtatatggtgaacaccatttacttagggcagtgccccctactcacaggatgttcaccactaagtggtacactagataattttagatggttcatgaaattatcgtgggtgatacgtggacgcagcactgaacaacattgaccctaacagtgacccttttcaccttagtcagttcagtcatctataacaaattaccctgggctgggtggtttaaacaacagacatgtatttctcacagttcttaaggctgagaagttcaaggtcatggtcccggcagattcagttcctggcgagagttctcttcctggttcataaacagaaccttctctatgtgtgcccatctggctttcccttggtgtgtgtgcatggagagagagagatctctttgtcttctcttcttctgagtgcactaattccatcatgaaggcctcaccctcatctaaacctaagtaccttccaaagaccccatctccacataccatcacataggggggttaggccttccacatattaatttgaggagtggcggggggacacaaacattcagcgcataagacttttcaatagtcttccaatcctagccacactcaggagaacgtctccaatcctgctagcacatctttaacacttctctatcaccagcaaatctcccttttcaacaaagatggagtagaccttaggctcagaggcttccaaaggcaacagagttcagcattgctctgttttcattgtgttcatttttacaactaccttctctttttggcaagtgatcctggattcccatctatgacagtgatataaattgttcttttaaaacaatctttaaactaaaagagtaaggcaacaaaaatatgaacaaatatcccaggtgatgtaatttgcagatgtggcagaaattgaaaagatggtatgtgagtgaaacttagaaagtcccggttaaagagtgtaaacgcatcacttcctaaggagagcctcggtggcggaacaggagcagcaggtctctggccagagtatgtgtcaggcttggttttactgttaaagctgtgactttggcctgacagtcagaaagctatacataaaactaaagcttatcatgcaaatgagcttccagaggtcataaactgcagaagatggaagagaacagtttaagtttggaatgcctgctgatgccaaataccacttcctttttcactagtatgaattcagcgtgatctttgatacaagccacctgtctggggaagaggaagttctcagcttcattgttactgctcagaggtaaggggggggtttaaacacttttttcaaagatgagagatttatgggaccaggaaaggatgtgtcctggttaagctttgatgaatcccaggatgctgaggaggaagaaatggttactcagtgataaagccttgagccgcaaagtggaattggatttcttggggatggtggttgcctagtgctgcttgcatagccgccactgcagattgaactgagaggaactgggcatcagccactcagaggtgatgattctacagctgaggagagacaggcccaggggggtgaggctctagtccaaggtcagttcccacttggctgtgtatttcccagatcagacagatgtcctctgcaaattgtctggctgggcccactgctgcttttggacatggtgctgtatcccttgatggagtgggcaggtcacctgcagcctgagggcctggctgagcctgttggcagaggccccaagagatgctactcaagagagggcttaatttggaagccaagtggatggataggaaaggggatcgtggggtggcagcttctcccctcagtagcatgtgcccgcccctctccaggatagccatgagtgcctgtgggggcttctggggagttacaagatgccttctccagggcagatccagcatgccttgaagcagcatctaggtagcacttggctggcagctccagtggagggaggggcgttcaggtgggtgaacagggagacacaagctttgattggggtggtggttggacacccaaggcaaccttttcattttcacttggaaatgatcttaaacttaacagaagtcttacaagaatagtgcaaggaactcctatataccctttacccagattcacccagtgttaacattttgcctcatctattttatcatcctctttctatataattttttttgttaaccatgtgaaagttgcagaaatcatgcctcttgattcataaatacttcagtgtgcattcccaagaatgaggctgttctcttaataaactgtagtatagttatcacattcaggaaattgaacattgacactatgctattagctaatccgcagtttatgttctgattatgccagttatcccaataatgtctttttagccgcttctttttactggtccacaagacttggttattttctattgacactattttcaagatcacataatttacatcacataaaacatgactgtgatctaatagaagcctatgcaaagcatagatagggtagacttcattcccattgcacaaaatccagaagggcttcagtggggaggtagcatttaaacagaggagtctgttttcaggctgaagcaacatgggcacggcagtgaggctgtccatggggcaagaagccctgttacacctgtgtaggtggtgggcacgagagtgtactggggattcgtgcaccttctcagaagaaggatggggagcacacaagcacagtgggaatggggctgaaagaggagcctgggcgctaaaccatgggggacaaaggtcacctagaaaatctgaactatatcctgatggcactgaggagccactgaaagtttttgaaaaggggagtggcacagtgcaacagcttggccccagagcatgaggttgatgaatttgataaggggcggcagatgcccattcaaacctgaaaattctcattctcttgccatttcttggatccacagaacactcgccattgttgggcagacccatcaatgtgctctcttggtccttccacacctgaggcagcctgtatgcctgggaaggaatgtgacatggaagagatttcccttgtcaaaatagaagacacttcctgcctccacctaattcagggctaatcataacagtcagagagggcagggaaccagtattgcaattgtgaaaggttcatttgttagaataacatgtccacacagcagcagtgctctggttttggatgcatattagaatcgcctggggagctttcaaaaatatcgatgcctgatctatccccagagaccctgaccctgcctctgcctggggtgagacctgggcaatggagttttcagaagggctcaccaaatgattctaatgagcagccaaggctaagaaccactatttataatcccttactctgtgctgggcacattttcactcagtaaatatttattgtgcaccttatatttaccagttgcagtgctaaatgctgggcacatgagaaaatgacagtaacctactaaattcaagaacaccccctatgtacattaacagtgctgcatagcttcaggaagccctaggatctgtagcttcaataatataaaaatttctagtttcttaaatcacaaatgttaagatgaccatattatcttctaagcacacaccagaatatttcagatgctcatttcttttcaggcattggtgaagatatggtctgactgccccggagggcacccacacacagcgcttgactccctgctatgacggaaagatccttaaagctccttatcttgaaaactacagttaaaatctcaattgttcctttcttccatcaccaccctttgaaggtctctttgcctacttgtagatttagggggacataacattgagactgagcagtttcttgaacctctcctctcagcagccaccagcctggcttttgcagaccactggaaagtatcccagctcattagcttttggaatgacgggaagccttttgatgtttgacgtctttatctcaactcttcaacttagctcattctggagcagtcacacgatgacagatgagacggttgggcctaagccggccaaacaaacggcagggcaagacctggcaggatgctggggtgggggcgggagtgggccaggatggtgttaacccatccacaggggagtcgcctttggcctgcccacagcagtgatcccaaggcttttgtcaccccttgggaaaggaaggacaaggaagtcaggctgtgtgggcacctgatcctgctgcttttgcaaactgtggatgcccctgagggactgatgtcaccccatgtaggaagacagatgaggagccagggcagagactgtggccctatggggtcagcgtcacacagcaccattgtttcagaacaataggagggagaaggagaggggatgtgagagctatttaagtgctgttgccattcagcacttgctggttgagagaggaaggcagtggggcagggcttggagggggcagagagagggcacagagcagacagggactcagcagatgttcagggaacggcgtggtggggaacagtcaggatgagctgagccagcctcagcaggtctaggggactcttttcttccgcccatgcagggtgaacttgggaaccaactgtgaatgtaggttcaagaacatgtacccaagagccacgcattttcccaaggaataatgatcacaattcctattagaaatttaataaagtaataaagggaaactaggtcttctctctcttcctcctgttccttctcctcccttcttcttttgctcctcttccttctcgctcccaaatctggcatcaggagcaggagtcacagctgagagagccctagtttgaagtctgactgagctggttggaatctcagctctggtttgcaggggggccttgggcagttacctgatttatctgacttgctccttacctgtcaaaggtgggtgctccatctccctctggggttgctctgaggtctcagtgaggccatgctgagaaatgcccggcatagtgcctggcacatagtagccacttaacagcatcaattccctcatgttcacctttccagaatgatctcacaagaatccccgttctgtgctttctcacccggaggccttatgtggatgtattttagaatcacctggggagctttcaaaaatatcgatgcctgatctacccccatagacttgctatagccagggtctatagcgagagcttccatgatgtttatagtggtaggtttggtcagggcctctttcctgggcttggctgtccatggatgatgggtggtcctttcaggtgagacatagctgctgaagtctagcaactccttcctggctgcaataccctaacttcattggtccattgttcgtggaacaggcacttacacaagtagcacacacagtaggtgccctgcccataacccctcagccctcacccttcccaatctatccgcaaactgggcagattccggctcccagcaccagccaccctgctgaggctttctctggccagagcccactcacttgcctgacaggcaggtgccagggggttcattccaccccacccccacccccagcagcagcaacagcagctctcaggagtcagtggataaaggcctggctcccatgccctcagctaggaagactgactctgcctcacagagtccccgcgagactgggccctggctgccgacagcacgaccctcctgtatggcatgcctttattgtctcctttcctttgctctctcccttctccactctccagtcctactggcatttcctggggccacctctcgaataaactacttacactcaaatctttgtgtggaacacaaccaagacaatagagtgcccttgatagatatgtacagggaccaaaaacagactgaaggcaatgaggtgccatctgcccttggagaatgtagagattcaactctaaagtggaacagagaaagcccactgctggacagctagtgttggccagcgttcattcattctcctctctctgcacagtggcaacacggagcgctctgaatccctgcatgacaacaccctcgtgctgatggtgccactgatgcacgaggtggacacgtccatcaccgggtgagtagcctggtcctgggttgccacaacacaggagtgccctccagtggaacactgtgcttctcatatttgcatgtgtagccagccaggagccaagggctgtgccacctccacttcctcccagccttgaaaagcaggatgaagctttagctgcagtaactcatacactcctccctccttgttttctcctctgtcccacctacccacccacctggtagataatctgagaagtttgatgacaagtttaagccccataatttctttgaacattccatatacctttatgtgcatatattctcatccgcccctagtccctccagaatgctgtatggtaacaagcagcatggctcctgggattaaaatctcagctggaagttgctgggccagagattatcaccagatgtgtctccagtcctggctcacaggaggaccactttctgattagctccacaggcagtgctggctttgcttgtttctgttaactccctctgcagagccagaggtggcttttcctgatgtctataatggtctggaatgggcagggaaccatcccatcggccacactgtctgtctgggtcaagtccacggtcattcagtgccgctggcattgttggaaagcaggaccctgggctgcagtctgtggagacctgaaacaacctgtgtcagttttcaaccaaagccccagcttggaaaaatgagaactccatttctttccagcttcagaaaacagagtgcatacctctttgatagtggaaaaaagatttacacaattagtttagatcaggtgaggacccactgaacccttgacccaaatgcaagctgaactttctggaggttcacagtttctaatttttcggttttcaagtgcttctgggtctcagccttgattagcagtagaaatgttgatcccttgcagggagagccatccctgcactagcccgcactgctgggagccagtggaatgagtctccaagcattcctgctcctgagcttttggcatttttggtcatgttttttaaacatgaggtactgatggaatatatttgcaaattagcatatttttgcctctgttcacagctctatttttaactgtatcatttatttacttgtctcatcaaaggcacagcaagaatatacccagaaccaagccctatccttggggacaaagagaaaacattctccccaccacccccagacacttgatcatgtaatcagtccttagaggaccttgttgggaggtgttaacagcccctgatgaagccatcagttaaacaaatgagtcaacctctgatctctccaggaacctaaaacagctcttgccatttggtaatgctgggaactcactaccttactaaaataatgcactaaacattgaaaatggatgagttgttgtctattcggacttagtctcaaaaatcttccattgttgtgtttaggtgagtgagtggcctccagcatctagaagtcgatatttgtctgggagtgtcagtcagagctttgtttcttctcaggaatgtgttcatataagcaacattgaaagcattgctgcaaactgagcttgaattcttctcacctcttatgtagcctccgaaatccaagggaaaatgctatcaatgaacggattcagctttcaaatgcctaacttctagtcatcttggcagtctgataaatttaagttttttaagtgaatttgtcatagagtggggtttaggatgccaaatacataactcatttatatttattttttaaaagcttatgatcatcttcttcaacccataaaacatttttcgaatgacaaaacagaaaatgtatacttttataatccagtttttaaaaagtcaaagctatgataatcttgtcatttcagaaaggtaatcccagtgcatatttctccatgcagcttattgacgtaacctaagatgagaagacactactattcatgcctggtcagaaagcacagactggctatgtaacagccccagcagggaagcactgggtgcaagacactggattaaattgagacaaatgtttgcttctcagaatggcagtgaccatgggtgcttgactgtgggtggggatgacagatttcatgctttcctctttcagaatcatgtctccaacctcctttgtatatggcgagtccgtggacgcagccaacttcattcagctggatgacctggagtgtcactttcagcccatcaatatcacccttcaggtacccactcctggagacctcctctgtccgtgggggctaacggaagggcacatgggatgtctctcctacagagggctaagctcttgtcaggagaaacccttctgtggttggctggtgtggtgtgtgtgtgagatctgtaaccacacacagaatgaatccttttcgatgcctggtactctgctgtgcaggcccctctgctttttcaggatttggaaggacaggtccacgtcatgaatgccagttttccccaagaagccctctgtgtggtggaggcctcagccaatgtcccagcccagatgaccccatgaggacccctttctgttctccatcattccccaccttctgggcagggctgcctcagaggatttgctgtgtcccttcctcctgagattttcttgccagctcatccaggagcccactcctcctgcaggggaacagcctttcggaagggcagttttataagaacagaggagtgtgagcccctgtgagcccccacgggaggcacgctgctccctcactgagccatggctggcttgcccaggcacacaggcatcatttccagcaagtccacttggtgtagactgtggacctcatgaaggacactgtttcttctcttagttgggggtcagcaaactttttctgaaaagagccatggggtaatttaggctttgtgggccatttggcctctgcagcatctattcaaccatacttctgtagttcaaaggcagccatagataacacagaaacaaaattttagttccttatagacaatgaaatttgaatttcgtataattttcacatcatgaaatgtaggcccaagcgagaaaggatatcctgaaggtcccagagctgggagaagccgggctggggccaagacctggcggcactggccggaccctgtgtggatgaagtgaaggagatgggcccaactcacccataggacacaacagtccatatctcctcactctctggttctacctcccagaactcttctctgcctcttgcgtccttccccatggagagatggtttcccactctggcattcactgctgtggctaaataataattattttctttccttgtggcctctcctaggtggacttaggggatgacaaataatgacagggtgagggtctagagaatgtggcagtaaaacatttgtgggctctgacaaacaatggtcttcctctccccagagtattctcccagcaacagactgcgaaaccatgatacataacacatgtccccagctcacagaggatgtgccttctgaccaactaagcccctgctgtcacaccctgctcttgatttacaggggagaaagggaaggatggggttagagcttgtttttgagacagtagagtgattgctgtgaacagcacctctgcatttctgaattgcttctcagagttattttatttttctcctttgcttttcgtaattgggtaggaaatagataaagacctgatgggtttatttcatcttagttgtttctactctttcctactcttatagttttgggggtgtcttgcaattaaagatgtagttcagaaaattatttagaagggttcaagtaacacagaccatgtaatgaagagggtatgagtgttgaaagaaggaaaagaagaacaggggttgcacagaatataccaaatgttcttatcaccctctggggaacaaaagaaagaaatctgagggtatgcagcttatccttccagttgtttctctgaaggtaatttttacagtgagtttaaagtttggtattcaggcaaatagttttcttcacatctgacctgaaataggactcaggctagagaatccagccctggggaatgagtgattggcatgtcccttagataaactcctccgtgatccattgcctcaggaagtgcacagcattcaatccagggttgagagagttgggtctgaaagattgatagtgtgtgccattgattagaaggagatccttctgtgctagcaaagcccactttttccttgagaattgtctgactacttatttattggtataatggttgttattgtggttgtcctgcaggaaggtcactaaccagcttggcagtgataatgaccagaaggtgaaaatactgtggaaggaggccaggaatacggagaaaatgtttctatatttccttattccagtaatattgttcctgaaggagaacataagactttccatatgaacagatttttctatgcttttaaaaatcggttattcaacaagctacataattgtttaaaggctccactgccattgtacacaggagaaaggcagaaatactagtcttgggcctgctttttacatttcatcatagtttttaaacagacacattaatttctcgacaataagaggcttttttggcatcaaaatttaaagcatttccccacctgaaaaacaatggccaaaaataatgcagatattacacatgaacatttgcagagaatccagtataaagacatttgttaaaaataaagatggtaatacaagctctcctgtcctcctggctctgatgagtgaaatagtgcaaatcagcatccttttcttcattgcttaccccattcatgcttgaaatgggatttcccagacatgccaggatgtttctttttaattctgtgcactcatgtttcacttcaaattagttatttcagctatggtcagatattccttccttttctatgtcttcaggttgtttggtgaatattgttcttttttgaatcaggagttggcaacccactcatctgctctatcagtttttatctatttattctttgaagtggaaccaactattgcagaaaaccaaagacacagttttctagggaagagctagctggagctagatcttcatacatcctgtcatgtgtgaagacctggtaagatttctggctttttgttggctctgcccttctgacctcaacttcagagttgcagattccctggattctctctctagtgcccaggccaccaagcagcatgtcattccttcctctctcctacttatcctttttaaacatttagttttaaattgacaaaacttatatattttatattttactcatctttttaaaaataacacctttattgagatatgattacataccttaaagttcacccatttaaagcatacaattcaattattttaatatgtttacacaattgtgaacctgtcatcatcatctagttgtagaatatttttaaatttttttcattttaatttttgtgagtacatggtaggtgtatatatttataggatacatgagatgttttgatacaggcatgcagtgcataataatcatgtaaaatgggggtatccatcccctcaagaaatcccttgtgtttcagacaatccaattatactcttttagttactttaaaatgtactattaaattattattgactatagtcaccctattgtgctatcaattgctaggtcttattctttcaatttttttaatccattaaccatccccaccaccccccgccacagccatccccccattatccttcccagcctctggttagcatccctctactctctgtctgcatgagttcaattgttttggttttgagttcaattgttttggttcaattttgtttgattttcacaaataagaacatgtgatgtttgtctttctatatctggcttatttctttccttttttttcttttttttttttgttttgttttgttttttgaggcagtgtctcactgtcactcaggctgctggagtgcagtggtgcagtctcagctcattgcagcctcaacctcctgggctcaagcaatcctcccacctcagcctcctgagtagctgggactagagttacacaccaccacgcctagctaattttttttgtggagagggggtcgggttttagatacggggtttcaccacgttgcccagctggtctcaaacatgcctgcctcccaaggcttattttacttagcataatgacctccagttccgtccttgttgttgcaaaattttggaacatttcaatcacccccaaaagaaatttcggccttttggccagaaccaccatcttccagtaattcgccaaaatgtcgaacacaaagggaaagaggaaaggcacctgatatatgttctctaggctttttagaaaacatggagttgtttttttggccacgtgtatgcaaatctataagaaaggtgacattatagacatcaagggaatgggtactgttcaaaaaggaaggccccgcaagtattaccatggctaaactgaaagagtctacggtgttacccagcatgctgttggcattgttataaacacacaagttaagggcaagattcttgccaagaaaattaatgtacgtattgagcacattaagcactctaagagccaagatagcttcctgaaacacgtgaaggaaaatgatcagaaaaagaaggaagctggcggcacagtagctcacgcctgtaatcctaacactttgggaggccgaggcaggcggatcacctgaggtcaggagtttgagaccaacctggccaacatggtgaaatcccgtctctactaaaatacaaaaattagccggggatggtggcagccacctgtaatcccagctactcaggaggctgaggcagggagaattgttcgaatccaggaggtggaagttgcagtgagccgaggttggcccactgcactccagcctgggcgacagagcaagactctgtcttaaaaaaaaaaaaaaaaaaaagaaggaagccaaacagaaagatacctgggtccaactgaagcaccagcctgcaccacccagagaagcacactttgtgagaaccaatgggaaggagcctgagctgctggaacctgttccctatgaattcatggcataataggtgtctaaaaaatgaaagacctctggactgtttaaaaaaaaaaagaaaaaagaaaaatccttaacccattgacatagcttcttgtattaatttcttattgctgctgtaacaaattactacaacatttgtggcttaaaacaacacaaatttgttatcttacagttctgaagaacagaagtccaaaatgggcctcgctgggctaaaaccaaagtatcagggcctgtgttcttgccagaggcaccaggggaaaatccacttcttgcctttgccagcctctaagggctgcctgcattctttggctcatggcccccttccatcttcaaagccagcaatggctggtcaagtcttaggatgttctctttctgatctgacttctgcctcttccctatataaggactcttgtgagtacaatgtgctcacctggataattcaagataccctctttattttgaggtcgcttgattagcaaccttaattccccctggccacataacattcacaggttccacagatgaggacatggacatctttggggggcctgtcatgctgcctgtcctactccctattcttcctgctccccagccctaggcaaccgctaatctactttctgtctctagagatctactcactttttttattcctctgcatattctgtttcttcctcgagtttcatgttcagctttttcctctccctccttgctcttactggtctctgtgacctccatctttttcctcatttctcaggaaatgattgacttctgaagacagaaaatggagaaatgctagggaaaacaagagaggcaaagttttatagaaccaaatgctgagacagaagaggggtacagttgtgcaagtgatgagctgcagattgcctggaaaccaaatcagctggctcatgtagtaaaaacagccctttctgtatattcgatcgcttggttttgggatgacccacttggtccttgagggcctcagttacctcaaactggcaaaggaaagaggttggaccagatctgtgggtctcaagtggtggttcctggaccagcagcagcagcatctcctgggaccatgttataaatatgaatctgccagccccaccctagacctactgagtcagaaactcggcatgacccccactccatacccccccaccaaaatgtgttttaacaagcccctcagatggttctgatgttttgctgaaatttgagaaccactggactagattatgatgtctgagttctcaccaagtgtaatagtctatgagtaaattcctatacatgtaaaaagaaaagttttagcaggaagaagacaaaatgctgaaagagaatatggtaatttcaaagtttgagatttttagatgcatgttagaagtgtttctattttgttgaaatttcccgtcattcagtagttcactttacttcaagttgtgaccttccagatccgaaccttagagtttctgtatgtgatttcaaagaatcttagaatatatattgcatgacaggaaatggaggtctgctattttccactgagacttgctgtgtgtgttccacacccacaggtctacaacactggcccaagcacccttccagggtcatctgtcagcatctctttccctaatcgactctcatctggtggtgcagagatgtttcatgtccaggaaatggtggtgagttctccatttgttttcactattgctttcagctttgagccagcccattcaaattttgtattccaccctaccctgacatccaccttgagggtttggaaaattcaactcattctaccctttggagacatatctggagaggccaggggacctgtgatacctgaatttctacattgagaccatttggttaatgctgtaagaagacctctttggagatggggaagagttaattacgaaccagctcctgggatggacttcgctggctctgggaacccccagcagcatctgcagttgcatgcgtctgaatgcattttgctgagtgcattttgcacagggaaagtgcctgcagtccatgttgagaggattgtgaaagcattgctctctataggggcacgtgaaggacattcagccaaagggacagtttttccatagatagcttgaaaatcagggcagcaaggcccatatggagcaggtgaatatctgagccgagagttgaagaggacacagcccacagggtggaggttcagaaaacattgtgtgatggtgacagtaatttctggcattgctgccctctgggtcatgtggactgaaaaccagacgcatgtgaatgttgaatgtagaacaggtcactcctcccgagatgccagctcagatgttaacatccctcatgatgttccattccagttccatggcatccccttgtctttgggctctgctgacccagcagaagaaagccgccagtgttccgcacctatgatgtactatggttggaacttagcatgaggtgaacaaaccacacaggcttctggctaccctcttaaatattattaaccatgctgaccatgccacatttccccagcatctaggagtgttctcttcctagagcatgctttctgagttgttcacgtgaacatctacagtgttgcaggagcctttttttttcctatgggcaaaatcatctattgaccaaaacaagacatttaagtcactcagattctgaaggtaccccaaaaccagggataccccttttcctctttactgatcatcgagccaaggaaaagccactggaagggacttgggctcacacttacaaatagctggcttgcatggaaggcattagaagtggtttcctgaagacctggacaactgcctggctatcgttctggctgagtggaccctcagatacccaagtggtgtgagctggctgcactctgttctttgggctctgagaaacaaatcctttggattttcaaaactatatttagaattttcataaagtctgtaacagacttggccctaggatggccaagtctccatctggatagcccagcctgtgatcaaaggctgtgggcatcttcatcgtatggaaaagtaaattcactggcacatctcactaagcaagtaggaaagctctctgtgttcttataaacgatcaccactgagcccagaatgacaacaagagtagaagcataaaagcgagtgcatgaggtgctgtagtgaagaggcgagagtccccagatacttgtttcagaggcccacagctggcacaccctctgccttaaagccctcggcaagggcctcctgtggctccgcccctcccttgctcagcagggcctgagaatgctcactgggtcaggtgtgattcagagctcatgacggtttccactttggccttatgggactttgaatggagcagggctttcattctggggatttgggtggcttggtgcaagtgaaattcagtcctattaggagaaaccagcactcattctctgtactgcactaggaggtgaccctttggcctggtggcattccctccccacccccactctcagccaccaccattccccaacctccaaaggctactgaacagctgggcaccagctggacatgttaagccaactgaagcagaaacagattataggcatggagggaaggctcatctgtcattcctctccacacccttgggaccctcaaattgtttctccctctctaacagtgcccttggtgtctgtattgcctgtgatcatcatccatagagcataatgaggatgggcttactcgccctatgggccctgggctgtcaccctacctacggacccacgtgtggcacagttttctgacttggttcagaattcatttagaagtctctggggctgcttctggggtccctgggcaggaccaacctgcctctagctttcaccaaagagtcttttgtgtttgcccaaagcatttcttgaggtccagctgtctgtaagtggagagtgtctggcttatatatgggaggtttttacggggagcctaatgaagtgtaaccactccaaactcccagccttggctcgtgatcttctttccttgtagctaatgtctctgagcccctctgctgtgcttgtatttaccttaaaaacagagccacggtggtggcctgaggaaagactatcaattttcactgcttcccacccacgggggttgtgtggaccctactctgacttcccacagcacagaaaaaaaaggaaacaggtcactgtggacctagtgtctgtccatcaggaagccaggttgtaatgatcatgaaaataatagaggggaagaatgacagacctttctagtctatctgaaatagcaaaattaccagtaacaaatcattcttgatttgttcacaaacactggctcagcaagtacctattacgtgccaggctccaaggagaggaataagtcccacatctgccccagaactcactgtcttgcaggaaacagatacataaaatgccattgtaataccgtataacaaatgcaataatggaggcatgcccagaccccaggatgctacaaaggttcagtgcttcacaaaggaacctcttcaagtcagggcttagaggatgtctagttcaccaagagaacaggtgaagaagagaacattccagatagaggaacagtcaccacttgtgagtgtatgatgagtatctgctgtgctgggagctacacccggttctccattctgtttgcctagctcttatacaaataggcaagagtaagtgttccgtatgccttctgcagatgtacagcagatagatattttggcagaatgacagagagtactgaaccacagtcatttcctctgtcagtttgtaaattaatcactcttcttgggtacatcgtgtgtgtgctgtagacctgaaccttcctacctgctgacttaggcatggagaaggccaagctccctgtttgatactagagtctaactacatgtcatggacattgtcagcaaaccacccttggcctgctgcaatgagcagtagctactgacctccctagcttacttttttccttctattggacagtcattctaaaaaactcacctgatttccaggaataaaatgagtgagccagacagcttatgggaggcaggctgtgtccacttgctccttagagatttctttttgaagtgaagatagatcatcttctcaatttttcagaacagacctgaaaaattgaaccacttcactttattgccattcttctgcagaggcgagccgtgtagcatagcccctgagcacaggtctaagattgcaccaagataacacatctgtcacaagcttcatggcttatgaagggaagagggtagtggtctttccaaagttaagttttactcacaatttctgaaggttcaatggaagagatgggagctttatctcagactgcaagcttcacttgatggagttaaaaacctgtatctgtgagcagctttctcacactggaggagaaggctttgggatttggctcttgttaatatgcaagaaggggaaaagtcagaaatgatagctaacagggagtgaagggctagaacttttattccaggtgaaagtactggatttttgaaagaactctagtgttagtccagaagagatataaaataaatatcgtaccattcattcctcctcctgcaaaaccaattgaaaatattggcctctctggcttgttgttttcttgctatggggcagtgattctaaagaactgacctgatttccaggaggtaaaattgtagggatgaatgataattttctaaggagatatatcaatgtctttgccatagggtaccattaggacattgacttcaatatggcatgaataccaacatctgttagaatattccaagttggtgccaggactcatattttagtaaactgtaaaatcttccctccccatgcttgtacagtagacagggctacccatgatgtacgatgggtatcccacaatgagtcagttgatgtgggaacttcaattaatttatagtgggactgctcacatccctatgaagaaaatatgcacctgatacatcactgaccataacaggagcttaaaattagacataaatggaggaatgaattgttttccccaaggatgacctggaggagcttcttaagttggggccatcaaatcagtcgatataatccaaagctaaagagtaaagaaattactcctgaataactgacccccccaaaaaaatgaataccatttattgctgtcccaaggctttaatagcctttttcatgtgctgtcaaatttaatccttatggcaccttcataaggtaagatcagcatcccaagttgaggaaccaagcttcaaggatttgcccaacctgacacagctgctaaaaagtagagctgggtttgtaaccaggtctgactccaaagttcacgtggttcccattgtgctgaattgcacactgctcctgaaagtgctgcccactccctaatcaccagaggcaggctcagtcaataggacagacagatgatgagtagacccccaagaatcacccaccagaggaggagcatcaacaccagggcagagaggcagcaaccgcaatcaaaagaactaataccagagggtgcagtaacaaggccaacagaaggcttctgaataagcaagactgatgtcttcagagcaatgcaaaaagacagtgtttccatgaaacagaataaactagagatttgtaaattcaagatattgatcattcaaatgaaacttcaatataagccatagagtagaataaatattaaagaataaagtaggggattcgaaacttggattttctgagaatgtattgcagaagaacaaaaaagccagttaaacttattcctttttttaaatagcaatctggaatgaaaatatcagatgatcataatataagagttagaagtcaagagagatggaaatgaaagcaagtcaagattcttgtcttggggggacaagtttatgtaccaattagctcaaggctttggtaaaataaatgtttaaatatgtaaaattttaagggcaacaaaaaacaatgtaggacatccaaaccactaaagaagaagaatttaaaacataattaaattcaaaacaatccaaaaggaaagaatttatgaagaaaaaaataaatgtataataagatggaagtaataaacctaaatatttcaataatcaaaataataattaatggattaaatgccctaaagacactctcagattagaattttaaaaatccaagtaccaaataacttgtaagaaatacaccttcaaagttacccagaatgtaaggcattcaaaaaaaaaaggcaaatattaacccaaagaaataaagtatagcaatattaacagcaaatgaagtataattaaagcccaaaacccacaaacattaaacagagcaaaagaaaatatatttcagagtgttaaagatttagtccactaagaatttgtaacataaatgaaattttatataaccaacaacacagctttaaccatagaaacacaaaaagaaattgacacattcacagtcattgcaagaaaatttattgctttcccctcaaaaatcatcacacaagtaggagtaaaataatgagtatttgaataatgcaactagagttgcgatcatttatatagagaccaagacagaatgagtcagaatgtctgattttcattactgctcccttgtttaccagctatggcaacctataggaagttaccttaactccccaatcttattttcctcatctgtaaaatgaactagtagtagtacctatctcacactgtaaggactgaagaaactaatttatatggagtaattaacagagatcctaacataaataagggaatgcacattcttttcaaatgtgaacatttacaaattattcaacatacaacaacacaaaaataagcatcaatggaatttttaaagtcaaagcagtagaagccacagtctctgaccacaatgcaataaacttggaagctaaaaacaaaaggttaggcaaacaaccaaccaaaaacaaatccacttgggaaattttaaacaccattcaaattaactttttagaaaaaaaagaaatcaaagttgaagggatgaacaaattagaagtgaaagacagtgagcggttgttcatatcaaaaccaatgggatttagacaaaaccaacacagaggaaaatgccactacttacatgtggaaaatagggaagactgaaaataagtgaactaaattgacaacataaaaactagacaagggacaatgaaataaacccaactcaaagaaagtaaaatgaaggtattattaaagacaaagcatatcctgaaatagaaaaaataataacaacaaaagtattccacattagcaaaatcaaaagctgtttttttgtccaaaaaaatagacaaacctgcagcaagcttcaacaagaaataaagaagagcgatgatgccaaaaaacaacactagaaatactttttaaagaagtaccatacttatatgaagatttaaaatttataacatcttttgagctgggcatggttggctcatgcctgtaatcccaggactttaggaggctaaggcaagaagatccttgagcctaggagttcaagaccagcccagacaaggaagtaagaccttgtctccacaaaaaataaaaaacaaattagccaggcatgtggcataaactacttgggaggctgaggtgggaggatcccttgagtccagaaggtcaaggctgcagtgagccatgttcacaccactgtactcaagccaggatgacagatcctgtctcaaaaaaacaaaaacaaaacaaaaaaatcttttcaattgtattcacacaaagataaaatctgaataaaatatgcatgaggttaaaaaaaaagtccaactagactatcttagaaaaaaatgtaaaagtagacaaagacctatatcttaaaaaaaatcaccgacccagatagctatataggcagattctagtaggctttcaaggaatggataattcttatgttaatataagctgttccagagagtagaaaaagataaagcaactcattccagaaaactaacatagccctggtacagaaaccagaaatggagagcgggcacactcacgcaaaaataggaagcagtgagccaaactcactttgaaaacagatacaaaagttctaaataaattgcaaattgagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagatactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaattgcaaattgattcctattagaagaataatatagtctgggtaaaacaggatgtaatccaggaatgctaagttggttctccatgaggaaactgattaatataactcattatatattattattaataataaaaggattaaatgaaaaataaccaaatgataatcttgataagggtttctaaaaagttaaaaattaaattcaacatttatttatgatattttattacatttccagtaaggaaagcatagaagacttcctcaacttgacaaagaccctttgccagaaacctataggaaacttcaagctaagtgaggaacaggcatgagtccctgctagtgtctcttcagtttagttgtgttggaggccttaacaataaaaagaaatgatagcctttattcttaaaaaaaaaagtatcctattgtaaaaattgttattgtctccctaaaaaaatccaagagaatcaactgattggccctgaggacttgtgaatacagaaggtaagagctgaagctgactgtaaactgcctgatcttcaaatgctttccccagagacacacacagacccaccaactgagggtgaaaaccttcctagatcaagatgtttacatacagcctctgaccagtcactggctgatcactaagctgtgctgatccaggacagcccctacaaaaccaggcttaaaaataaaaacaagtgataaatatatatatacatatatatatacccacacacacacacacacacacacatatacccacatacatatatatgcatacatgcaatatatattttgccagcagaaacatcagaggctacacactccaggaaaaacagactccagagactatgtctaggcaagtcactaaacaaacaaaacaaaaaaaaagtaacaactacccctcaatgggaggggtaagaatccagaattgctacaatatattatctaaaatgtccaatttaaatacacacagacactgtatatatcatatatatttctcatgtgctatacaggaagaaaaaaacagttaataaaaactgaggaacccagatgttggatttaacaaagacttcaaagcagctattacaaatgtttaaagaactaaaatcagtttaaataaagtatgacagcaatgattcatcaaataaagaatatcagtaataatattgatgaataaattaaaataagtggaaattaaataaatgaataataaaatagatggaaattataagaaccaaggggaaattctggaattgaaagtaaaacatgggctgagcatggtggctcatgcctgtaatcccagcactttgggaggctgagttgggcatatcacctgaggtcaggagttggagaccagccaggccaacatggtgaaaccctgtctgtactaaaaatacacaaaacttagccaggtgtcgtgggcaggtgcctgtaatcccagctactcgggaggctgaggcaggagaatcgcttgaacccgggaagcagagattgcagtaagccgagatgtgccactgcactccagcctgaatgacagagcaagactccatctcaaaaaaaaaacaacaaataaataaaagaaagttaaacacctgactgggcacggtggctcatgcctgtaatcccagcactttgggaggctgaggcgggtgtgaggttaggagttcaagaccagcctggccaacatggtgaaaccccatctctaccaaaaatacaaaaaattagctgggagtggtggcagatgcctgtaatcccagctactcaggaggccgaggcaggagagtcgtctgtaatctcagctactcaggaggctgaggcaggagaattgcttgaacccaggaggcggaggttgcggtgagccgagatcacaccactgcacttcagcctgggcaaaagagtgagactctgtctcaatttaattaaaaaaaaaaaaaagcaaaacacctgaaatgaacaattcattagaggggctcaatagcatatttgagctgacacagaatcagtgaacttgaagctggattacagtacagattttccaatctgaagaacagaaggaaaaaagaataaaacacaagcaaaatggttgaagccccagaggcctttggtgtgctttgtgggacaccacaaagtttatcaagatatacacaattggagttgcagagaaagacgatagagaaaagagggcagaaaaaaaaatttgatgaaatatcgttccaaaacagtggcagtgtataaactcttcaataaatgatatgaagacaattggctatccatttgggaagaaattagagaaagcctgtacctcacagaaaaaaacaaacaaacaaaaaacaggtgaattaaagttagatgttaaaaaaaatatttgcagaactgaatattttcataatctttagatgggaagctcttcttcctaagcaagccataaaatcctgaaaccataaagaaaaaattaacaaatttaaacctataaaaatgttaaacttttatgtgatcaaaatacatcataagggaaaagatatttgggagaacatatttgcaacatgggtaacaaatagataatatataaattacttctacaaaataatgcagaaaagaccaaaaattataaaaatggttgaagttatatgaacaggaaattcacaaaagaagaaattttaggggctgggtgtggtggctcatgcctgtcatcccagcactttgggaggctgaagcaggaggatcacttgaggccaggagttcaaaaagaaattttaatagcaaataaacatatagaaagatgcctagcctcactggtaatcagagcaatgcaaacttaaaatgaggtttttctcctcattaaactggcaaaaatctaaaaaattgttaagatccattgttggttaagatgaagagaaatgagcactttcaaatactgctggtatgaaaggcaatttgacaataactaccaaaatttaaaatatgaatatcaacaattccacttttaggaacctgtctcaaaattttcacataatatatccaggagaaacttctaattttctgatagtaggtgtatattatcagggttctcagcataaatgttgacttctattttggtgaagcagaatataactttaataatgctcccttaggattctgagagaaagttgttagattcagaccaaaaagtatgaaatcttactaacttattacagataggtatagtgcagagatactgtatcaagtactttacaagaacaaattaatctaatcttcataataatttcttaaggaaattgaggcaaggaagagttagagggaaggccaaggtaaattggtaagtggctaagttgacgttcactcttaacagtggggttcactgtgaaataggagttcagcaggacttgtttctcaagacgcaggtcacagagaccccgctgataaagcaggatgtggtaaagaagccagctgaagacagccagaatcaagatggtgacactaatgataattcaccagcaccatgacaatttacagatgccatggcaactcctagaagttactctgtatgctctaaaaacagaaggaaccctgggttctgagaattcgcagcccctctcctgtaaaactcatgaataatccactccttttttagcatttaatcaagaaataaccattaaaataggcaagcagcagcccttggggctgtgttacctatggggtaaccaccttttatttctttactttcttaataaacttgctttcactttactctctgggcttcctcttgaattctttcctttaggaagccaacacccaccggccctcccaggccaaaccccaatttgggggttcatcctgccacaactgtacagtgtggggtcaaggggaacccttggtctttttcactgaaaaatcaactcagaaaaggcagattaataggagaaaaggcacacagatttatttaacttgtatacaggggaggcttcagaatgaagacccaatcccctggtaaggtacagaagcttatataccatcttgaggttatagaaagaatgcaggctcagagcatgaccacaaccaggttttaatggcaagacatgtcatgggggagagaaagaaggaggcttggctagcaaaggtggcattgttatgtagatgaagccttccaggtcataactcctagagagaatagatggtgaatttcttttcagacttgtaaaggtgtcagactcaatctgtcctagatctgggaaaggcctggaaagagaagggctggctgcattcaaggagattctctacaggtgcaaaatttccccacaagagacagttttgcaaggccacttctgtctgctggcccagcagcagccatttcaaacgatgtcaaagaaatctattttgggataaaacattttgatttcctttagccacttgcagggtcttgcgccatccttttgtctgggtgcgtagctgtccagcagctctagcactacctggaagttgaggcatggtcatgcagaactaaggccccacccaggcctgctgagtcagagccttcacttcagcaagatccccagggattcctttgtctgttcatatttaagaagccctggtctaaagcatgagacttaaatctctgctctcccattttcttatctgtaaaatggtgatgacagtcctcaccacaagaggctgttgtggggatatttttatacacatgttcattctttcaacaaatactttgcgcccagcatatgctaagcacctagtgcagagaggaaaacagacaaaaagtaatttccagccatcatgtagcttacattctggtggggaaagagtaataagtaaagcatatagtttattacatgatggtaaatgctctggagaaaaatttaaaaagcaagaggatagggattgggaaaggctgtaattttaaacggagtggtcagggacagtttcacggagacctttattcagaagttgcagggaccaaagctatcttacgggagtttgcaatgagaatttctttgcccatgaagtccttgccaagtctatgtcttttctgagaattctctcccccttgatttcagccctgtttgatttctgacctttgaaatgccagcccccatgctgccgttgtgtggggttccgactggacatccagaagtctccgtgtgtgttctcattagctttcactctgggggagttttctgccacaatgtgaatcacttattttgctggcagcagcagttgacagtgacactgatttttaaagcctgcacatttcacatcagaaaagtcctggattttatgacttagctatgcttagaggataattgcaacaagaagtctcccctgcagccagcttattggagctgagacttgtataagagccagacctggcactttaaacagcccagcaaataacccaaaacaaaaatgaacaatgcacatttttatctatgctgctcttccccatcatgaacacatgcttctttttttcctcgccttcaccctcaattttttttgtggaaattcaatggttgactgtaccaagccagctctctgggtgagaggttccttctaacaaggattagaaacccctctcatgtaggaagaggtggatttgggggattatatgatccaaccctctacctttggacagaatacaatcgagatgtctccccagtacacagaactgcttttccagcaagttctctttgttaagccattctggtatccctcaaatcccttgttatgactatccacaattctccatgccccatgaccctttcttagctaaaatgaaaaataattgcctagttccctcatgtagagaagttgagctattaccttgacttcccccttctcttccaaaaaagattacaattcctttaattttctttcccatcctagggtgtcctctttgctctctccatattctccaaataaaaattcaaaactgagcagcaaatcctgtgcctcttcatccaacccctcctcatcatgaatcattatcactcaggaagtaaggacctggtttaccatctgagaactttagtcctaataatttctctacaccaacttctagtcctaataatttatccgtataatgctcagaaacactccgagattctcagtaaaaaaaaaaaaaaaaaaaaaaaaaatcaaggaaatcttaatggccaaagccataggtccaaaacccggcgttccctcccacccaactttccaggccattttctccaatagcccctcatccctgaccttgtcttccagcctccctggaccatgaatgctgctgaaggctctcactttgtacttccctgggccccctgcccttgctagtgacttctcctcccctctggctgtggaaagctactcattcttcaagacccagttcatatgtcctctctgtcaaggcttcccagatgccttcacagatggccctgcctcagggcctttgcacctgcctttgctgagaacactgttccctccaatctttgcatagctggctccttcttattatgcagatctgagcccagagttcactttctcaataagtcttccctgaacactttacctaaagttgcaaacccccattactctctatctcatttgtatgttgttttcttcatagcacttgtcactatgtgaaattactctcttatcatcagtcttcttccacgagattaaaaacaccatgagagtaaagggcaaggtccttattttctgtgtatttgcagcatttggtgccgagaccatagtgagtggtcagacaaatgaaagaaatggctgcttccactctgttagtggcatcctcagacacacagtcaccccttgtatctcctggggattggctccaggacatccccccatctctacttgagatcgcccagtaggaatattttgaacaaattcctttaacccatggcagaggttgccttaatttcaatgtgagaataagaaggtgaaattttgaaataagagattgaattacttatcagaaacgaaagcttcttagagcaaatttaaactctacaaactttggtcagggatttgaacacatatttccttccccctcagtttctctcacacagacactgctgatctcagtaatggccctaaactttcttttctttttcttttgcattttcttctttctgcacatgtatgaatgcaagctgaatagtcaagttcctgaaatgggtcaggattaggtttgccttaaatctttttctcaacagaagccaaacacttaaaagaagggagatggctgattgaattctggaacaaaagttacattcctaggctcttggttaatttgagcttggctagagggagaaagcgtgtgtgtttctgtgcacaagttacactcaacacacaccctctggaaggtgggggtaagcttcagtcccgactgtccgtacagagtgtggttcagaggctgccctttaacctgtgtggccagagagaataaatcaagccagcagtgctgtctccctgctgactgaaggcgcccggccttatcaaggagcccaaatgtcttgtgctcacagctgctgtgacatctggaagcattaacactttgttgccagcatgtaggctagttgaatgccgatgcgtaggtgcctggtgttttctggtctgctacatgaataggcgtcaaaagttggtggtgaggagtttgcttacgttcattccttaaaagcaacatgacacagagccttgccatggcaggggtgatgggttgttaccaaagtcgataacaggaaatctcactgaggataaacagggctcatcggccattgccgagaaacacatggttctcatttaacctgccaaggactaattgtgtatgcttcggaagcgcaaaaacaggaaaacgcttttctgacatacaccccaagtttcttcagaccaaaaagaactgcctcaatgttgttagacgctgagaagtaatgatctccccagctgtcagggagccaacctcacttacttctctttaatctaaacttatgacctaaagcatatttcaggcctcccatgaagtccttgaaacttgagacttaatgaaggacactgaggtttcacttttcactgctctggtgtatgtactctcagaaaagcagtggaagaggttagatagatggtgatgtaggaatcatggcatccagaaaatgagtgtgatttaccctttgataaaagggaactaataaagcaatatatgcaggaaatgcagagacaacccagtgaataggtgtgctgctttagcctttaagggaagatgggtctgagcttcattctttaccttaagatgggtccaagagctagaaccagaatttaaacaagcagatacaattccaaggaccatgttttgtctcatatgggggctattcactcatttattacccaaatcaacagaccattctgcttccaaaatatttcattatctgtggaaggaaaacatttttggtatgcatgtcaagtgctcagataacatatttatgtatcgctttttcactaaagagaatctgaccgcatctggaaattcttttgtgtcactgcctctctcagactacttcccatctgtatcgctttaactccaataaaaggccatccccatgcctgggaaatgggctttgtctggggaacttgtctttctctgattacatgtaaattaattaaagcccatcccgttttacagggcagcctggtggtggtggcctgcactcttgactttccagcatgttggcctgtcacacgcaaaggaagagggaggaggggaggatgcaggggcattgttttagccaaaccctaaagctgatggaaatgaaatccactggcttttatcatgagaagtgaaattgttcatgaaataatggcagcctcatacagaggctgtgcattggattatactcaacctttcctctgaaacgttggtctggaggctttgcccctttattttcagtttcagatttgatctcagtaacaccctgaccttttcagactccataccacttttcacagggatgactgccttaagggatggggaaagggttagagaaagcaagtattttatttagaagacagttttcagttagaaagggagaagacatctagagttaaagttacgatcttttcctttctgtgcttaagtgatactaggtcattctttaacttcttgctccacctgctctatccccagctctgcaggtttggagtgggctgtcatgtgattttgtttacccgtttcggttcaaagacagaactctttatttgaacactgaagctagcagggactgtccaaagccagagcccctcatattagcctagcttatgttgttgtgatcatcagactgtttctgttttttggatttttgtccttaaataaacaccttggaaccactagctacacagaggggtaaatatcagaaaatccaaatttggtgcactaatgaacacggggtctcttttcacaaagcaaaagaccatcattcttcagaaggatctcccaaagaatgccattgaaaactcctcattaccttcaaatggggtgatgcacacacgagtagcatgaaattagccatgttcatattaaggagcaatctaagatcattattgctgtttctctggccttatattaaatagtgtcattgcaattgaaaaattagagtaaatgaacagagcctgtgagcatccaccctttgtaggttatcctgagtctgcattattacagggtcttgaaatgaatggtgatacgtgaaagtatttgtcctaggattcattaatattattatattttagtctttggtcaatatgaagaaatactcaatagtaaatcatagcaacatgatttaacatgagatataatttgaagggctctttaaggctgctaagcaaccatgaatcatggtttgcatttttctagatggataatatgaagctatcttatttatctttctagaactagacaccttaggtcaggctaatcaaccagctggtatcatttctcagttattgtatgactactatctttatttcaaaccctgaagtcctaaaattaatgtcaccacagccattgtagtatgtgttcagccgcctgtgccggaataggggcttactgtcttttgatgccttggttctcagagtaggcaatgggtaattgaattagcaaagtagacattcaaaacattctctgagttttcaaactcaaggagcgtgtgacttcagagaagcaggcgataagtcagggggtgggtcatgtttacccggttgccgtcagctgcgattggtgtaatatgatatggaaaagtggcccagggatgtaactgagaacataaagtcaatgaataacacagaaacgtgagttaacaggaaacacatgttattctaaaatgaacctaggtcccttttaacccaagccaattcaacaaacatagcttttagatcataccttttaggtttttttttttttacccaaaaaccacactggggatgactccagccgtggctcatggggaacactactgtcattcagtttgttcctctgctaatttaatcttccattttcctttgattggtgatgcacgcattcaaggggcatcaagccatggacactttggtgaccctccctatccttggaaccccagccagctgatggggttcgtactggtaaaatggcaaactggtagaggcatctatgcttctgcctgttaaaaatatactaataggccaggcgtggtggctcacacctgtaatcccagcattttgggaggccgaggtggacggatcatctgaggtcaggagtttgagaccagcctgaccaacatggtgaaaccccatctctactaaaaatacaaaattagccaggcatggtggcacacacccatcatcccagctactcgggaggctgaggcaggagaatcgcttgaacccggaaggcagaggttgtggtgagctgagattgcaccattgcactccagcctgagcaataagagcaaaactctgtctcaaaaaaaaaaaaaaaaagctaaaaatatcacataccaaagctgcaaattatttctttaattttgagcgacgttaatccacatgatctaaatcatacattctcacacattctcctacttcaaagctttccctggttcctattaccttctgggtaactacctccacccacgccatgtgtaagacttgtcacatgccctcctctgtgtccaggcccatctcccctgcctcagttctggccactgctacccagcattcatccagtgcttgacctgtgttgaactccttggctctctagactccagtctcaagtttgcccctctatgcttttgcacatgctgttctcttcctggaattcctttctccctcctccctttactcctgagaagttttctttatcctttgcgatctacctgcaatgccacttcctctgggtcagatatgagaggggctgacttcctggtggagggagaaatttgtagacaagatttataatctcattaggagctgtgctctgaggggctgcgaatggataaacagtgaggtggtggtcaggtggtgtttgggcttcagtatgtggaatagctactatgcagcctggtgcaaggaagatggagtgggacagagcatcctggtggggattttcgagatgtgcttctcagacatgacaggttacttaacctctctgggcctcagttttctcatctgtaaaaaggggtggaatttaaggagagcagaagttaaagcttatctgtcacatccctgataaatgtctctgtgctgctgttctagctggttgaacctcaaaaatgtcccagtttagacaataaattatatggtcacccttctgagagcagtaccctccacacatgggtgccgtaaggattcagcatatgccgttctctaacatactaatagcacctaatattgtattatttccattgatatctgaactcagtatagagatgggaccataagcgatttcccaggatgatgtgcttggagcatgacacttagaaaaaagatcagaggacttttctgcctcttcagtgttcaaacccaggcacagggactgtgtttggctgctctgtttggggccctgtgggaggaaacctgtgtcctctctcttgctctgagtcaacagacaactcttagaagtgcctgattgagcctacaacatggaaatgccatttcctccaagccgtttatctgaccacctcagcctggaaagtaacagctcttgacttcccttctccacctgggatcagatgacgacaacatttgaaacaaagggtctgctctctttctcagtatcacacctatggaatcagccctgattcacacttcaaacccactacttcatgaagcaaggtcttgccagatcccctagagtgaacaggggattctttatcctctcacaggcctggcaccgtggtagcttctgaccatgacagctcctttcactgaggctgacccagactctgccaccaagtgatggccactccttgggctcccacagccagggttcctgacagcttccccagtcaccaccatttcatggtttcagtttgcacaatgtcctctttggggtaaaggggaggacagatgccaacagaaaaccctcagtacctgccttggtagaatacagccttgtcactgtgtcctgcatcctcctgtccttgtttgggtgcctggtgaagtccttttgttcaaattctaatagccatggacctctgccagctcccagaggccctgagagataagcagccatgtcatgagaagcatttggactccggtagcctgggaaataaatgaggactgactgggcagagaagagcaagggggcgatggccacagagtccttagccagccaaggaaatgacattgttggtcattggccggggatgcttgggttgtctgcaacacatgaaaaaagcatcacgtccccttgactttgagcaaagagtgcggttaaaaccaagttgtgggaggatggatagtcagtaattgtttatctgtgtgatgagataaggtagtcccctgctgtaatgaaaatgcacagacagttcatgaagtgaggaattagcaactaaggacaacctgagtgactacatgggccaacatcctcatgtgtagatgaggaaactgaggccctggagacccaaactggcacggctgttagcaggcagagctagggctgaagccaggactattgagtattcatcaagagcgtctgtaccacagaacttcactggggcccggacatgaccttggacaagtcgctgaactcggggacctctgtttccttatctgtcagctgaggccacaaggactgcatgatctcgcagctgccttccagaaacaacattccagaatgctctgttccccccttccagcccaagagactgtgcagaataggcctcttctcagtcagcaggcacttttgtctcccatggtctaggcaggagtcatttttttttgctacagtggtggaaatgggtcaggctggagaatgctgaggtttccaggctagtggtttcttcctctgaccacagtaagaggaaaggaagctttccctccacctctactcctctgtgactcctgccccagccccatcctcagcttccacctaagaggtagtgcaggaaagtggtgataagcagatgtctgcagctgtgtgacgtgtgtcccagcccagttctgtggcctgctacctggggagcctctggttgtcattgggcctcctgttgcctctcagcttgcctccctctgtaaaatggggacagtaggccaggggctgtggctcacacctgtaatctcaacactttgggaggccaaggcaggtggatctcctgaggtcaggagttcaagaccagcctgaccaatatggtgaaaccccatctctactaaaaatccaaaaagcttagccaggcatggtggcgtgtgcctgtaattccagctactggggaggctgaggcaggagaattacttgaacccaggaggcagaggtttcagtgagccaagatcgcaccactgcactacagcctgggtaacagagcaagactccatctcaaaaaaaaaacaaaaatgtggggacagtaatagcacctgcttcagggaactgctgtgaggactgaatgttaatgtgtggaaagcaccgagagcctggcgtgcagtaagggccatgcaagtgttaggtgccgttgtcatggctgtcacattggtacctgttcaacacacttagaggaccgcctccctccaccttgatgacccttggtaggtactgagttcctgagttttagctgaggactgaaggtgtgactgcaataggattagctggtctgaatcagacttatgtagcaccaggcaaccttcaatctccttttgaaaggggaccaccctgaacctttcagaaaaacgttgctttccccgattgaagtgattcccatgtaaccacagtcgggagcacaactggccaagattttcattcaccgcagactcagtcctcatttcccctttccagatcccaccaggggcagatgaggtgtcacattgcatcacatcacgccatcgccattaccctgttcacaggccaccccagaaactcccggcgggagacagaaactaacttctgagctgtgactctgccccttggggttgacactgaggcttaggctgtttctcactcgcttgccctgcctttcccagctccctgcccctctccgctggcgtcttgtggccagatgacagtgctagctcttcacacctgaagcacattagcaacactggctgggctggagctctgctcccaagcttcctctccctgcctagaaacctgaagcaccgatgtgcagagcaaggaggaactctgctcccacgcctgattttaatgagggatggatgcatcctgcagggctcagaggttctgtttctctaaacccagaccaaatgtgtttgggtggccaggcctcgtaatctcagcagaggaatgtgcatgccacagggctgcagaaaacagtttccagcggtctgtcagcagatgtccactccagaagacagacagggaatttggagacctacaggctttggagtgaaaaagtgatggatattaagagcacaactacacacattcggattctcaaacgcccaataaacataaatattttccatccacaatgtactatatatgcctaaatatagggcaagccccaaatagcacatcctccatttccctaattagataaatttaactctctttttttttttgccaacttaataggaatcagaactatgattgcctttgaggtggggggagtgggcagtgggaattgactggcaagggactggtgggaactttctggagtgagagacaagttctgtactttcatgggggtggtagttactgggtgacataattcatcaaactgcaccctttagatctgtggattttaatgcctgtaaatttacctcaataaaaagaagtttggagaaatgaagaaataatcaactatctgtgtataatgtttaacttaatcatgtggttgaatgcttaaaattttataagaatgatatattaatctataatactcttcattcttatgtttcacacaataattttatccaagtgtgcatcttctgagattgatgggtttcatttctaagccacatttttagtcagcagtttaccagaatatatcatctacaatttgcctaatttatttgaaatgcagaacttcttgaatccatgttggtgctgaaatttgattggcacacaccaacgcccacttgcgtagcactgcagcagttgttttcctcatttgtcttgcaagtgaatattcatgctgctccccacatcaacagcttacgtattgctttctaaaatgggctttcaaatatttattgcaactttcaacaattgaacccaaggaataattaccaaatcttcattaaagctcattgcctccttcccattgtttccctctcgtgacctctaaaatcgtccaaacctgatgttgattgagatcatttcaggctagtgtgttttccccaaatgttgtcgttcaaataaagtaattgaggctgggtgcagtggctcatgcctataatcccagtgctttggaaggccaagacaggcagattgcttgagctaaggagttcgagaccagcctgggtaatgtggcaaaactctatctctaccaaaaaaaaaaaaaagaaaccagcaaaaaacaaaacaaaacaaaaactagccatgtgtggtggcatgtgcctatagtcccagctactcaggaggctgaggaaggaggatcacctgagcccaggaggttgaagctgcagtgagctggactactgtacttcagcctgggagacagagaccctgtctccaaaaaaaaaacaaaaaacaaaaaacaaaatttccaaattattagacacttaaattttaaaggacagtaagtcccaaactgtgagaaacttttataggcaacatcctcttttctaatagtttaacttgaggatataaaccttcaccttatttattttcagacatatatagtaaatcctggaatgtattcagatcaaagataaaatagagataaatttagcaaattttggtggtcttgttttataattcactattaatagattagcattgttagctttagtttatttgtgtagcaaaaactgaccaatagaatctaattaaactgaagagcttctacacagcaaaagagactatcaacagagtaaacagacaacctacagaatggaagaaaatatttgcaaactatgcatctgacgaaggtctgatctctgtcatctataagggacttaaatttgcaagaataaaacaactccattaaaaggagggcaaaggacatgaacagacacttttctaaagaagacatacctgcagacaacaagcatgtgaaaaactcagtatcactggtcattacagaaatgcaaatcaaaaccacggtgagataccatctcataccagtcagaatggctattattaaaaagtcaaaaattggcctggtgcggtggctcatgcctgtaatcccagcactttgggaggccgaggcgggcggatcatgaggtcaggagatggagaccatcctggctaacacggtgaaccccatatctactaaaaatacaaaaaaaaattagccgggcatggtggcaggtgcctgttgtcccagctactcgggaggctgaggcaggagaatggcttgaacccaggaggcggagcttgcagtgagccaagatcgcgccactgcactccagcctgggcaacagtgagcgactccatctcaaaaaaaaaaaaaagcaaaagtcaaaaatcaacagatgatggagaggttttggagaaaagagaatgcttatacactgttggtgggagtataaatgtgctcaaccattgtggaaagcagtgtggctattcctcaaagagctaaaagcagaactgccaattaacccagcatcccattactgggtatatatatacccaaatgaatataaatcattctaccgtaaagacacatgcacatgaatgttcattgcagcactgttcacaatagcaaagacatggaatcaacctaaatacccatcaaagacagattggataaagaaaatgttgtacagatataccatggaatactatgcagccataaaaaagaatgagatcatgccctttgcaggaacatggatggagctggaggccattatccctagcaaactaacacaggaacagaaaaccaaatatcacatgatctcaatgataagtgggagctaaattatgagaactcatgaacacaaagaagggaacaacagacactggagtctacttgagaatggaggttggaaggagggagaggagtagaaaaaataactattgggtactaggcttagtacctgggtgatgaaataatctgtaccaaaaacctccatgacacaagtttacctatataacacacctgcacatgtactcccaaacataaaataaaagttaaaaaaaaaccaacagcaaaaaaagtttttgttccctaccatgaataaaaagttgaaacattcttgaacaactatattttactcaagggcattatagacagggcaatttaacagatgcctgtggttagccatgggattgtaagcacaattctaaattatgaattactaattattaattttctggtttaacctcacatcctgtccagccttcagctacaaccagtgtgatatggtgatatataaagaagacttcatttttctaacagttcctcaatttaaacatcagaaagagtgctgttcttaaggaaatcatcaagaaagactaagcaccattgttttgtttctgatgttgctgtcactcagcaccgttgccattgctgtcagaagcaaaatcaaatcactcaccaagagctcggcaagcatgcaggtccccgtctggctcagggcagagactggtcagttatttttttggtagcaaaactctggctttagagttggaccatgagcagtcctgcttgctgctcattccctttctctagaaggacccctaaggagttttacagcaccgtgggggctttctagaatggttgaaaacctctggcagcagatcatccatcaggcttggtcccaagttccagacctgggttcttgactccatgactgttggccagtgacctaagttcagtctcattttcctcattcagacaagaattgcttgtaaggatgttcttaagtgtgctttcaaaaccatggagtataaggcttattttactccttaagtcttcctatttcctagtcacatctcatttgcatgttatatgccatctcatcaattattgggggacctaagatccacattttctattatttggccctgttgatgctacaacttctgcctttcagcttttcagccattgttctccacttcaaaatggacaaggaggaaaggtgaattggggttctaccactcctgcctctacaataagaggctccagcatcatgattcattcttgagaatgactcctctgacaggcctcttttcatttgcaggtgggccaagagaagggaaactgctctttccagaaaaacccaactccctgcatcatccctcaagaacaagaaaatatcttccacacaatatttgcttttttcacaaagtctggaagaaaagtcttggtaaggatttgtttagtggttggggtaacacgggtggtcctcactcggaagacaccagttttctatttgatatttattatttcctaaatctggttttaatcaatttgacttacaaaggcacagactgtggtcaactcctaattttcagtctgaggtttcaatcaaaatgttaaatttacattccaaatcctattacctggaaaagggataaatctttgcaacccaccaagcacaaagtaaaatgtttcttccactagaatgagtctaaacaagagtgattattcttgtgcaaacattttgggaaactgtttgataatatctactaaaacaaaacgtgtgtatcctatgacacagccattctactcttgagtatatccccaagaaaaatgagtacttgtgcttcccagaaaagacatgaaaaaggatgctcacagaaatgttaaaatagctgaaagctgagaacaatgcagatatccatcaataggagaataagtaagcaattgtggtatatccatacactggaatattacacagtaatgaaaaataacaaactactgctaatgaatgaatctcacagacagaatatattgagtggaagaagctagagacaaaagccacatattgtaatatttcacttatacgaagttcagaaatagcaaaaactaatcatgatgatagaggtcaagaaggtggttactttcagaggaatgtggatgggatggggcatgagggagcctgcttagatgctggaaatgtcctacatcctaatcagggtggtagtcctccaggtataaacacatgtaaaaatttttaaagacaggccaggcacggtggctcatgcctgtaataccagcacttagggaggctgagggggtggatcacctgaggtcaggagtttgagaccagcctggccaacatggtgaaaccctgtatctactaaaaatacaaaaattagctggatgtggtagtgggcgcctgtaatcccagctactagggaggctgaggcaggagaatcggttgaatcagggaggcagaggttgcagtgagccaagatcgtgccactgtactccagcctgggcaacagagcaagactctgtctcaaaaaaaaaaaaaaattataaagacacacacttcagatttgttctatttactatatttgttacacctccatttttaaaaagtgcaggtattgaagatggaatgacaatgcttttccaaagcctccttttttttatctttggttacatttctctaagctccttatttcagccctggcacatctcacctttatcatttcctttctcattcttttctcctgttggagaagggtgactgtttgccacttgaaaggttgggtttttttttttttttttttttttacttacatagtgagggtgatattgttgaaagcccttagacttgttagatgtagtgatacctagtgattttatagttacgactctgtctggctgaaaattttgccgtatagatgaaacatcatcaaggtatgtatacgcattttggaacctatcatataaaaaagaaaacttttgtaacttaaatttgggatttatgtttttggttttttgtttgtttgtttgttttgagatggagtcttgctctgtcgcccagggtggagtgcagtggcatgatctcggctcactgcagcttctgcctctcgggttcatgcagttctcccgcctcagcctccccagcagctgggactacaggcggccaccactatgcctggctaacttctgtattttttgtagagacagggtttcaccatgttggccaaactggtcttgaactcctgatctcaggtgacccccctacctcagcctcccgaagtgctgggattacaggcgtgagccactgcgcccagccgagatttacgtctctattgtaacttttgtgttttcttgaggaagtgtcacatgacttcttagccctcttatttacctacctaataaataggcatgaaagtatatttgccactacacaggtggaagtcacataatgtaggaaacgtgtctgtgttcaaaactcataagaatgctttcagaatgcaaaatttaagtttgtgggtttaaaaaaaaaaacaattatttctctttgtgaattcatccaattcttggtaggataaattagtgagctgttttctcccagttgcttgacttaaaggcatgctctggttcccactgggtgggaaatcccttgaatgccctctggtggcgagaaagaacgattgcatcttcttgtggatttcctctgcctggaattgccttagtcaccaagttcatggagcccactactctgtaaattgttgtggatttgtctttgttcttaattccattggaaatttttctgacttttcttctcaggactgtgaaaaaccaggaatttcttgcctaacagcacactgtaactttagtgctcttgctaaagaagaaagtcgtactatagacatttacatgctgctgaacacagaaatactgaaaaaggtaagccctaatgaaccgcacttgtggatgcatttagaagcatttgaattgttgacatctgattttgggtaaaaaaaaggaaaaaggaaagcatttgaattggtgtcctcatgacaatctggctgcccccccttttggctgtctacaagagactgtttttatttttatgtatttagggggtacaagtgcagacttcttatatgaatatattgtatcgtgatgaaatctgggcttttagtgtacccaatagtgaacatggtacccaataggtaacttttcaaccctcacccccctcccacattttggagtctccaatgtctgttaattccactctttatgcctatgggtacccattacttagctcccacttataagtgagaacatgcagtagttgactacttatgagttatttcacttagggaaatggacttcatttccatccatgttgctgcaaaagacataatttaattcttttttatggctgagtaatattccatggtgtgtgtgtgtgtgtatatatatatataccacattttctataaccagtcatccattcatggacacttaagttgattccctatctttgctgttgtgaatagtgctgcaataaacttaccagtgcaggtatattttttatacaatacttctttccctttgggtatatacccattagtgtgattgctggatggaatggcagttctatttttagttctttgagaaatctcgatactgcttttttgattgtactaatttatcttcccatcaacagtgtataagtgttcccttttctttgcatcctcaccaacatctgttgttgtagttgttgttgttgaactgtttagtaatagtctggctgccccttttgaaacttttccagcaagtgccattggtaattttgctggtagataatgccagggtaaaataccagacccttgctactcaaagtgtggtccgaggaccagcagcatcagcatcacctgagagtttcttagaaatgcagaatcctgggctccaccccagacttaataaatcggcatcttcatttttaacacattccccagggattttgtttggccatttaagtttctcatgctttagcttgcatcagaatcacctggagatcttgttcaaacacagattcctttggggtgcagtctgaggctctccagttgccacaagcacccaggtgatgccagtcctgcagtctagggacctcgctttggatgaaggttggctaaccttttctgtaaagggccagtggtaaatatttcaggctttgcaggccctacagtctcttgcaactgttcaactctgccattgtattgtgaaagcagccatagacaacactcaaataaatgggcatggctgtgatccagtaaaactttataaaaacaggcagagggccagatttgacccatgagtcctagtttaaatgacggtttgttttggtccaacttttgaacctcaggtcactttgctattatgagtttatcacaggtggttcattaaaaaaccacctcaaccagtgcatcggtggctcttgaagaatcatacaaatttcctatgatttattttaaggtgagagctgctgagaggccacttccaacaagttgctgtaaaaataattacatgtgaagataaaactaaatatgcatgttagcctcagagattccaattatttttctttagaaagactaaatgtgttaatctgtacaaacctatccacgtgtgaatgaataaccttagaaaagtcattctgtggttatttttaaataggcacagaggtaacacactgacctgagaggatgcaggcatcaggggatgtttttccattttcaatctgtagccgttacagccctcacacacctgaagagagctgtgcatagttctggtttctctggtttgctctggagggaaactggtttggggcaagttggactcacactgcagtgctttcttctccctttgtacctctccctttataaaggacagtgttggaggaggaccaggcctgacttagagcaccactggccatcctctgattccataagggaggctggaaaaccccacgtctggagaagtaccttcctgaaatgtgtccgcaggccaggctggaggactatgcctctgcatatgtacctgtcctgtttgtattcttcaaaaatggtgctgcagacagttttattgcctgtgccatacttgccactgtccatagagccctggtgacagcactggtggctgtaagccactctgatgtttcctttatcctcaacccagatggctgctgcttgcacttcagttatttgcacttaatcatgcacagctctgcagcctggttcttctgcttttctatcccggcagccagtggtgaccctttgccaaggaacatgtcccagtgactactgtccccatgggccagccaggccagtagagccgcaggcaagagagctgaaagctgtagggtgtcatatgaagccttcaaggctcattctccatgtgccctttcagcagaaaccaggagcacttccaggtgcagagaaaagcttagaacaaagttgacctggaagccagatggggccccagctgctcccagagcttcagttgccctgaagccagctacagcctcccttggggagtggagcccacatggctccaggcctcccgaaggatgtggagcagcgccagccttgtggtttgcctgggcctgcagtcgtgtttattttccttttgacctcaagatctggccccagacaagggaatttgaggttttactgttttgaccttaacaagttttcatttgaaatgtaggatctgatttttaaaatcactgtaggagccgggcgcagtggctcacgcctgtaatcccagcactttgggaggctgaggtgggcatatcacaaggtcaggaattcaagaccagcctggccaacatggtgaaaccccatctctactaaaaaatacaaaaattagcctggcatggtggtgggcacctgtagtctcagctactcgggaggctgaggcagaagaatcgcttgaacctgggaggtggaggttgcagtgagccaagatcgtgccattgcactccagcctgggcaacagagcgagactctgtctcaaaaaaaaaaaatcaccgtaggattcggatttttttggaagtattcttctttcagtctgtaaggcttttctcactgattctacaaccgtgggggcccatcctgtgccagactcctcgtctgcttggcctgtaacgttggcaattatcatcatcattatcgttattaatatccaagtttatttttatttattttaatgtttttatttaaaaaaatatttttagagacaggatcttgctctgtcacccagatgggagtacagtggctcaatcatagctcactgcagcctcaaactcctgggctcaagtgatcttcctgcctcagctagtcctcagctaggactgcaggcacatgctaccatgacaggtgaatttttttttaatcttttgtagagataggatgtttccccaggctggacttgacctcctagcctcaagtgatcctcccacttcagtctctcaaagtgctgggattacaggccttaaccatcgtgcctggcccaagattattgttattattcaagattgaaaatacagcatatcctgatacataaaaccccaactttataaaactgttaaattggtaaaagattatttgttgcttaaaattatttcttgcttaaagtgagttaactggagtaactcttttgaatgacaagcttcccaaaagcatttaaaatgtgtcttatggttgttttaagaaaagaatgataattggtgcataactcccaagtcacatatacagaccagggtccctgtgtgccccaggaaggtctttgtggtttctttggcagagatgagcaaagggtacccttggaactgttttctgtggagtcctctaccttcctgtttctttgagggtttaaccaaaggtggcatttaagtgtaagctccttgcatgacaggcaagctgggtagatgtaggtggggacaccacaggacaccttgcctgtggagcccctcctgccccacaggtagaatgttgaatgcactagttctctgctatctgtttccacgacagaagccaggctgcccttctgctccacaatcaacctgtaccactggcttgaggttctggcttctccccagaccacagtttttccagtccctgtcttcttccaaattctttctccatccctgttttggcgccattttctggttatctggatcagtgtctttgaatctgagcccacaggaagacctctgcctgcctctggctggggggtgattccagagtcttagctgtgctcccttatacccctgcccctttctccttaattcataagccagatatttaccccttccccatctctccatcaggcatcctctttcaatgtttaatggttttgattccaaaatgacttcatttaagagcaaagaaagagttaaaagcaactcatatgaagggtttgagggttgtggtcaaggcaggaagatgcctataaaatgtagatcagatgccttctgtggaatgccaggcctagatttgctctacacaattaaacagctttatttatcctcaactctttgtgaacatgtcaatatcaatatccaaatatctggctctaactgcttggaaaccacagcacacatcttgcgtgtgttgattactggcaaactccatcatttcccaccatccaccatgatctgcaaagaatccttaagagagaccctagtctgtgtttatgtgggtgcctgggatggagaggtatctagttcaatgataaaatttttgtctgggctacatggaatcatggaatttcagttctgcccagtccctctcaaggcccagccattatcatagaaaaatcttcaagtaagttgtgttgtttcttccacaggacagttcgtctgtcatccagttcatgtcccgcgccaaggtgaaggtggatcctgccctaagggtggtggaaatagctcatgggaacccagaagaggtgacggtgagtcagccaccccaggacagccctcctcagagggcaagggaagctgggtgacttggagacctggagctggaatttgagggtcaagacagtctctgagccaagatgttgggtttgtggcagacccaagactatgcctgccttggcttccaagccccccctggagaacttctgtggttcgttcttgtgatagcattgtcctttaggatgccatcattatgtgaatgtttcctgctatgattgtccaaagggaaaatggtctggaagtacacccacgtcaacagagttggatttccactgtggagccaggactatttatatctttcttagacctttcctaagacagaccacatctgccttacccgtcacattactccatgggtaaatactgtgttttggtttggtttggtttggtttttaagagacagggtctcactctgtcacccaggctggtgtgcagtcataactccctgtagccttgaatacctggcctcaagggatcctctcaccttagcctccagagtagctaggactacaggcacactaccatgcctaatttttaaattttttaaaatttttttgtcgggatagggttccacgatgttgctcaggctggtctcaaactcctggcttcaagcgatcctcctgcctcagcctcccaaaacactgagattacaggcaaacactgggtgttttaaaaacaagttgtttgaatgacttaaagagattacatccaaattgccaagacctagtaactgctctttaactatttaccacccccttctcctccataaagtgcagttggcaccaaggcctcagagacacgggagggtgtggcaaaccacgaggctgagagtggaggtgtgggagaggctggagggaagctatggccttggaattttattgccttttattgttgttcttgcaggagcaggggggttgaggggggttcatcctgtatttgacgcccacactcagatcccaggggagtagaggaggagacagcagccgatgcacttcttttgccagtgagctgtgcaatgatgctacctgtctgcttcccttctgtggaatttaccctctcttagaacagtcagtgttgctgtgacacatttacaaaagtgataagtttataatgattttgtgcttagaaactgttgttaatttactctctgacaacagtggagacaccacatgtcaaaatgtcagaatggggttcaaaccaaagactactcttacaagaccctggttgggaaagtttcatatagaaaataaatgctgggcaggcggatcatctgagatcaggagttcaagaccaacatggcgaaacgctgtctctactaaaaaatataaaaattagccagtcgtggtggtaggctcttgtaatcccagctacttgggaactgaggcaggagaatcacttgaaacccggaggcggaggttgcagtgagccaagatcatgccactctgctccagcctgggcaacggagtaagactccgtctcaaaaaaacaaaaaacaaacaaacaaacaaaaaaaaaaccaatagtaataatgcttaggacctcaataaaacttcagtcctgtccgtttttggtgagcaagagatgagaacatcagggagtctgggatgaaaatgaattcctgaatgagtgaggggttgggcattccctactcagtgaggagaatgagtgttccatgcagacttttatgctctacccacaagataagttgtccaagcactatttttgtttgtttgtttgtttctttgtttgtttgagacagggtcttgctttgtcacccaggctggagtgcactggtgcaatcatggctcactgcagcctccacctgttggctcaggccaggcactaattttaatgatagaaaccaaatggaatgatgctgggtcatttactacttagggtcagtttttctggcaggtcagatatttggagttggtgtttcccttttcttccctgccttctggccatttaactgctaattcagacctccacctgggaagtgaaaaagaaaagtggttccctgctcattgtcatagttctggtttaaaagttttatagaatgaaatacttgcccaacatgagaggtttagaatgttctggtaaaccacagtgttaataagtggaagctaatggaaatagctaacaggttttctacacgtagaatcccttgtgtagatgaaaaaaaaaaatcactgggcatattgccttccattataggactagactgtgggatccaggaaaatgttgcttaacatctcgttgttggattccaagtcatctgtactcccccaaaataccacttccattaattactgttccattttgagcactatggtgatattttcattatcaagagttcttgggaagaggccgagaggttttttttagcactcctaagaaaaaattaacacacatgggaattccacaatgccccttctccctcctttccatgactttgccttttcagtccatgagctacaatgaagttctacaatctgttgttctcaattttcctggcaggaaaaaaaaaatcttttctgagtaggaaggtttgcctttttagaacaaacacgttcttccctgcgtgattcttctgaatgcctggccttctgtcaactatcagtctgaaggggaatttccatagagcctcgccaccaaatttaaattaggcaaagtttcaaagattttagattaggcaccaaattgttatggccttggaaggaacaggaaatgtacttgcatttggtatcgagtgggggaggaaaacaatcagatttttaaccacataacgtgtgcacggtggtaaatttaactgatggagaaatcaagcaattttcctgtgatcttttttaataggagttttaaaatgcattttatattgagtagttatttcatgttttcttaaaacaattattgtattgaactaaaaataaactaggtagtttgttcacataacaaatctacattcaaagacatgcaaacaaattttccacttagtccatttttctgttctcagcattactacaaatgcctcattctgttatcacgttgaattcttcagcatcttctatatcatttccagggcatctctgggaagtagtgatgcctgtcttccctcagaagcacactgataaccccaatatacccacaattcacacttttttccttctctgaggtatgctgttttttgtcaaaacagaaaaaacacactactaggatatgaaaaacttcattctgggcctggttaggtcataaactacagaaccttaggtcatatattctcaccgggcgcttgtttctccactgcaaaaaataattcgtatttgcttggtcctttgtagtactttactgtttataaatgtagtacatttatcttcatgatgacccttaaatttaagtaaggtagtattatgctcattttatagaagaaattcaatctcaaagaggatacagtctcccaaagatcccacaagcagtaatatattaggcagagctaaactcacacactgtcactcaatatcctaatattggtacatgccatgctaataagtgtgctaaaatggatgaagcggcaatttctcaggtcccttccaatgatcctgtcctctgcttctacttgatattttttctctctttcaactagcattaacatccgaaactgtatatcatcaccacatttcatttaccatggttttttaatttaattattctttaaatttttctatttccatgttaaatccagagaaattgttactttttggaaagtttctactgctgcctgcctctgaaggccacgggacttacctgtttgtttgtcaaagcagaaatgcccaacattttgtaaacactaatttttttataactgtaaagatgattattccatacttaaaaccaattcaaaataaaataaatcctcaatacttcttattccctggggtagtaattttaattagattctattgattcattattttctcctgtgtgcctttatttgggaaatactgttagtttaccttgctatcgagtctctttccctaacaagaaaatgtcagccttacgagtcaggaaagcttttactttcactatcacatatgaagaatgaactaaacacctaacttggaaagtaaaacttaaatgagggattcaggacatttcccaaggggtcatctgaccaatttaagagttggtatgatgtgcctaaaatagcaaattaactcttctacttataataaaggtgcagatgtactgattagacatgctgacatgtacatataaaatatgcctaaaccaaattaaaagaaaacaaaatatattccatggcaatcttgaaaagtcagggagctcaatatatattaagagtatgcgctcagccaggcgcggtggctcacacctgtaatcctagcactttgggaggccaaggcgggtggaccacaaggtcaggagatcgagaccatcctggctaacgtggtgtaaccctgtctctactaaaaaatacaaaaaaaaaaaaaaatgagctgggtgtggtggcgggcgcctgtagtcccagctactcgggaggctgagacaggagaatggcgtgaacccagaaggcggagcttgcagtgagctgagatcacgccactgcactccagcctgggtgacagagtgagactccgtctcaaaaaaaaaaaaaaaaaaaaaaaaaaagactatgctctcacaatgagagcattaaacatttggtaattaacataatttaatatgccaaaaatgagaaaatagtcaggatgagggatgaggagtacacataggaaatttttgtgattttcttcattttgattgtattgctttcttgtcttcaggagggaagattttgacttcaaaagtaacaaaatatttaagaagggaattcacatctttctgttctaattggtattcttgcgctattttctcagcagtccatgtttctggataaagtttatgattgttaagaagtgtcagtgcttctacaatggaaattttgcctttgggaatgctcttaatatttatcatatcaaagtgatgacctttcagcaatctgaattcctttggctcttgatgtgtttcagcagcttttacctgcgcggaagacacaagatctttggaatcaacatacacatcttttagaaatggcagcagcttgtcatctttatgagcaatctctcccttaatttctggatagagactaatctgctctcacaggaggctgttggtagaggggtgcctgggagcaggagagggcttcatcttgctgatttcccattctgctcggttctctcggttggaatgcctgatcctgcgagtcactgcagcccccatctcataacatgatgccctcaggtttacgccacttgtgggaacactggcacaggaagcctccagggcgtctggagcatgcacacatgtcctgtgattctttatatcttttatttttatgccatggtacaagttgtgctttacagagcatttgggtgaataactagaaatatgccatagattcttgaggctttgcctggttcactaatgacaggctccagggcgtttctcagggagcgtgttagcatgtttctaggaccagccacatcagccagacctggctctgtacagacccaaacctgagaatgccatgtgagacctgtgtgactgcagaatcaaagtgctggttgcgaggtgccaattacatgttgaatttcatcttcaacccaactctacttacctttcagggagtgatgagtagggggcgagaggggaaaatgcagaaagtgttgtttgaggcccacagaaactataaagatgaagaacaggagaaacgtagttaatcatgccctggaaagctggcctgcagaaagaaaaggaatttatctctgagaaggccttcagaaagaaaatgagtaggctccggagacgttcatctgtcttcgtgcagccataaaaagttatcaggtgaggctgaggggtgaaggcgctttctctgatccctgaattggttactgaggcccacagaagaggaaaggacccctgaagccagaaactcccccaaggcaaatcaagactttatggaatcagctctgttactgcaagacatcccctcaaactcccgtctcagtctgtgtgagaagcgtgcatgaattcttgctattttcttgatattttcaaatagcagaatacatgataaacttgtaagtccacagatgagtcggtaagctgctgccatatggagcatgcaccaaagactgaggtctttggtgacagctggaaagactggctctgtctcatttcagcagaatcagaatggattcgaaggctatccagtggaagtgctcagaattgcgctggaaggctggagaaccagaccaaaaatcagagggatctggaaacctgagggctataggctgcgtccaggcgcaggaagtctggcatggtgtcctggacactggacacagctatccctggcttctctctacctcgtgctctggagtcaggcagaaacctttctactttctggagttgctgagaaggttcagtgataccagcatgaagctcctagaagaagggctggtgcatagctgctgctcagggtggcacagcccctccacagtcctgcccacatgtgagttgccccttcacaccactccctaacactgccctcaccaaagatgcaagcctggtatctcaaccagagaggcatctttcaacatggcaagcaagattactccaaaaaaatgccacttaccattcctttggtgtactgcttctagaggcaaagtttactgcttttactgtcatgaaatagactgtgacttgttatttatcatttatgtgaccaattatagttacaatcatgttccatgtgacaatagaatctttccccccttgaacctcacattatgctgagatgtaggatgaagaggagggttgttgaagggtcatcaccgcccccatcctatgccatcagcagtgggtggtgagtagttctttctcttcacccacctccccacatgtgagaattaagctctgaccatcaagaattgagaaaactctcggtatagttttccaaacacacgagtcatattttctaatggtcatcatttgcttatttgtttgatgaatatttattgagggcttgctaagagccaggcactgtgctaggcactggggactcgatggggaacaaaagagacatgatccgtgccctcccagagctggccgagggggcagcagtcagcaaggacgcaaacaagaattctatttccagttgaggttagtccccagggagtagcctgctttagattgggggtcgaggaatgtttctacaaggaagctgagactggcagatgagaaggaattcgcttgccaagcatgaggaagagtgtctcagttggggaggagagctgtatggagccccaaaaggcttggcctcttcaaggcactgaaagaccaggtagcaggaagctggttagcagtgaagagaaccatggtagacctaggcagggtccatgccaggtaacaccactgggcacttacaaaggaaagccattgaaagcttctgtttggagcagggaatggcatgatccagtgtatgttctttaaaaatcgtaggccactgtgtggatggtggattttaggggcaaaggtggaaataaggagctggttagaaggctgcgattttcacctggcaagaggtcagggtggcagaggagacagagcaagtggacagtatgtctatgtcagtgaaggtgcggtgaccggtgccactcacacgtaaggaatgcttatcctggagggctgggagtgatccagtgtcatctcgatgcaaagccccttgcacagcacatccacggtggcactctgttaatagtggctgtcattgcataaagagatggccaaggagatgaaccacatgaaaaatgagcctccttctccccaaatcctcaagtcctggtcagtttactctaaatcaaagtttccagtcgtcatgatgagtatgatcatcatcattattatttttaggcaacagaacccatttctaaattgaaatatgcttcagttgactcaggggtgaggttcctggaactccctcttggtggcttccataccccctcactggacccgtgggctctaaagaagccactgctatggaaagttgtattctcagaaggttgcccagtccatcaaaggctttcactagatgctagttatacccccagtaactatgaacaagatgaaatttttaccctcaagacttccacagccccaaacaggtcaacacacacacacacacacacacacacacacacacacacacacacacacgtgcacacacatcacacccctgcagcactgtatgcatacgtgcccagagtatctgtgctgaagaggtcaagacaggtttcacagaaggagtgacccccgaacaagtattgaaggaatttcccacgtggacaaggaagatcaggcattcaagatgaagtcagatggtgtcttgggctggattctcaagaagcagaccctgagatgagggcatcatgtaagcagtttatttagggagatgctcctaatgagacccagaaataaatgggacaggataggaaagaggagaagggaagcaagggtgagatttcagggaccatcttagctccaccctgatcttgacctcggagttggtcctgcctggaagcaggggagctggggtctcacactcctgtatctgccagtcattggttggggctgttccagaggtagtaaccccaagccactttaccctctaaaagtgaggcaggcctctagaagtgaaggcatgacaaacctgggggctgggcaggccaaatcaagagaggggacccaaaaggatctgggcagagaaccgagtcttggccacagatggaaatgttctgcactcagagcttgggtgctgtgctcagtgtgcgtgtccatgtcccattaagatgaatgacctcattgtgtgaggtgtgctcgaatctgctgaattcctgtgaagtgctaggcatgtgctatgattacctcctgtcactctgacatcacccctgtgaactaggcactacaacttccatcttctttggaacagaggctccgggagtgaaggagcctgctggatgccccacagccggtcagtggaagaggaatttctggccacagctctgcctgttggcgagccctgagtctcccttgaccccttacccctctggcctgtgctgtcctgtagcccagagcccacacacagagcaggtgggaggaatcgcattcctgggtggtagacagctgaccctctgtcttaggagtgacccttggctctaatggcctcaggagcacatcatgctcagacttatttggtggtcagttggctttggaactcttcccattgtgtcctggtccttaactagatgcacagatgtgcagtcaaggggagaatgaagactcctcgggattctccatcgcttgaggtaaatgagctccatccctctctctctcaagagcaatgtgaggattatggggagtagtagatagtaaacctctcagcatggtgcctggtgcatagtaagtactctacaaatgtgatccattaccagtaacaggaattagaaagcccagctcattcctctgcaaactctgacagagaaagggattttggaaacatgacacctggcaggcatggggcatgtttgacatctctgttcatcacagcacagacttacagtgccagtcttgccaaatgtacagtttattttctgttcatttatgtcgtctccataagtctccctgtgcctctgaactggcttgccttctaggctgagttctgagagccatctgaggcatggttctgctgaaaacatttattccagccccaaccaccctgtctccctcctccctcccccacacctgcactggctattagatggaatcagaatcgggtggaaatgtcatctcactgtcacagatgttattctctttccacttcttattttatataaattccttccttctattgagacaagtgtgtgatgttgactgcagagagcatcttgcccttgtcattgaccttcagctggcctaggtctggagttgaacctcctcttggatggtattgaccgagctgtccctccgtctctggaagccctccatccagcagaagcctgggtgagatgtactgccattgtgatcatattctcaggccttgtggagacatgggcattgccagctgttacagtaggcatatttgcattgatcagaacataaaagtttccagaaacacagaagtgaatcaaatagtgtggtttaggttcacccactgcctcagactggaagctggcttctggccactccatgacaccagcttggcaacctcaggtacgttaaattctacagaagcaggcagggtgccagtgtctggacctgtctcaaaggcctgtttgccctcctcaaaggcccccttgagacagatcctcatactccccattttcgtctgttttgttagtcagcgtccagtgtgtgagccctccagccagggtccgcaccaggccatcagccatcccttcactggccagagctcctgccttccccagctcagcctgctacgaccctcacagccactcccccaaaaccagcagacttctcctcctcctcagtcaatcttctcctttcacaccacctcctttcttactgaaagcgtggatctaacctggggaaaccatttcccccgcagccctctcacgggggctttttccttgtactcccacattcagttatctcttctgacctagattcattttgcagtgtactttgcaaaatgcaaatcacatcactgccctgctcaaaatcctccagtggcttctcattcctcttaaggtaaagcatggagatcttactgcagcctccagctcctgtctctccagcatatcatgaacatcttcccgctgcttcttgttcatcctgttggctccagttcactgtccaatggcagtgtctcacccttgccaagttcactcatgccaaagggggtttgcacatcatgttccctctccttggaatgatcttccctcccttgtttagctggtaaacttctgcttgtcctttcaccttcagctcaaatggctcctcagggaactctgttcactcccatgcctctatcatgaggatcttttatcatcatgaacttctcctttgtagcacttccacagttataatgatgcatttatttttctaattgactagtagtctctagaagctggaagttctgtgaaagcaaagactgcctgttttattcatcaatgaatttccacaatgtctagcacataggagatactgcagacacatttgttggttggttggatggatggatggatggatgaatggatggatggaacgacggacagacggatggacagagcagatggacaggttgattgacagatggataggtggtggatgggcggatggacagatggatggatggccaggactcccccaaaagatataacatttgcaaatatatttttgaaggagagagaaaataatcacactcagagactccacttcaaatcccacatctcttttgttgcaaactgagtcgtgttcatacttcatctgattttatagcagaaatgatgttgaatgtattaatttgtatattcatgaatcatataatgaatcagtgccttggttcaggtgacaggaatgcatgcattcatgtctttattgtatacaaatcacagtttactggagtccgtagacaggaagatttatcattaccttaaagagtgagaaggacctagaactgggactctgaagtatacagctgtggttttaaaactctgttttgttggagccatgggttcccttgagtttgttcagtgcagctgaggtcaggttagggaggaacagggcttagaaagaggggctgggtcaggtgcagtggctcacctgcagaactttgggaggctgaggcatgcagataacttcagcccagaagttcaagaccagcctgggcaacatggcaaaatcctatctctacaaataataataataataattagttggctgtggtggtgtttgcctgtagtcccagctacttgggaggctgaggtgggagaatcacttgagcccacctcaagtgattgaggctatagtataggttgaggctatagtaagccaagattgtaccacttcactccagtctaagcaacagagtgagaccctgtctccaaaaaataaaaacaaatgggggctgagtagtctgggttctagctgcccacctaagaagctccattgtatacactgggatgctataggaggttgaaaatcactatgtttccaagagctcagagaatgattaattctgctgaaaacaggagtaaggcaggcttcttgggaaagcagatattggagcagagtctctcctttaaaaaaataaaatggttttacttgcctttaaaatgctcaatttaaaaaatagtaaaacgtagaaaagagaaataatattcataatatcaaaaaaacacctgtttactttaaagggttcctactgtattgctgcaaagctgaagtcttctacgtattagataatctttttattttttattttttattttatttttttgagactcactgtgtcgctcaggctggagtgcagtggcacaatctcaggtcactgcagccttcacatcctagattcaagtgattacaggtgtgcgccaccacacctggctaatttttgtagagacggggtttcgccatgttggccaggctggcttgagctcctggcctcaagttgatccacccgccttggtctcccaaagtgctggaattacaggtgtgatccaccatacccaacctatttattttattttattttattttggacggggtcttgctctgtcacccaggctggagcgcagtggcacagttacagctcacttcagcctcgatatcccatgctcaaatgatcctcctgcctcagctccccaaatagctgggacgacagttgcatgccaccatgcccagctaatttctgtgtttttgtagagacaaggtctcactatgttacccaggctcatcttgaactcctaggctcaagcaaccctcccaccctggcctcccagagtgctgggattataggcatgagccagcatcttctgattttttaacttagcataataaacatcattttcccacattattactatgttttcaaaagtatctaaaatttggaaatcaggcaaaaagatgattacatatcctttcagtgtcatactggagcatcccctcgcccctttctactcaaagtgtggtccacagaccagcagcatcagcatcatgggggagattatttgaaatctaggctctcaggccccattctagactctaattcagaatctgcattttaatagagttcctcatgtgattcttatacacagtaaaatttgagaagcactggtggaggtcccaaattctgtaaagttacctattaacttacggaaggctgataagttataaatgactcttgccagtaaagataaaaatgatttctgtttgactgaaaatatcccaaaggttagaatttattgccttgtagggtattagccagttttgtatttgatttagtaatctgatttcagtaatttttttcctgtgactacacatttttttctggtctttttaaaactagctttgccaccctgctgacttcctcaataataaattaaataaatctttgccacgtattcactatatatttgtatgagaatcatgtttttaactttttgaaaattatgctttgacaaccagctttctgtcatcatttttaatagttctgtggtattctattttgtgattgaccatagtttacttatctattgccctaatgttagacacttaggatattgctaatttagtaccaatataaataattctgcagtgaacatctttgagcataaaactttttccgtattttatatttatttcctttgagtaagttttcaagtactgaattaatggatcaaagggtatgaacatttttattttattttttaattttttatttttttaagacagagtcttgctctttcacccaggctggaatgcagtggtgccaccttgactcactgcagcctccacctcccgggctcaagtgattctcctgcctcagcctcccaagtagctgggactacagacatacaccatcacacctggctgatttttgtatttttagtagacacgaggtttcaccatgttggccagactggtcaagtatgaacattttcagatgagcaataatgagcttgtcaaatggacaaggatggaagggcatttcaggaggcaagagcagcctgcagagaggctggggaccaccggtctcacagaggagaggcctctaactggctagaatgtaaatatgtgtcctgggagcagctggaaaggcaggaaggagaccagagtatgaaggccctggtgtcctgaattagatgctcagcctaaaggaaagtcatggatactgtaaaccgagaagtgacatgatgagacctgtgccttagaaaaacaactctatcagcaaggaggcctttccaagcctcctgaaatagtgctggtgagagaagacgagatgtgagccaggaggtacctgggatggaaacaagaggatggagagaaaagttgtttagaaaggtgtaggggcttaaccaaggatcacccagctcattggtggtgatgacgggacctgatcatcagtgcttcttgcctctccatgtcgtccatgctgctgttccttccttagagttttgttttttaatctaagatatgacttcctagagctacaggacactcagctcatcactcacagatgagtttgagagttgtgatgtgagagaacaggctctgccaaagcatggagcacgcatccaaggggatgaacagcatccctaaaaataataagagatgaagcccacattccggggaagtgacagggcattcttgtggaacttgacagactaaactgtagctgctactttaacctctgtgtccacaaaaccagacctccaacgtggcgttgctggtatgcagatttcagtgtccctaagaagccatctgggttagcacagggggctgggttttacagctaaccccgctgagctcagtgtctcagtctgattcatagtcaacaataaggtttagcagacttttctcacacccaggtgctttcacagaactgccacatttccctatcagaccgccatttcacagaggaagagaaagttggttgcctacggttgcaccaggaccagattaaagccagcgctcctccctctccatctttcctaacagttcctcacagttcatctgtacaagacaccatgagagattccaaatgcaggaagtgatttgatccacagctttttaagggcaggaacccaaagacatgagtctgtctgcctttaaagatgagagctgctcatttgaactagatagaaaatagtggatttaggatgacagacttcagagcccactctgtcctaccacctcctaccagtaaatgttcttccctgagaattgcctattatctgaaaattgctctttttaataaccccaagctggaaataatctccatgcctatcaataatagcatgaataaataaacagtggtatgtccacacagaggaatactgtacagcagtgagagtggacatgccacagcctggagcaatttcccaaacataacagtgagagaaagaaaccagatgcatgcctgtaatcccagcactttgggaggctgaagcaggtggatcacctgaggccaggagttcgaggccaggagttcgagaccagccaggccaacatggtgaaaccctgtctctatgaaaaatacaaaaatcagccgagtgtggtggcatgcgcctgtaatcccagcttcttgggaggctcagacaggagaattgcttgaacccaggaggcagaggttgcagtgagttgagattgccccaccgcactgcagcctgagcaacggagcaagactccgtctcaaaaaaagaaagaaaagaaaagagaaaagaaatgaaaccaggtactgtagttcatacatcatcattccattcatagcaaggacccaaagaagcaggtgatgctaatccaagctgttagacatccttggtgggggtggggactggaaggaagggggaagggagcttctagggagccggtcaccttctgtttcttgatctgagtgctggttacacacatgcatttagcatttggtatgtgaaaattcagcgagctatacacttaggatacctatacttttctctatgtatattcgacttcaataagtaatttttaaaaagtaaaaagagctgggagtggtggctcatgcctataatgccagcactttgggagctgaggcacaagaattgcttgaacccaggatgcagaggttgcagtgagctgagattgcaccactgcactccacctgggtgacagagagaaactctgtctcaaaaaataaaataaaaactaaaaagtagccagccatgcacaacctcaaaaaaaactccctacaatgatgctaacaggaacactccatttgtcaagggcggactctgtgccagatgctatgctggggactctgtgtgcattaccccttttcaatttctgggaaggcactgttctgctcctgtcttgcggatgagaaaactgaggctcagaaactgtggtggcctgtgtgtccatttgcctcatcccctggcacacgcacacactctcctaccccagctgcgggaatggaggcaatgaagtagaggtggtctcattttctttccttatcaccagggaagagccagtaagtaattcattcagttgacaggtagcctataaagaaggccactgtcaaccaggcactgcagtgtggtgatgacaagctcagatttgggggtttggggttggctaagagctgggttcaaatcgtgactgtgcatttgaactacacaatccagagcaaatatcctctctggacctccatgttcccctctgtaaaatgggtgtggaagacctcatagggctgttgtatgacttagacaagagattgcaaaaaaaagcataaactgacacagacaatattcaataagtgttagagagggatggaagccaggccctaaaaaggttaaataagcagtgctaggcattataacatcagtattgtgcccagtcactgcttgggcttgagcaaggggctggaccagtgggcttcagcgatcagtgaggcttcttgacagaggattgaactaggtttagaaaagactttcccaaaggggaatggacattccaaagagatggcaaagcttggagaaagacctgtggttggccagcctgtctggagccaaaggagagaatgactgcccagagctgtgatttttttgtcttttgcagtgaggagcttaaatgggacagtggtgtattggggagagttatttggtagcagaagacgcaatagatgctttgaattctgcaaaaccaaactcccctgtgaccagtggggataaagcagagccgaaggggacaatcagaagtgagcactgatacatgtttaacaatcagttctctggcaggagggtaggggtgccctgatttgtttgccaaatactcccaccatagcccatttcaaactgccattgcaatgtcactaggtacggagttaggaagagatgcacagttgcctctcatgagctgatatgagccagttccacataccactgggtttcaggaaaagttgggaaaacttgcctcattggaacatgggctccaattgctgtggctcccatgggaaactacagtacagcctctcgaacgagtttctccaatgtgctaggccctaccatgagacccaagacagactgtgtcctaactctagtggggtccacagtctactggggaaactggcattaatcaaataattcctctaagtgacacattgagctgaacacttggaaagaagagctgccttacatgcagagcactcccgtgttctttgtttcaaagctgaaacaaaaggtacattgtcgttatctgttctgaatcaagaacatagtgtgtcctctaagtttttcagtacacttttgttcacttcatgatatttaaatcagggttgttgtcattacaaccctttcaagacctagggcttggatttcaagtgccttttcaggtgccagtgaaaaatccatcagtttgcaaccagaaaatcgttcagcggagcttatgtatttatttattagtaacaacagtctggatacttctctgtagttctctccaaatgtcaagcccaggctgggctccatcatgctctgcgcacttctgtttaggaaacgttttcagctggcactgtggctcgtgcctgtaatcccaaaactttgggaggccgaggtgggtggatcacctgaggtcaggagttcgagaccagcctagccaacatggtgaaaccctgtctctactaaaaatacaaaacattagccaggcacctgtaatcccagctacttgggaggctaaggcaggagaatcgcttgaacccaggaggtagaggttgcagtgagccgagattgtgccattgcactccagcctgggtgacagaacaagactctgtctcaaaaaaaaaataaaaaaggaaatgttttcactgttgcgttgcctcctaggtggtcttcgaggccctgcacaatctggagccccgtggctacgtcgtggggtggatcatcgccatcagtttgttggtgggaatcctcatcttcctgctgctggccgtgctgctctggaaggtgagtctggtgattgcaggtccccctggggtccccactcatagatgcccagctctcctgcctttccagggaagaaggagtatcctgttagagcttccttcatggcaccggtacagtgaaggacagtgacccttcaggcagggagtggaatcttggctccccttgaggccattcacaactgaggatttggaccacttcagagtgaaggcaaaagtctcagttctctcttctcttaccttcccttagagccctaacataggatggtgagaacctaactccaaaacagaagtctggggagcaactgccagaagggggcgatttcccatttgcttaaaaaagatcagaaggcgaactatagaacaattcttccttcttttcctctaaggaatgtgaggaagatttctgaccagaaaacttgagtaactgagatgggctacagtccagagtagcttcatcataacttctcccaacctcatggtggttcatttggaggtggcccagggtgcagacctgtcctgcctcaagcatcactctctcaaggagaaaggggtgtcctcatccccatgtctaggatgatttgtttgcctcacactctcctttcagagacccggagtccttttccttcagagcctctctattcatcagtaatggtattggaggctttagctgatgaaggtctgtctcttccttgtttccactgtgtccccagctccaaaacagcaccagggaccataactgcaacttcctgacaccaaagtccatacttctctagaattacaaatttcagatgtaggtgaaaacagcctcttagagtattatagatggatattttaaaataagacaactaatttctttgggattacaaaataatatgtatgtattgacctaacataacatatcaattaccaaaaaaagttgtaaaacaccaggagttcacatcccagaaataaccatgatgagcatagtattgcctcattttgacctttttctctgcatatatagatatagaccaggcattctcataacatcaacttatttttgaatagtgtattagttaaattttacagtaatatactcagcatattttcaggtgaagtacctctaaatttaaaagcagtgggttcctttttttttttaagtatggggtcttgttctgtcacccaggctggaaggcagtggcacaatcatagctctaactcctgggctcaagctgttttcctgcctcagcctcccaagtagctgggactacaggcatgcacaatgcctggctcatttttttatttttttgtaaacatagggtctcactatgtttctcatactggtcctgaactcctggcctccagctatcctcccacctcagcctcccaaagtgctgggattataggtgtgaaccaacgcacctggcctggatttgatttattaatctgggaaaaacgtatacctatttttccctgaagacagtactgtgaacatctttccatattgttcaaagcacgtttccagcacatcttaaagctgtagagtgtctgcagtctactcatccagtcccctgatactggaatttaggttgcttctgtttcacacttcttttaacagtgccacattaaatatccctggagccaaatatttgcacaaatctttcattatgtcgttaggttgaaagcctagaaatagaattgccatcaaaagggagtgtatattttaagctttttaaaaattatatttatttttttattttgagatggagttttgctcttgtctcccaggctggagtacagtggagtgatctcagctcactgcaacctccccctcccgggttcaagcaagtctcctgcctcagcctcctgaatagttgggattacaggcgtctgtcaccacaaccagctattttttttttttttttgtatttttagtagagaccaggttttgccatgttggccagggtggtcttgaactcttgacctcaggtgatcctcccgccttagcctcccaaagtgctgggattacaggtgtgagccaccccgcccggcctaagccttttattactattgcagattgccctgtagaaaggtcataccaattcaccctcccacaagcagtgtatcagaaatgtctgtttgccaatagtggatgttaccttttaaaaacaatctgccaatttgttgtttatttaatccacatcgccagatagattcttaattctcctttttctccaactccaactccttcctgctgagacagcctctggtttgtgggtggagaacaaagcctgctcagtgtttggcatctgaaaagacaaggcttcttgctgagttgagggctttggtgcatgagtgtgtgtgggtgtgtgtgtgtgtgcgtgcgcgtgtgtgtgtgtgtatgtgacttccttctgcctttatatgggctcttaaaatgagaggagctgtgtcctttatggctgggtgtgtggaaccagacagggcacagagtggggagtgttgtggccgtgccccacttccccttatagtctgcatgccctccttctggccgccccacctggctctgcctctcaggggtgtcctgtctcctctgcacagcccctgcctcctccagcccaccacctgctttgccttgcttttgctgtgtttgtttaaaaaagcatggttgcaggagatgctgtcatgggtggggagaaccctgaggtcacccagctgtgtgggatccaaagagccaggacctgagaaggcagactctgccctctgccacagactgggagggagagggcagtcacggccgccagggacacaccgtgtgcccagaccagggcttgccgtaactaacgggtggcaggaaagctttgaggaggctgttgaatgaggccacctgggtcacaacagctttgctagtcaacccagagcagtatctcatttcggctcacatttctcgaacgcttactttgccccagtccttgctttgcctggactaggcactgggatgcagcaataactgtgcccttccctgcacttgaccgcctcaccacctagcaatagacctgcaggcataatggagggtggtgagtgctgcgcagtaactgctctggaaactgagaagaaggtgccatgagtccccctcccttgcccccaaggaggagggaggattaaaaggtcacagagaacagtgtggtagatgagagcagctttcaggctgacagctgtgggcagcaatcctgactctcacacttgcctgacatgaggccttaagggggctgcttaccttctgtgaccctcagtttcttcctctgtaaaaaggagaccatcacctccagtttggtatgtagaggttatgcaaggaaaatgtttagcactgcgcttagcacacagaagccaggggatatttcataaatgaggtgtcattcgagtctgacctttagtgtggtttgagttttccaggcagggaagggtagatgaagattccatccagagggaaggaagaggtgggaaaataagcagggtttgtggagagcagcttgtaaagtttgtcagggcagtcactgacctgcagcaagaccgtctgccacagttgtgaaggccactgctaaccaggacaaagggggagcatgggaggtctgtgagcagagcggtggcatgaccagatctgtgtcgagagagagatctggggctgggtgcagtggctcatgcctgtaatcccagtgctttgggaggccaaggccagaggtttacttgagcctaagaatttgaagttgcagtgagctatgatcataccactgcaccaggtggtagagcaagaccctgtctctaaaaggaaagagagatctagggacagtgtgggggcaagagtagggccattgccatgggtcaaggtaggacaggcagggtttgctgaccagttggacttgagaggtcagggagaaaaaaagaatagctgtctctccttaagataagttcagacaaaggatgggtgcccttaatcagggtggggaaggcaagatgcgaattagtttggcaagaggaggagcttggtgttgggctttctgagtgagtggtgcttagaggaggctaggagacaaggctgggcttgcctcactccctgtcgcccccacccagcagaaggaaggtcaacagaaggaagccccttctctctacttggctacacatccgcatcattctcttcccaccgcagaccagctttctctatgtttccctacacatcgtagggagatagttgcctccagcccctccaaacttgcatctcaaggactactagccacagacgcagaatgatcagccacctctgattcctggtcccacatatctgggagagaggatctgcctggcccagctctagtcaaatgtctactcccatcaactgtggaagggaggaagggagttgggagggagagaatccacctggcccaatgtgggtcatatgtctcccacggaggctagtgggggagaaagatgcaggatggtggtttaggggatactggggaggagactctcagaaaagaaaacaattaggcaggcaccccaaaggagttcgctcctgcaggatttcatcgttgttagtgctgctgctgcctgaattgcaggctgttgtatcataccagctagctatgctgcatacaaactgcccccaaattgaatggcttttcacaaccattacatctgacaaatttctgggtcagggatccaggaagggtttggcggggtgattcttccgtcccacatgacattgagtgaggtcacttagtggcatttacctggtggctaagctggtcttcagagttcaagacagcttcattctcatgcctggcaccttggtagggacagctggaaggctggattcagtcaagtccttcttcctctccatgttgactcagggcctctccatgtggttcttccagcagatggtctgactttttatgtggtggcttaggctgaaagagagcgctgccagttgtcttaaatgctagcccacagctggcatagcatcatttattctgttggtaaaagcagtcatatgccagctcaggttcaagagaggggaaatagaccctgcttctcaatgagaggagtggcaaagccttagtggctgtcttttatctgtcacatacatgatgttcgaaatatgggcaaaatcttttctttttttttttttttttgtggcagtcccactctgtcactcaggctggagtgcagtagcatgatcttgactcactgcaacctccacctcttgggttcaagagattctcctacctcagtctcctgagtagctgggattacaggtgcctgccaccaagcctggctaagttttgtattttttgtagagacggggtttcaccatgttggccaggctggtctcgaactccaggcctcaagcgatctgcctgccttggcctcccaaagtgctgggattacaggtgtgagccaccgtgtcttttccctaaaagtcactattacaaacaaaaattcgcctaactagaagttttgttctattttaaagtagatgaaacctcatctctctcccatagtgtcatagataaaatcacagttgaactcctttggggaagaggaggcaaacagaaaatgttggtgcagcatttatgtcagagtgtgcagtctgttgaggcagtgttgtaatgtgataaggggcttggtggaggggatttctttagggaaaaaaatttttttttctcaaaaggctaactatgacttttgagacttataaagtctcaaaagactttataagaggttaaaagggcaattgaaatgtaggattattttaaagacctacgtatttctagaacttcaactacagacctcttgttaactctgattcccatgtctacaacctaagaatgatacattatgtttagtgaatagtgattcggtatcacactgacagtacggtgcagtaacccaaagacctgttaattgatggtctaaactccagcctcatatttgacttatacgggaggtcttaatgtttccggcttattgccatattccatatgtaatttcctccattcctttcaaggggaaagccactgagtgttacccagctgccactgctgaccggttgcccacttcactgagggcctttgaagacagcggttggcggggacagtgttgaagtcctcttccctttacagaaccgtggctcttgaatgtccttctagagtagctcttggcattgctacctatggtcatttgctgctgccttgaggtccggagccaaaagtggttgttcccaaaagtgttgcataaacgtgaatcgtgacatggtactgaaagctgagcagagcagctggccatgccgccgcattcacagcaccacacaagcctgaaggtctgcatgctttatgcttgcaagatggccagcaccttcactaggcaaagagtagtaggtccctactaggtggcaggccctgggcaaagggacaaagataaataaacaacagccctcacctagtctgtttcttttttttttttgacagagtctcactctgtcacccaggctggagtgcagtggtgcagtcttggctcactgcaacctccgcctcccgggttcaagcaattctcctgcctcagcctcctgtgtagctaggattataggtgtgcgccaccatgcctggctaatttttgtatttttagtagagacagggtttcaccatattggccaggctagtcttgagctcctggcctcaagtgatccacccaccttggcctcccaaactactaggattacaggtgtgagccaccatgcctggcctcaacaacagagccctcacctagtcttgaagacctttaggaaaatcagcttcagcaaagccctgaaggtgagcaggacttggcctgtgccaccagcccctggccccacctacgcatgcactgtggtgctactgtttacctaaatcagaaagcccttatcgtgtcagcaagtgtcttttccagagctgagctccaggctccctgctgatgtgctcagccagaccagcccctcatctgcctctgaccctgtgcagctcctggcggccttcaagaaagcccatctgctggcatctcaggcatcttctcatgcttggcggcagcaggccctggctctgacacaaaatccacaatgagggccccaagctaaccagaccgctcttcaaattctgaaatggatcctaatcagctttcccaaagctgagatgttagcagacactgggagccataatttaaactttatgtgcgaggattacagtagccagccaaaccaccatgcaggaagaaaactttgaaatatgaaatgcttttaaaggaagaaaagtccaaatgagtcccctctcctttcctgcagctcctgactgggttggaagatgcctgggcctggcatctcttcaagacaatcataaaggcctgtttaggaggagaaagttaaattgctcagaggtgcaggagggataacaactttgtgtgtgactggcacctttaagaaataccttcagcttatataagccagcctggtttctgtggaaagaatgaagatgatggggtgtttctccttttgaagaaagacaccccccttcccttatttagggctccaagctcttccctccctgtctttctctctgcttccctctcaccctcctcccctccccagctctgtccttgtttgtttgcagtttgccaaaacatacaggccaccactcagtgaaggagagagaccatatcctccctcactgctgtcaaccaaggaccctctctctcccatttgacccttttgcaaaccgagatggtttggagcaaagggaagtgagactgcttggccagccctatggccatgtcttcccaggaggcccaggacctacttgctcaagtggcaaagagacaggctgcagaatgtgtttgccagccctctgaaaagggctgcctcaaaccctctatcagctggggctgttccaagagcctgctgctttaggactggctttgggctcatggtttttatttgagagcattacttctgacctaaggcagaaacacttagaaaacaaatctgtgaaatggctcagagaatgtgtaaggtttggcaacccctccagaggtcactgggttatcaccttcccttcaaactgggctgggagggcatccttgcttctcctccaaagaaaaaaaatgaacagacacatgcccatgtgcttgcacacacacccttcacactgcctcaattagaaccatgtgccaatgacattcagtgggggcttgtttatgcttgggagtaaatattgggctgatgttgcactgtcgacatctcgagacagagacatgctatgtaaatagtcaagtaactgaagagaactataaacatgaagtcttgagttagtccaaaaaaggaatttgtcccaggtcctcagaatcactgtctaggaagcaacccaaaggccgcggagtgggtaggatcccccaagagaccagatgtcatggtgttgtccagctggtccctctcaccctgcagggggctggggaggaagaggctgctgctgcagggtggataccccagaactcagtcaggcctcatgcctcacgcagcacccatctaagtaaggctgtttggggcaatctgttgtttccctaggagttttctggttgcttttggatacatggttatatgagaaaattgtgtatgtctgttacgagggttcagggagctgctctttggagctgcaggaccagcagacacaaaaaccagaaagcacactgttccttcggcttccagccaagcaaagcttggcttgagtcacctcctctagggtttctatgtttcttctgctacagatagaacagttaacagagccgcttgcccctcaaatggtgaagcaagcactggaaggttccagaaaaaatgcagaaaaacattgactccattggcttggaagtgagtgtggggctgctgggcatccagcttagcccatcattaatcatttcccagcaccttcagggtgggctcagctggcaacaaaaacagagatttgcccagtgtttctcaaagctctccccaaggcacccatgcgtgctcacatgagcgggtgtgtatgtctgaaggaggcctacttaaccttgggatgtgctaatttcccaagtgtagggggactttgggtcctggcagtaatggaataggtaggactggctatgaagtactatagcaggctgaaggggctcgtgggtttcctggcatgtgtatgaagagttacagatttagaccatgtatctcttaagcaaaggaactacaggtgctccttgacttatcatattttaagtcagaaatgcatttaataccccaataaacccatcataaagtcaaaaaactgttaagtcgaggtatggtaacttggggattatttgtacttgttagatcatcaaattcagagtcactatctttagtttagtgtttatctttagtctttagtttttatattttatctttagccattatctttagttgaagtcattatctttacttaaggggatgacaaaaaccttgctaaatttagtttttcacttcctcattcctgattgacattctattagaaaatgttagctaggaagacctgttctttatttattgacttgcatttattgagaactgttgggaataatattgtgcctctagggcatttagaagataacatgcttttttctggttcttgcaaattactttcggtgacttgttctcatgggttgcttattttgagtttttatttttagagaactgatattttttctgttcttgatgaggtaatcaggcagtctctatgttacatgagttaagagtcctagacttacttagcaagtcctcaattctgacacttattataagacatctgatccagagctgcatgttcaactccatcaagccttgcctactttcctcatcggtaaaattgaccttaaaatcccacagttcaaaagactataaaagttaaataagtgaacataactgcatgtgttttgtgaattcaaagacctcataatcttttaaaatattattaaattctgttttatttgtttctttcaaaaattaacagatttttaaaaattgaaaattgaattttcaaaaaatttctcaaaaatctttgagaaaaattgagatgggacaaagactctgtgccttgttcccccttagtgtgagtcctgagtacccagctgtgtggcccacagtctagagccttgaattcactttggggaaaacagaaaaagctgtcatgatgtttcagggctggaagaggtctgagaatcccattgatctcttaggcagagacgaagacactatggctcgaagccagaaaataaccttcccaggctgggcgcggtggctcacacctgtaatcccagcactttgggaggccaaggcaggcggatcatctgaggtcaggagttcaagatcagcctggccaacatggtgaaaccccatctctaccaaaatataaaaattagccaggcctggtggtgcagacctgtaattccagctacttgggaggctgaggcaggagaatcgcttgaacccgagaggtggaggttgcagtgagccaagatcgtgccactgcactccagcctggcaacagagcgagactccatcccccacccccccaaaaaagaaacaatattagtttgacagagccaccactagactatagggtacctttgtgcaaactataatagtaaatagcaccgcttcctaaagactctttacttccatctgtcagaaaaaattcagaaaactctgattttatgagaacaagacactctactgccatctgttggaaaacagttataataaacttatacacatacatgatatctgtgatgtgagtggtatcccccagccccttaaatgcagtgtagcacctgcactactgtacctacaactccctagccatgagagtgcattatgttttaagaaatggtcttcagactctaaaaaaaggaagacatacatcagtggtagctctgatctcccatccaagagattacgcataggctgtgttaggaacaggactggagaccctgcagtgttagagtggggcatagagcttgcaaggctgtttcagccaggggtgggtgggggtgattttcaggcctaatgctgacaccactccactgagagaaagaagcttgcttccgggtgcctgcaagagatgacagtgccttcaccttgttgttagcaagaattgcatacataaaaacttgagcacatgaaagccacatgtaagagtgagttcaggtgctctaaatcctttccagattgttaacacactgtctatgtcaaatccttacactagcatagtgatgagaaagtgagccagcttttgctcttagagatgaacaagagaagtctggttcaggccgggcgcggtggctcacgcctgtaatcccagcgctttgggaagccaaggcaggcggatcacttgatgtcaggagtttgagaccagcctggccaacaagatgaaaccccgtctctactaaaaatatgaaaattagctgggcagggtggtacacgcctgcagtcccagctactcgagaggctgaggcaggagaatcacttgaacctgggaggcagaggttgcagtgagccgagatggcgccattgcactccagcctgggtgacagagtgagactctgtctcaaaaaaaaaaaaaaaagtgaaaagtccagttcagcaaggcacactaactgatgctgtttaaatctagagccctatcagctgtctgtctgattcattaagtcagcaaaaaaaatattgagtctgtaccagttaacttatgctacttgacaaaccaccccagtattcagcggcttaaaagcaatatccatctatgcaggtcacagttctgtgggttggctatttggactgagctcagtggggcagtttgagctcagcgagacttacatgtgcctctgcgggcagctgggagttggctagtctgggagggcttcaaaaaaaactggtctcttagcaggttagacataggcatttgtgtggaagcagggcagggttctgagaaagtaattggaagtgtgcacagccccttggggactgtgtaacagacacaacatctcctccctctcatccaattgtcaaagctagtctcagtggagaatcaaggctgggaaaatagactccacctcacgatgggaagagctggagagtcacatggtaaagggtgtggagggtatgtgggcatctttgcaatttatcgctggtaccaaggacaggtgagatgctgagtactggggattgaaagcacaaagcctgccttcaaagagtcctaagacaaatgcaggagataataagggggcagactgttaagtttctgcttgatagtgccatggtagggaaatgtgacttctctggaattacaactgagtgacctgggattattgacacattacaacatcagcagccaaaggtatgtgctagagaatcctatttccctgttacatccttccacagtttcatgattacattctccttcatggcatgtgaccagccacatctggccatgttttcttagccaaccacatctttatcgcaaaagaatgacatttcaagcagtagcttcttagatttccattcagtcttggtccgtttttctggccttctgtgggtgtgctgtggggatgatgtctatgactttttcttaattatccagaaaattctggccaagcaccttttcttgcagaggggagaaggtgaagaggtttcaggagagaaaagtatatgtgtgggggcgtcagaacatggcattctgatgaatgtggtcttatgctgggaagaaacctccagggctgaaatcaccaggaactcaatatctgtttacaaaactggccttgaggattgaagctcagaacacaagactcttgccagttgttctaagaaagcttctgctctttcccagtcattcaaactgcaccaccttatcgacttcccctcacggtgaatgctcaggatctccttggcaacgtgggtgaagatacctgctggctctcttgacagttctcgtctttggcttggccaataaaccccctttagggaagtagaaagatggtggcaacagacagctcctcagctccacctgccttcccttcttcaggggagcttatgaccatcagggtggctgtgatgcttccctggatgtttggctcacagtgaagaagcatgaggacaaatacacagacaacaaaaacatttgatgtgcccatgacagctgggtttgcttcacgatttgtgtaggacacgtcttatatgtgcatgcactgttggcagcagactgcagagagtcttaagggttttccaatatgacttgggaattgcaagctgatgataccatggtaccacaacctgcagtgtggcaagcctaccagcaccaggtcaagtgtgtgtctctgtttgatttcctctattcaaggggattgaaacaatgatttgagggcaagtcatttatttggaaggtgatctcaggaaaaactgttggagagcagggaaggaagccaataaaagatttgtcatcaagctggttacctctgcaggcaagctccatggggaaactggtagaacgtacacctcagggttatcccacccaaggagagagggagctggggtatttgtacacccgatacagtcagccttgtttaaaggaagatgcagagaggaatgtctgacctcataaacagagcccaccaatgttagtgagccaaggacgagagatgccgagtctctcagagcatgggaggaaaggtaagctttgggctacaaacgttgcttcactgtttggtggtgatgactatgtgagaaaaactagacacttgtcttaccatatgtgaaaagttgtaagaccaaatgtaacatcaaagggcagggtcttttcagaactaagctagaggaaattgccatcctgggtcaggatgaaacgcccgttctaagtgagaatgtgctgctgactgtggtgcacagacagcacaaattccatgggtttgagagaaagatgtaaatgacagcaaggtagaatgcagacctgcagacgctttaaacagcctctcacgtgagagcagtatttattaaattattccacagatggctaagatctctcaagatactaggtttatcaaaagccaaataagcttggggaatgtcaggtccctggtttttttccccaccggaattaatggtaatggatcctttactttccactgtacattaagactctctaaaaaaaaaaaaaaaaaaaaaaaaaagccacacttcccaaacttatttgaccatgaaactttttttttttttttttttttttgagatggagtctcactctgtcgcccaggctggagtgcagtggtggcacgatctcggctcactgcaacctccgcctcccaggttcaagcgattctcgtgccccagcctcccaagtagctgggattacaggcacacaccaccatgcccagctaatttttgtatttttagtagagacagggtttcaccatgttggccaggctgctctcaaactcctgacctcaagtgatctgcctgtctcagcctcccaaagtgctgggattacaggcgtgagccactgcgcccagccatgaaacctttttttactcccaaacacctttgaacagctctcagtaactggtattccccagcacacagtctggaaaacactacaccagatgcattttagaaggaacaaacagcttacgtaatatcacccgcaggaagtccatgcattttgaaaaatgtctccacaggatgtttttcttgccagtgttttctctaatccgaggggtcctccaagcctccccagccctgtgagtgcaggtcacacctacccagggacagactgccttggggtcacaatggctgattcttcagcacttctaactcagcttctctttctttctgcctttcagatgggcttctttcgccgaaggtacaaagaaattatcgaagctgagaagaaccggaaagagaatgaagacagttgggactgggtccagaaaaaccagtgagctgccacaccagtcacatgacctgatcactagcctgtcatccttggtctttgtatcttccatatttggaagaaaaaaatcttctccagatttttcggaggccccactgatgctgttctcttcttcattctatcaagcccaggtgccagcctgaggcagccacttcggccaggtcacacgaccggggccagcaccacttcctttaaagatgaactctgaactttggagagtgagctacagagccgagcaatatttatggatgcaacacgcatggtcaaccctcaggggaaaactgttacctaaagtatttttataaatataagccttttatactgattatgtcttttatatttgtatcgatgttttattatttctattaaatagttatataattcactcaagcactgatatctggcctaaaatcttggaagtacatgtccatgaatacaaattttaaaggatgaaaatcttaccgtactttggaacttgctgtttaaaaagacagatgaaataagttgaagaaacctcatgtaatgaatccaccaggctggcagtggtgcatataaactgtgggtgtggcaagaccccgaagacatttcacatctttatcgcctcgatcaagtgtggagtcacatgctaatgtgtgctaaagaactgtaagtgttttttcatatgtacttttcattggaagattcccaacaagaatttggatggaaaacctgatccctagcaagaagtctgctctgtatcacctttatatagcagacatgtcaccctgcttctacacagatgatggatgaaagcttggagcaatgccatgtggtcatctggtaaacctcagaatggcgtctcatcctggacatcctgcatcagagttcacacaccacaaggactaaatccttgtcccctaagcaaagaattgggtctgaatgctgtgagggattgcctttttgtggtaattttcattgagagatcttcatttcccctaccaccctggctgtcccagctagtggtgattgcagattccttcccagagaggacatttaaccgttttaaaaaaaatgtcttagattgggttcccaagaagcagtccctgaaacaaggatttgtgtgcaagtaacttattaaggaagtattcccaggggataccagtaagagagtgggggaagcaggacaaggaaggagacaaagccaggcaaatgtttgtcatttcagggagagctccatgaagtttagcctcagcctgatcaggggaactccggaggaaaagttaggcctcagaggtgtcccaacctgaatcaaggggctggctgcacccagaaggagatgtaaacgttttattctcaattcctgctggcgtaatggctccagtagctcaggacagtcctctaaaggacaaccacagatgcatcctcagccaggggagacacagggaaatgatgcaaaagaaatgatgcaaaggatctgagcagaacactgcccctccccaccccctgaatgtgtgagtgctgagttacggccttcagtatccaagctctctgtttgacagtagatatattgtcagatgcactgtgctgcttagttttgagtgcagtgtgattttctgaaagggcaatgagatgatggatgtagcatgctcagcactgacctggcccatagtgatcactcaataactgttaacagctatggctgctattcctactgatggataaccatctaataagacagaaaacatggggctaagagcagggtctaacggagtcttaatggcttattacagcctgccaaagtgccagctacatacacatggcatccagtgcggatgaaacaatctataaaaccaagggtctttcttatagcaccttttttactggaagctaacacgttgggagtccgtgaacattgtcaaaaagacatcaaactcaacttctgggaagacagatttttaatacacatacttggctaatactcacaaacatatctaaagttttggcaaaattatgagggtgatgggtgggtactaacctggcatggagcaggtgtgtcttttggtttcttatgcagttgactctgctgcagggagattacagatgtaacctcatgcttctcttcctggtgaacatgggaatagaccaaaaaaatcaagggtcaatggcatgaactaagctgatcctggaaatcagggatgttgcatctaactgtgggatggaggcacagaggtagctacagggagcaggatgaggcaaagaaagcagctgtcactcagagttcgcttatgagttttatcaaaagcagcaagaaaagcagtcttgggtgggttttatcacttattaacagccatttatgaggcccctgctgtgtgtcaggcactgtgcaaggtgctggaggttccccagagaacacttcagggacattttgcctcagggtggcaaaatgcagtggcatgtggactttttgaatgggatgccatttgcagctttcctttgatggactcttgttcataatgccatgttttctttaatgaatcatttaggattcttaggtgatatttctggaacagcaccatcaacagctttggccacatgcacttagagcaactaacttgcctcctgccggggtgtaggtgcgttggtgacagtgtagaagggtgattcgcaggcccatgttctgcccaccagcaaagccccactggagaagggtagactcctgtgggcagtctcagagctgggacctatttgcttctgcttgattctgcgtgggtggacccacatgagcagctgtatacccaggaggtcactaagactttataaaggcaggttttaagaaaaccagccttggcatcaccaccagcagatactgaaagcctccccaggaacctgtctggggaaggatgatgcctctgctggtctgatcgtgctgagtagcaggtgggctacggggactggggagttaagcattttgtgcagtgatagagaagtcaagcatatcgttagcgctctctcaacttgggcagttcacaagctccttcccagctcagaagccctctctatgctctcaggggaagcagatggggtggatcagtacatctgtgttacccttccagaatattatttgaaaattctacagtatgttctactttctccccttcctgcttccatggtttcactgtggaatcctataagatattctcctgagcagtattatttcagtttccttcagcttttagttgaatcttcaatgtggttttaaccaactgttcagagaactgaaatggtttttaaatatgaaaaaggacctttgtaaaaatggagtaaaacagtgccccttttttaaaaaaagttttgcttatgcttaatttacataggactcaggagagtttggaacatcctccaagtgggccatagagctgtcacaaagaagaggccatgatgtttagaaacaaggggacactagcaggaggggcagggtccactggcttagtggcaactgacaggcatccattccgaataactcagcactgaggtttcctcaggcagttctttaggaaaactgtcagcatcatgggtactcagaggtatggtagaccttgtagaagatccactaggaagtcctccttcaccaaatcatgtagctactgcccttgagccaaaggcaatgaggtttaaaacaaaaacccaacagcactcctgggaacatcctgttttccatgcggaagcatagcagatccccagacgatccgtgtgctgtatgctacctgttgaaccctagcatggtggctttttaaaaggttatttatgacttttatttttgggtaaggcattatggccaggtgcatgcagttatgtctgggttacgtgtgaaacgtacatctggtgaactgtatacttggctcaaacttctcaaaatttagaggtgctggaaaggattgtcacttggagcctttagtagacaaaaggcagaaagtgagcatcatttcagaaatgctttagtatgcacacttttagctgatattttgatatatagaataataatatacacagtggagaatattcaaagagtggctgaagggagaatacagagccagtagggccaaaatgaaacttctaggatgtcttctgaattttcagcacatggggggaataagtgaacaaatttcccaacatcgtgcaatgctttatagcacaatgatctagatttcagactgtgttaaggttttttctttgttgatgttgttgttttaattctaatgtgcacggtgtgactggcagagtgagtttaaaagctttacgagtgattaattgcttggcaggcacccacgctatctgcatttccagaactttactgatgcatccatgtacatttccactgaggaattttggtgggtggggggaggttgtgctgcctcacaatgtcacgtgtattaaagtctaagcagtcacttctgattcacttgcactgtttgggaaatgtcaggtttacaaaaacatacatgtttggaataaaaaatggctgcaaacaattcagaagttcaatctgtaatttacttgctaataagaactttttaaagtgttgaagctagggtttcaatgtaatacaacatgagcattaaagagaacatcaaggtccatctaattcacatgaacaacccacctgatgtggctgaactgtctgcagtccttggcctccacacaagaggtaccacctcctctctgcatcaccctgactcccctggcccagggctacacctaggttcttgatcttgagataaatgtgcccaaattaaatggtatggattccttattatcagtagacttctttcacatgtgcctgccagttactaagcatttttccagaagcattttgataacattcttacacatttacaaatattgtattctcttaggttttcactctccttcatctgtctattaatagttatgttcttgttcatattccacatgctgttcatttatgtgtttttttttccctagacaagactgttaccagataggggttccaatccagacaccaagagcaagttcttggatcttgggctatcaagaattcgaggctagtccctaaactgaaagcaagtttattaagaaagtaaaggaataaaagaatggctattccatagacagaacaggaccagggctgctggttgcccatttttattgttacttcttgattatatgctaaacgaggggtggattatgcatgagttttcagggaaaggagtggacaattcccggaactgagggttcctcccctttctagaccatatacggtaacttcctgacgttgccatggcatctgcaaactgtcaagacaccggtgggagtgtcttttaacatgataatgcattataattagcacataatgagcagtgaggggaaccagaagttactcttgtagccatgttggttttggtgggttttggctggcttctttataacagcctgttttaacaaggtttttatgacctgtatcttgtgccaaccccctgtctcatcctgtgacaggatgcctaacctcctgggaatgcagcgcagtagctctcagccttattttacccagcccctattcaagatggagttgctctggttcaaacgcctctgacaagaccaataaagatctatgtattttcttggtgtttttcaagagtaagcctttggctgtaccaatcaagtctactgggttttgctttctatttcgttactgcttttagatttattaaaatttcttctattgcctgatggttaaaattcatacacatagacaccacacagtataaaagagttatgaaaaaatatacaccaatgggttaagaatgattgtctttaggtaagtgagattgtcaggcttttgctttgttttattttgtttttatttgaatattcgttttctacagtgagcatgtattttgtaacaatgaaacatatgcagattacttgtaaataaaattatatctgggagactataaattgctaagccaaaagagatgccacattgtaggtctggaaagagatttgttgcagcaaagagcattgatgagcctgacacttatgacaatggtccagtgagtaatttcaagcattttaattccagtgcttcctggcttaacaaacctgccaccattactaatgctaattaaataggtttctctgaggttgcccaacctgttttcctaagccaggaaatggactcgacaaactcaaaagaatcaaaagatacaaatttaagaggaagaaaaatcactaattagtgaagtccgcttcctattcaatcaggagttttacagctcaccagattacctctcatccttaaagtctgtctggtcctcaggttactgtttagtaacagaattgatgtaagaattacttagagctcaggctgcactatcagaccgactggcagctatccatcagcaaagccacctgtccctaagatcatgtccgttcactctatgtatacatgcaactaaagtgtgtataatgagatattgccatccctgagctgaaatctaaggctgcctgctgccaaatctctgctttgcttcaaagtccaaattattttatattttattttaaatcagttttttaatcctaaaaattaaacctcaataaagggataactactatcctttgaagacaaccaattggtattttaaaaagttggcatttaaaaaagaatctccaggaaatgtttcttctagaagatgactgattaggaaaaaatgaaattatctccaattccacatctactctgaacccaccttatcaggagaatatttggctccatataatagaaaactccgaattaataaggccttaaacatgataaaagtgtgttcctctctcccaaaaaaagaagcagaagctctggtacagcagctccatgggcatcaggaatccagctcctgtctttctcagcaccctcaaggttgcctcatggtctgagatgactaccagggaactagctatcatgtccacattccaagccaaaaatagaagaggacaaaatgacatatgccccctcccttttaactattcttcctagaagttccatataacgctggccagaaattaattatgtatgtagatatacccacccactaaggaggctggggaatgcattattaaggaataagaggagggtaagtgttaagagacaactaccagttgccacaccctccactgagaaaatattcagactatagctgccttgagctctaaacttgtacgcttcaaatccttaagtctggctggatttaagcaagaggcaaacctttatttgggctggagtcagggatggggtggatgcatggagctggttaatcatattcatgtccatacaaagccctttcttcttttatgtaacttttctcctttgtgtccccaccctcactcacattcccctctctcccagaggaaccaagtctaataaatacatgcccttaaacatggatgtacatcatattattttttatgtttcacttaaatggtattgagcacacactgttttatttttccaggttgtattgatgttgctgtgtttacatttggttcattgtttctggctacagcattacattctacattatgttttcagcacatttcacttctccagcccctctgaaggaagcctttgctgctttcactgcctgctgcagtgaacactcacatggccctttatgggtggagctagaatctcatggtatctatcatatatatgacatctgaaggtggttggttacgttctcatttcgttgctagattctctctaaaatgaccacagactggacactcccagcaacagtgtatattcccacatccttgcccaaaatggaattatctgacctaaaatgttagaattacttatctttttctgatgaaactgaacattctatcattatgcactgatccttttttatctttagtaatactttcttatcttaaagtctattttgattagtatttacacaacatatctttttccatccttttattataatctttctatatccatgtgctttggatgtgtcatttgtaaacatcatacagctgaatgttaaaaatccgttctaacacaatctttatcattttactggaacatttattttatttacatttattgttattaatgaaataattggatttatttctatcatcttttgtgttttcttttgtccacctttttatacttttctctcctttctcttctttgttttcacattccattcttcccctccattattcacttttattctttatgcagataacagatactttaaaactttaagccttacaatagccaggcacagtggctcatgcctgtaatcccagcactttgggaggccgaggtgggagaattgcttgagcccaggggttcaagaccagcctgagcaacacagagagacccccatgtctacaaaaaaaattttagctgggtgtggtggtgcacacccatagttccagctacttgggaggctgaagtgggaggattgcttgagcccaggaggtcaaggctgcagtgagctgtggttgtaccactgtactctatctagcctgagcaagagtgagaccctgtctcaaaaaaaaaaaaaaaaaaaagacttatacaatatcttacttatttaacatatcacaatctagagttagtcactagtcactatcttttaatgtattttaattttatattttaaccacataaatcattgtttttgctgttttctttaatgaatgccagtctagatttgcccctatacttgccaccttcttggctcttaattgcttcttgcatctcagatattttctcctggcatcattttccttgtgcctagtacatcctttagaatttccttcagtaagaatctgctgatggcaaatgtttccattttgttttatctgaagctgtctttaattgcccgtattcttgactctttgctggtacagaattctacatcagcagttactttcagtggatgaatataacatttcattttcctcttgttcctgttgttactataaagaagtcagcagtcagcccatttgtcactcctttaaagggatcctgtcttttctcttaggtttctgtgaagattttctctttgtttttgtgtgctgcagttttcctctgaagagttatatggcatttatgcttaccttttctgcttgcaatttgctgtacgtctgtggtttgaggtctttcatcagttctcttcatctctttaaatattatctctgctccattctctttcctctcgctttatccttcttgcctctttatctaccactcctagttccatcccatcatccctctgtgcagcattctggactatctcttctagcccatttctgtattcactatcttttcaacggtgtcaaatctgctttgagacttgtttgttaagatttgggtttcaattattatattcttatatccaaaggcttttagttctccctcaaatatgatgggcacttctctgtattttcttgtttattgcatataatttcaaatttatttctttaaacataaaaatcatagtttccattttgtgtctggtaagtgcaatgaagtttttatggctctgtttctgctttctaggatttttcccctgatgatcgtcactcttggtgcttggtttccttgtgcaactagtggtttgttggtttgtttattgttagctgcttagtttccttgcaaaattacttgtggtaattctttgaggtccaggatgaaatatgttctatagagagcctttgctttcacctctgccaggcaccagtctggggccataccttgaggttttatggaccacccaaataacatgaatttgaacaacacagtcatatgaaggccagcttgtggttgccacttctcagcatccctgtcaactcctgtgatctgctctgcaccatggcaactttcctcaaagttttccttggtcctccaggagtactagtaggaatagcgtttctccatgtggttgaatcttatg

SEQ ID NO: 1103 - DNA, 3108 bp, Homo sapiens
atgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctgggtccttgtgggcgcaccaaaggcagattccaaatacagcccttcagtgaagtctcctggggctgtgtttaagtgccgtgttcacaccaaccctgaccggagatgcaccgaactggacatggctcgagggaagaatcggggcacgtcctgcggaaagacctgccgggaagaccgcgatgatgagtggatgggggtgagcctggcccgacagcccaaggctgatggccgtgtgttggcctgtgctcatcgctggaagaacatctactatgaagccgaccacatcctaccccatggcttctgctacatcatcccctccaacctccaggccaaaggcaggacgctgatcccttgctatgaagagtataagaagaagtacggagaggaacacggctcctgccaggctgggatagcgggcttcttcaccgaggagctggtggtgatgggtgctccagggtcattttattgggctggaaccatcaaagtgctgaaccttacggacaacacctatttaaaactgaacgacgaagtgatcatgaacaggcggtacacctacctgggctacgcagtgaccgctggccacttctctcacccgtccaccattgatgtggtaggaggtgccccacaggacaaaggcatcggcaaggtttatattttcagagctgaccgaagatcaggcaccttaattaagatctttcaagcatcaggtaaaaagatgggctcttacttcggctcctccttgtgcgcagttgacctgaatggggacggcctctctgacctgctggtgggggcccccatgttttctgagatcagggatgagggacaggtcactgtctacatcaacagaggaaatggagccctcgaggagcagctggctctgactggggatggtgcctacaatgcgcactttggagagagcattgccagcctggacgatctggacaatgatgggttcccagatgtggccattggtgcacccaaggaggatgacttcgcaggggcggtctatatctatcatggtgatgccggtgggatagtccctcagtactcaatgaaactgtctgggcagaagataaatccagtgctccggatgtttggtcagtccatatcgggaggcattgatatggatggaaatggctatcctgatgtcactgttggagccttcatgtccgacagcgtggttcttctcagagcaaggcctgtcattacggtggatgtctccatcttcctcccgggctccatcaacatcacagcgcctcagtgtcacgacggacagcagcctgtgaactgcctgaacgtcaccacctgcttcagcttccatggcaaacacgttccaggagagattggcctgaattatgttctgatggctgacgtggccaaaaaggagaagggccagatgcccagggtctactttgtgctgctgggagagaccatgggtcaggtcacagagaagctgcagctgacttacatggaggagacgtgtcgtcactatgtggcccatgtgaagcggagggtgcaggacgtcatcagcccgatcgtgtttgaagcagcctacagcctcagtgagcatgtgactggagaggaggagagggaactgccgcctctgacaccagttctccgctggaaaaagggacaaaagattgcccaaaagaatcagactgtttttgaaaggaattgccgttcagaggactgtgccgcagacctgcagcttcagggtaaactgctgctctccagtatggatgagaaaaccctgtatctagctttgggggctgtgaagaacatctccctaaacatctctatctccaacctcggagatgatgcctatgatgccaacgtgtccttcaatgtttcccgggagctcttcttcatcaacatgtggcagaaggaggagatgggcatctcctgtgagctgctggaatcggacttcctcaaatgcagcgtgggatttcctttcatgaggtcaaagtcaaagtatgaattcagcgtgatctttgatacaagccacctgtctggggaagaggaagttctcagcttcattgttactgctcagagtggcaacacggagcgctctgaatccctgcatgacaacaccctcgtgctgatggtgccactgatgcacgaggtggacacgtccatcaccggaatcatgtctccaacctcctttgtatatggcgagtccgtggacgcagccaacttcattcagctggatgacctggagtgtcactttcagcccatcaatatcacccttcaggtctacaacactggcccaagcacccttccagggtcatctgtcagcatctctttccctaatcgactctcatctggtggtgcagagatgtttcatgtccaggaaatggtggtgggccaagagaagggaaactgctctttccagaaaaacccaactccctgcatcatccctcaagaacaagaaaatatcttccacacaatatttgcttttttcacaaagtctggaagaaaagtcttggactgtgaaaaaccaggaatttcttgcctaacagcacactgtaactttagtgctcttgctaaagaagaaagtcgtactatagacatttacatgctgctgaacacagaaatactgaaaaaggacagttcgtctgtcatccagttcatgtcccgcgccaaggtgaaggtggatcctgccctaagggtggtggaaatagctcatgggaacccagaagaggtgacggtggtcttcgaggccctgcacaatctggagccccgtggctacgtcgtggggtggatcatcgccatcagtttgttggtgggaatcctcatcttcctgctgctggccgtgctgctctggaagatgggcttctttcgccgaaggtacaaagaaattatcgaagctgagaagaaccggaaagagaatgaagacagttgggactgggtccagaaaaaccagtga

SEQ ID NO: 1104 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 1105 - DNA, 98642 bp, Mus musculus
  misc_feature (1)...(98642): n = A,T,C or G
tgtgtgtgtgtgtgtgtttgtgtgtgtatgcacatgtaggtgcatgcacaccatggtttgcatgtggaggtcagaatttttcttttcttttgagattaggttttcatgtagcccaggctggccttgaactcacggtgcagatgaagatgaccttggactgctgttaataagatagggtatttaccaaaggccctgtaggtccccagtgctttcccctgcctatggcatttgcttaccttgaggacgttgtgattcgtgatgtcttcacagtcagcagagcggttgcacaaacttctccagcccggtgcgaaaggattcactggagaggaaaacatgacagggacacaccggcttctcaaaagcaccggatccttcagtaaagtcccaaaggctttggttggtgtgcaggcatacgcccctttaacccagctacctggtcagaatactaaagctaggcacacagtttgagtaacacgtgcactgtgtctttactccatctgggggctaattgaagtaattacaaggcttgaacatagaaacatagtatgtctggctactccctcgttaattcctcaaaaacagaaaccataaaacatcattcctaaagttctataagaaattgttaagtttgtacctagctgcacagttaaaagtcatgtcaataaaacgacattgactttgagtaataaacaatatattatatttgaaggtaggctgactttaaaaccacaaccaggcagtagattagtgcttagcaaacacttcaaacttattataggtaggagacatctcgtgtttatatggcgattcttttttttttttttttttttttggtttttcgagacagggtttctccaggctgtcctggaactcactttgtagaccaggctggcctcgaactcagaaatcctcctgcctctgcctcccgagtgctgggattaaaggtgtgcgccaccacgcccggcggcgattcattttataatctattatggttttgaattaaagccataaaattaacgttgtaaaatggtttcaccttgaaaggctatgaacagctcatacaggaagtccctctctggaagtttaacaaaatggcatttgtatgatggctctatgacatggcacaataaatcagagattaagttatccaagattttcttcagcactctaaagagcaggtcattgtgtcttcctacacaagatcctgtggtaaaacgcacggccatgtggtaagaataatcaggttcccgatatgctttagagaaaggtgagaataaaaacagttgtgtcttgcattagtttctgctgcgtttttccaaaaacatgtaacattcaacatcgttaattttgcaaatcagtttcaaaatcgtacttatctagtaaatggtctagataattccattggtctgtttatacaatacatataactaataattttaatgaaacaacaacaacaaaaccggtcattatcattattagatgtctgtctacttaagagaaatggctaccgtgtggtagcaatacaggtaagttaatagtgtcaaaaagccattggggctcaagagatggcacagaagttaggagctgtggttcccagcctcccccatcagatagctcacagctgctcctaactcctgggcatcagacgccctcttctggcctctgctggctcctgcactcacatgcacgtgacacacacacacacacacacacacacacacatgagacacataataaaaatacatcttaaaatgtaaggatgtttttggggcactggaaagatggctcaggaccttatattattattatatatattattaccaaagaccagaaagtcatatttcttctttatcatagtttcttcttgggtttctgctttgatagtcttataggaaagcatacatgagtaaagtccagataacggctccaggaaatccttcagtaccagttctcctgtgtttgttatatttatctggctattccctgatcaaaagaggaaatcgctgggttactcaacaggtaacttaaacattattcagtagacgcagggctataaacagacatgcaaaaattcaaaaattaatagactatttgaaccttgagaacccaataaaacattttttaagacacggtctcactgcatagccctggctggtctagaacttgctatgtagatcaggctggccttgaattcacagaaatctgcctgcttctgccttctgagtgctggaattaaaggcatgtagcaccaggcccaacagcccaagggggaaaaaaaaccttaattgtcatactactctatgaaagaattacatgagccgggcacacttgtgaaatatatgttgattttctttatttagttctgactgatttatgccagtaattcagtaaattatatatctatacatatttacgtgtttatataaatacatttatattttatatttacacacacacacagaaacacacacaacacacaaataatgttgatattacaaggtactattctaacataaaattacatattgaatatcccatattactggtgttttatgggtaaactttagtacttaggaaaatgtttagtacttaggaaaagtagggcccaaaaataactgccgcagggtaaccagacagcatagagaaaatttgcttgagagggagactctggattcagtcccaagcactgggaaacaaaagtaacaaaaaatggtctctttggttagcccaggccaccttcaaacttgtaatcctcctgcctcaacattttgagtattgtgctcacatgggctgtgcagtcttttgcatctgcttttagtttttgcatacgaagaacttaagtcatgggccaagaaaaattataatttgtcgtgttgagaaaagttaattgcagttaaaattaaatttcttggggctggagggattgcccactgtttaagagcacttgctgctcttgcagaggatctgggttcaattcccagcaccaacaaggtggtttacaaccagtagtaattccacttccagaggatcagatatcctcttctgacctctgagggcatcgggcatgtggtgcacatacacgcatgcaggcaaaacactcacatatacaaaaataaaatacagctaatagaattttaaaattaaatttgttcttttcaataatggcagtgcttttttaaaaaaacaatgttcacaccgttaaaatatatttaaattatttaccttttaatgtgttttcatttggcccagtccataaataggtggggtccactgtttctttattggcacgatcaatatccatacaaataaggacaggactagcctgatgtaactttacatatatttttactgtgacaaaataaaattctgcgtaattacattatacagagaaataaagacacacacactcctagacaatgataccagttagttctttcaggatttcagtacttaaaaagtcttcgtaacgtgtccaatgctagttgtcatttagaatgaagtctttgctgcttccccatagtaaacctttaaactgtactttgtcggtaatatttttattttgtgacagtctagaaaaatgaagatcaagttccttttaacgtacacattaataaatagctccaataaggagctatggaatcaatgttacaggatgttagcttgactgacaaactatttcaaaactgaaaacttggtatttcgcgtaagcttcctgttgtcttgtgcagtgtttactagaaaggtgtacaacagtgactcaactggatagatagtacctagtctcacaaggtactttttaaggtccaatcattgccaggatcagaatctctaaagtctattgttcagtttggcagtgtaatggtggtgttgggaagagaaaggccttaaatgtggaattgttctagacggagtgcagtgttatttcaaatttggagtactttttcctgaatgtaggaaaactacagagagtagtaacactggagctgatgtttgatgcatgaatagggctggttaatacaagagggagagaagagccttccagaggggcgtccactctgctaagtgccttcacccattacaaagcagaagtatttgaaagagagacgtggtatcagagcggcagatctgtggtgaacactggaatagaagactagctttgagggcaatgatgcaaacttcccgaactgcagagcacagacgccctcctgcctagctcccttttccctgcctgaagaacctaagaggatgcatccccagctcttgggacaagccttgcgtgagaagaggcacgtattacctgggtgccctaccgtgccgtaaacaaagcctttgatattgaataaggaagaacgttgcgatccaactgcggaggagagaacacctctggcttattattagtgtttggaggacacacggttcagggcggggcggggcggaggcgaagaaggagggacgggggaggagcctgcgggccaagccccacctcctgcgagagaccagagcaccgcgtagagtagggcccacgcaagcatcacggctcaagcactagtggcgacggctgggtgccctcctacctcaggccaggcccaacgcctccccatcgctcctctacagagcgaagcaaaccgccaagggcatcttccctaccggtcccaggctatcacgggggcggctgtgcccgagagcgcctgcgtgttccggcttggcacgaggggcggggcaagcgctcgcagatggagagccccgcctcctggcgcacgcgcagttgcggagcgctgcaccctccgagcctttcgcacctctcctcgggtcccgtgttcccgctctctagctctagtcggcctggtggtgtgacgagtaaaggaaacgaactcaagacttcctcagactaaaggaactgatgagtgaacacagtgggtcctaaggacggtggcggcggctctgagcagcccaaggatgccgtagtttggcgatcagaagaagggagatgtttgtgagaatttcctaaaagcgagggctcagctctggaaccccgagctaacgttgctagcgttgctggatctgtcaaaacgtcacatccagttttcacctagttgcatttttctggcatacaaaaccaagaccttgaagagccctctcctctgtgcttcagaagggtgccctcagaccttcccacgtggaggaaggttaaacctttatttttttcagcttagagtgtgagatgatgtaagggacaccccctcatgcaaatttattcggaagtaactttgctttagagaatgggtcccttcgaaaggaaggcgagagcgggtgatcttttcctcagctgatgtgagataagtcactctcagggagctccaaaatagtctttcaaagttcttctgaaccctgtgctggggaccaaacccagggcctttactgaattgagtcgctaaccccatcatgcgtggtcccatcttgactgctattttaggtgacctgaaagactttaggtgttgtttacctcttggcagtagagcaccgctctcagtagtggttttgagtaggttggttagggagagagcccaaggttcagatagggtgcagaatggttatttggggtgagatcaggagttttcagttttatttcctttgagccgagtcagtatttggactgtctcagatggtccaggagcaacctttgtcagtaatttcatttttagtcactgttaattttatcgatctagcacaagcatgaaatgggattcaatgagtcagatccaccccctgtcagttactacgtctagactcatgggttagcctcaactgttaaaaatgtggatgggtgttttgcttgcatttctgtctgtctgtgcaccacaggcatgcactgcccacagaggccaaagagtgtgtcgcctctgggactggagttaacaatggttgtgagcagccatttggatgctgggaatcaaacgtgggtcctttagaagagcagccagtgttcataaccgcagagacacctcacttcagatttaatcaaaacattttccaaaagtacaaagtattactaacttctcagttattgcacacgattctcataaacttatgtgttaaatcttaactcttatagaagagtgttagaatagtcgggctggagagattgctcagtggttgagagtttatctgcttttccagagggctctagttccaggatccagctgggtagcttacaacaacacccttttaactcagttccaggtgagccagtgccctcttctggaaaccatggatgcctgcattcacgtgtatataccctctccatccctcccatatatacagaattaaaaagaaaacctttagctgggtagtggtagcacataccttgaatcccagcactcaggtagcagaggcagaagcagaggagggcagatctccgagttttaggccagcctggtccacagagagaattccaggacagccagggctacatagagaaaccctgtctcaaaacaaacaagcaagaagaaaagaaatgagagagagagagagagagggagagagagagagagagagagagagagagagttagtttgggtcttggaagtatccatgtaaatgtttgatgtaagctttgtgctttagttttgtttacttattttgagacagtgtttctctgtgtacctctggctgacccagaacttgttatatagtccagactggcctcctagagatctgtctgcctctgccttgtgagtgctagaattaaaggcaggtagcatcatgctgggcagcccagacaaaccttgtcatctgactctatggagacgctacatgagctgggttcactatgaaatctatactgatttcctttatttctcaatatctcatttaaactgatttaggtcagtaattcagtatatgatagatatttttatagaagacaaatttatttgatttttaaaaaagatttatttattattttatctaagtacactgtagctgtcttcggatgcaccagaagagggcgtcagatctcattatcgacggttgtgagccaccatgtggttgctgggatttgaactcaggacctatggaagagcagtcaatgctcttaaccactaagccatctctccagccctagaagacaaattaataatgctgatatcacaaggcactattctaacatgaaacattacatattgatacttgccaaggcacagttgtacacttgggctatcctgtctttccttcttttctctttttctttccttttaacaaagagggtctttctgtatagccctagttgtcctggaactttctttatagaccacactatcctcaaaccagagatactcttgcctcagcttcccaagtgctgggattaaaaacatgcagtctatgcctggcatgatacagcattgttaattaaagttcatatttttaatatttccgtagtttatctgcaccagagtcacactcaggctttcgtgtcacatttagttgtgctgtcccctcaggttcttctgagctgttgacagtttctcagacttttcttgttctctttcttctcttgttttctttccttttggttgttgttgactttgacagttaaggactgctttgaagatccggactcagccttaaatgatcaagtattttgtggaaagactctcttggactttgcttgatggtttttctcattattgcatagaattatagatttttgtgaggatggcagcagaaaagtgacgttcccaatacatcatatcactgatacatactaacatcatactttaccactgttttgttttggtttttttcgagacagagtttctctgtgtagctctggctgtcctggaactcactttgtagaccaggctggcctcgagctcagaaatccgcctgcctctgcctcccaagtgctgggattaaaggcgtgcaccaccacgcccggctacttttccacttttaatgttaaatgcattaaatgtttgtcaggttactccatataaggttatcccttgcccccaatactgtactgtttgtactctgcacttaaagaggagagatttatgctccacccacttgagggtagaattgctacacaaatggttgtacggctctgctttttatttgtctcttcaggtatctggagagactggaataagcagcaaacagcatggtaacagtttgctgttctgtatagagaacattgtaacagaaacccccaagtttctctctgtcttttaaataaccaattaactattcatccttctcatccctgtgaaagtgtacagttcctcttctgctacttttgacgttgctatttttgcttttagaaactaacaaacaacaaatttccccttttcagtactaaaattaaaccttagtgtttattaaaccttagaatgtctccgagctccatattgtcctgcagaactcatgtcagtggagatgctgctatggttctgtgatctcagagacaatgtgagccactcgtgttatatatgcatatgtacacaaacatggaatatagagttcacagactgcctatataccaaggcactagttaatgtgagctcgggttcatgttttcagtgtgcttgcttagctcagaagtatgattttcttcagatacagatagatggctgatgtacagttctcaacctttcctctcaaatgtgtgtgtgtgtgtgtgtgcgcgcgcacgtgcacacatctgtcggtctttttgaagacagggtctctctattataaagccctggctgtcctggaactcaatgtgcagatcaggaaggcttcaagctcatggggatctccttgcctcttgccttcccagtgatgggatcaaaggtgttgcacccccatacctggcttcaaatatatttgtgtaactaacaagatgatgaaagtgggaccattccttccaccctgttggcatcgttagaaatgcccctctgagccccatctcttaggacttcagcgtgatgaaccgctgagctttgaaaaactgttctgccttcagttcctctcccccctccctcctgtcaaatgctttcctctctaaagtgtagatgatgggaaaggatgttgattggcacgcctctgtgaaccaacaccttcccttgacttagtccctctaccccacatagcttcactctgtattcttctgacacaccatacgtgggtttttgtaaagtgtcctatttagaggaaagaagattcgtaggaaatgaacacacatatgtactgctgtctttttttttctttctctctctttttcttttttcagcgctggcaaaccaaccagttctcagaaaggacagcaaaatgagagaattgttccctcaagttaaaaagttggagagccgtaaatgccaacgcacttttgaactatctataaatctgaaccaaagactttttaaagtttgttttctgagaaatggctcatactgtaatgtggggctggcctgcaactgatggcaatcctcctgcctcagcctctcaagtgctgggatcatagtggcgggccactccaactggagtgaaaaaccaaagggcgacgggggttggggggagaccgccataaataactcaatgaagtgagttctcactgacagttctcaagaccgtcatccctgagtctagataaaaagttccaggtccttccgtgtcaggcaaatctggaagttgggcttacgcacaccgctcggctctccttgcgacagcgccctcatccccggtgtttctcaagtagacgtcccgagacggtcgctgaggcactgtttccacgcgatcagggttcctcaggcttgacattcaaaagtgggtgcggaacccgcggcactcggagcgtgctttaaagcggccgccagccagcgccgctctaacctcgcgccccggctgccggcggctcccgccctgcatctgcgccgacgcgaccgagcgatcccggggcctccctgcgcccggaatctcccgccagccgcgcgggtccccacggcagcagcacgtggagcggccgcggagcctgagcgacagctgcagcccgcgcggcccgcggcgacatggaaggtgagctcggcgccgctgcgctgggggctttgagcagccggagcggcgcgcgctcagaggctcggctggcttccttctgaatctcggttttgcttctatttatttcttttaatttaaatgcgtgtccgttctcagacaccccctcccccaacttgggaaagtgctaagttctcttcagttttatttcttgggggttgtgagacgggggcatatgtatgggtcaccttaaatctgcaaaggacaaacagtcttgggtgtccctaagtttggcaccaaacctgggacggaataatctccccctcccccgggttgggggtgggggggacgctccgcggtctcagtctccataggaattagtttaatcttagttacttgagtctacttttctgtaatgtgacttttctgtgaatactgtcttagtggctaagggcatatttgaaaatgattagcaattgtagttagttagcttggaaatcaaatgaacttaaaaaaaaaaacaaaaaacaaaaccaaaggggggaaaaaacccgaaacaaaaataaggctcacgttaagggtttcatttgaattcatttcggaagttatagctttgcttctcagaagcctcgcagtatgaacttccttaagataagtgcaatttcacattttcaacaagtgtttctaaaactctgaagatggaagatgtggctcaactttgggggaggagaggtggccctgagaaaatcagaagttgagcgctgcattcgtttaaaggagagagatactgacgcttacctaattgaagtgttggtctgtaaatattatgaatatcacagttactttcttcatgatggttgaagaatctcttttaacacatgaaccttgatcttttggcatctttatttagttctagtgtatgtgaagctatgaaatatgattaacaagtttggaacacagttaaatatgataaagctttgtttcacaatgcaattgagtggaacacagcccttaattctcagcttgtgcatggtatgctggtaaatgtggcttcttcttcttcttctttttcttcttctttttcttcttcttcttcttcttcttcttcttcttcttcttcttcttcttcttctccttctccttctcctcctcctcctcctcctcctcctcctcctcctcctcttgnnnnnnnnnnnnnnnnnnnnnnnnnnnnnnnnnnnnnnnnnnnnnnnnnnnnnnnntcttttcttcttcttccctgctttgactaatgtaaacatatttttttctctcagtaaaatggcaagtggtaatgcaaagcttttaaatgtccgctgttgaatgatgcttcaaacattttctcgtgaaaaaaaaaaaaaaacctgtatacttctaatgttttagtgtcaaagtttaaaaaataacttcaaaattgttttgacacttaaataatgatctatgaaatgtaatattttacatgtaaaagtttcctcatccaagaacagaggggtgggggggttggcatggtgtatactataggaaactttattttaaaacgagctcccatgctttaattattacaaataatctcttttcctgaagttgctggccagttctccaataccatgtcctagttttaaccgtgtcgtttattaggaataatgtaaacccacaactggagtatttttgtgcaaatgctattagctgattagttattcaagatgcaatacagacactaagctaaatagcttactttaggacatgggtctacttaccaggctcttcagtaggacccataaagacttcctgaaggaaaagacaatgaaaacttgtatagttcagcatttgtagactatacgtgagacaagaatgtatagaatataggttaattatttaaagaagttatgagtgtggatggctagattaaatagatacaaagagatagatatcatatggtatatttaatacacaaattcagtctttaaataaaagcaaactaaaaaaggttaatatgtgagtttggtcattttaatgttaggtccttgaggttagaatagttgatgtagtaaaataactaaaaataatctagactaattagaataatctggctaattttgattgtttattgagacaatgcagggttagccttgaactcactatagcccaggctgaccttgagctcatggcaatcctcctgctttagcttcctgagtgatgagattataggactcacagcatcttgttgactcatgtttttgatatttaaaataagatactttgtactattttgatatttgctgttagagagatttgacttgtatcatagcgctctgtcttactgatataagaatgtatgtcataaaaatgtctgacttaaaaatgcattatatatatcttctcatgtcagatgcctttgtttctgcctaatatgccacagttattgtgaactgcaagagcacacagttattccttcattcctatcaccttttcacccatttatctttgcaatcatcaacagacttgggggggcattctctgtgtggagatgtcagatgaaataagcctttaaaatagagaccttaggctctatctataaggctgtatcttttcattaaaatgtaatctttcatgtaaaactgaagagcttaccaaattaaaactgatagcatttgtctccccacagtcagggacctggggtatttgtacccaaggctagggaccaccgatgctgcatggctctgtggcactacgtccgtccatactaccacaagcagcggttttatccggagtggctcagagaacaggcgattcacaaggctgactttcccatgggtttcttgcttgtcctaaagtcttcacgttaaccatatgcaaagattttttttaaggtgtatctcttttacataaattgtttattgtatttcatatgtattcatctttctcctgcatgtacgtatatgtaacacatgcctgtccggtgcccacagtgctcatggagggcagacgagggtgtagagtcccgtgggactggagttagaggttgtgtaccaccacgagcatgcttggaacagaactagagtctcctgtaatgacagctgtgttcttaactgctgaggtatctctcccatcccaaatgtgtatatattttgtacagcttcctgctttttaaacaaggtgcatatcaggacatgatctcagtgcttccgggtcatcctatagactacggggaacctgttctagctttcattcccatgggatatttacaacagcacagaactggatgcccctgcattaaatagttctttattatgctatcttttttttttaaaagatgttgacttctgttgtttagttcagtttgtggaatttatggtagtcattttctttttccagttttgagtccttttccgtgttctagatgtcagggattagcagagacttagcttctaggtggtgctttcttgcttcataatatgagtgtgtagaggtttaaaatatcaaagttgagcaaccacagccatagaagtgtcatgggttctggtaggatgtgatgttctttctataacttaatagtgtgtttcacacttccacgtctttcctaacaacctggccccccacccccaactactcaggtctcaaggctctgctcaagcatcatcaccaaggacactctactgataacctttgatgatgtctctctactgccttctggttctcacccctaaccagtgccacactcccctccagttttaccaaagccttctcctttctgtaggtacttctactatggtatatgaaaatggtgggttgctttatccttcctatgggcttcatgctttgctgttgttgaaagagggtctcatggtgtaacttaaactagcctcaaatacgtgatcctcctgcttcagcctcttggggtctgggattgcaggtggctaccacactccatgagcgactatttttaataacttatttgtttatttttgtgcttgtgggagtgttttgtgcatgtgtgtaaacctgtgtgtgcatgtatatggaggccagaggttggtggcaggtgtccccccccctccccccgtggctctccctcttatttttgaagcagggattctcagtggaccggaagctcactcatatcgttggagcagctgatcagaaggtcctgggaatcctctcgcctctgcttctacactacggggaatgctggcacacactgctacacatggcttcttatgcgtgtgctggggacccaagctcagatcctcttgtcatattctcattccttaagttttacttctgtttgcccagtgcctggtttgtagaaggctttcagagtttgttgtactcagcgaagaaagcagtgccaaaaatagcttttattatgttcatttaaattttctattacatttagctgtgtgtgtgtggggggtggggggggacacacacatgcccagcacactgtagaggtcatagtgtgggagttggttctctgctccaaccacgtagcagtgagttttgtggcaattacggctgtctgatattaagcccctggttctcagagctatgtaacttcctttgttacacatagcttcctaactccatcttggtactgtgggtgttaggttctagcagtcaaactttgagaagcacatgaaccaacagtttgcaagaagtatttgtctaaatcagttatgtgcagtagagtcaagggaaccagaggggagaaactattcacagctcgagcaaacctgcatttcataagctttgctcactcaaaaccccttacatctggtaaatttttatgtatgtatagataaaaaaaacaggtatacaaatcatacactgcatggtaataaatcgcaaataaatttattttaaagtaactactcatataattttatcatttcttaaggcaatcttaaacatttcatattaatgaaatggatatgattatttttacagaagaattaaatcttggtcaagtatttaatatggcaggacagagtattgtcaatattttctggacttgattgattttttttttaaaatagttgtcaatactgaaaacagtgcttcatataaacacatagaacaaaatggccaatgtgtttagggctatttcagaaattattgtctaatctcaagccaaaattcacttagtggttgaattcagcaactcaaacagcaattttataacttattttcattttatttttttatcaaatgtgtgtgtctatgtgtaggtgagtgtagtgcctgtggaggccagtagagggcatgagagccacgggagttggagttacaggaggttgtaaatcaccttatgtgggtgctgagaacggatgtgccctctgtgaaagcgctcttaattgctgaaccagacaaccctccaatagcaatttaaaaagccattcactctactccaatccaatccaaacatacaccaacttaccactgatatcgctgaagaacgatggtcagcaaatattaaaagtattttccctaattaaaccattatattcccataaaaggagaaaactgtacatagtttaaaaaacaaacaaacaacaacaacaaaagccaggtgcacacctttaatcccagcacttgggaggcagaggcaggcagatctttgtgaggccagcctggtctgcagagcaagttccaggacaagggtttcttgtcatagagtcctcccccaaatgaaacaaaccaaccccaccttgctgctgtagttcgagtattaaatagactctggcttggcccagggtgtttcagacaacgttgactggctgttgtggcttgacggtatacacaacgccaagtgtcatgcgctatgtttagaaccaaggctaccttgagattgcaaggtgggacacggctgagtcctgctacaaacaccgaggattcattatacttccattatgacttaatttgtggtcattgcattcagaactgttttgctgttgccaagttagggactcccacacaatcctgtgacccacagcttaaggcccatggtgtgaggtggctcttgctttgtgaatctttgcatcaggacaggggcattttatacagtcctaacaaacacacatctgcatgctactatttatgtatgtgagtgttttccctgcaagtatgtctgcaccacgtgtgtgactagtgcttgaaaaggccagaagagaatatcaaatgccccggaactagagttataggtggctgtgaactaccgtgatgatgatgggaattgaaccctggtcctctggaagaaaatacagggctcttgatctctttctgcagcacctcctcttctcctccctccctctcctctcctctccatcccatcttctctccttctttgagatagggtctcatgtattcgatgctggccttgagctgtctgtggccttgaacttcggatcctactgacttgtcaatggctcctcccccactctggccccccgaaattacaagtgtgcatcatcacaccaggtttacttggtcctgggacagaatccagggcttcatgcatactaggcaagcattctgccaaccagctccatcttcaggctgtttgatattattataagaatttctctgaataaatgagaatgtatgtgtgagtagatacaaggattaggataacattttagcattttcatacattctaaaaatgaagtcaggaagctgataagcaagaattcaaaaaaaatttttttttaaaatcaacccttcgaggctggagagatggcgcattgcttaagagtgctttttgttcctgaggggaccagagttccattcccagccacctgtagtcaagagtcaggggctccaacacccacttctgccccccactggtacctgcatgtatgtgcacccaagtgcatgggcacacatacaaataaaaagaaatctttttttttaaatcaatccttgcatttgaaaatgtagccagttgctttgtctctttgtaaattataatacatacaaaacataagacatgataatttgttgtgttatgatttatagatgtaatgatttaagtggaataaatcttacttctcaaatttgaattaaaagggccaggagcccagaagacacaatcaagtacacagtttctgagtatgccaagccaacagtatggcatgcacagctcactggaaggtaggaatttgtatttgtcaaaggacttcaccaatagctgttacaaacaccagtgacctaatatgtcctggttacctctaaataaagcagctaaacaacatatgatagaggtataaggaataaaattggacaaataataactgatatataattcatagaattttttgttgttgttgttttgttttggttttttttgagacagggtttctctgtgtagtcctggctgtcctggaactcactctatagaccaggctggcctcgaactcagaaatctgcctgcctctgcctcccgagtgctgggattaaaggcatgcgccaccactgcccggcttcatagaattcttatagtttcttttttgtgcttgttttgctttgacacaaggtctcatatccaggctgctttaaccctgctatgttgggcttaaactcctcatctttctgcttctgcccctaaaccattggacctacaggtgtgtgccgccatacctgcctttagatttttatgaggctttaggtcccctgaaattggagttacagaagtgggtgctgagaaccaaagacaggacccctgggggagcagcaaacactgttaactgctcctcagcccttcattgtttgaccaggctctcattgggtagctcaggttggcttgatttgatattcctgctccatctcctaagtgctgggattaaaggcatgtgcccaaggacctatggattgtatactgttagttcaccaagagttagcattagaggcaaaaatgagacacaacttgtgtttacttttcaatagaggctgatgaagcccagatgtgagtgcagtgtccagataagagatggagggagcaggagagccttgttaggcccagtttctctctggcagaggtcatcacccctggtggcccctgggaccctataggtcccagggggattactactgactcagggggaatactactgactcagaatgttacatgctttcccctcctactgctaaccttgtatctagactttccacccttaatctattttgaggatggctgcaggagtgattgacccacaacagaatgtcagtctcctacccagaacacttcacagtgtagcttcctggtgtctttccagtggtgttttctgtcttccaatattgcccttctgcgccgctggtgttcccagaacacacattttctttaactgcctatttttgtaatgtttctcttccaactcaccaagtccaaatatgaactcatctcccatctctctcaaacccagaccaactttccttggtttcccaacgctgttaagagccctgccacaggtgcagctcctcacccatccatcagggctcctctccatgctctctgtgaagaagccgctgctcattccagggttcgcttccataggtcaacgtctaaccacctgcaggctctcaccccattttatgtttatatacaaagtgtttttgcacggatagaacacactctgacttgtctaggattgtaagtaccacgatcatggagaggatgcttttcttgttcagttcacaaccaattctttcaccattattagcgtgcctgtatccttctgtatggaagtgtctgtcccttgtagaggcaactctacagatgcccctgttgtcttatgtctctgatttctagaataatggtgctggtgcatttacactttgaaatataggaaacttatctgtcagaaggcaataaaatcatgacaataaaaaagatatacaaatatttttttctgaaggagggtactaggtcttggtaggaatgattgacctaaaaggggagaaaacaactttcagatacatagtttattctatcatgagagaccatccagccacagagtaaagataatgtatatgaaatatatgaaatcagcgtacttaaaaaatagacacagaagccagagggtggcgcacacctttgatcccaacacttgggaggcagagacaggtggatctctgagttcaaggccagtctggtctacagagtgagtttcaggacagccagggctacacagaaaaatcctgtctcaaaaaagcccccccccccccgtgcacaaaaaaaaaaaaaggcccagactcagagccctgctaatgtttgggttggtccacaaatcctttacaaggcctcttcaaagccttgctgagagtcttggttgtatactgcctttagttattcttctgttgttgcagtaaaataccatgaccaaggcagcttataaaagagaggattttgtagtttccgagggttagagcccatggtggctgagtgaagtgacagcttgagagcgatagctcacgccttggtccattactctaagagaggtggggttttttaaaatcccaaagcccacctcagtgacacacctttcacaacagaggcacacctcctagtccttctcaaacagtcccataaactgaggcctaagtattcaaacgtgaacctatggcggccattcttgtccaaaccatctcatagaccaagagcatcctcatggagtgcatcactgggagttgttgtaagtgcagaagtgtggactagacagactgatccaggaccttcacccagatccctggaaaatcctgtgcacatgaaggtctgacacgcactgctcttgattagactaacatcggcaaaacctattactacttccctagcacgtgttgcgaccagtggagggtttattgctatacatagatttagcatgtcatttaaatgctgattttatcttatgttttgagtttatctattttttttaaatgtgcattgatgcttgcccacatgtctgtgtgagatatgtctgtgtgaaactgtcagatccgatgggactggagatacaaacagtgccaagtgggtactgggaattgaacctgagtcctctggaaaagtagtgagtgctcttttttttttttcccttttttttttttttttgagtgctcttaattgacacatttacttatttggaaaattcttactaagtcacccttgctattctggaactgtctgtgtagaccaggctggctctctcattcctcctgctcctgagtactgagattttgtgtatacaccaacatatttggcttcaataatcattgtgaaagttactcagggcacggaggctcatgcctatactccagtacttgagaatctaaagcaggagagttgccgtgagttcaaggacaacatagtgacaaaacaaaaaatcagcactaccaacaaaaagatgaaggatagaagcctttgtttgtttgtttgctttttgtttaggttgaacctagtccttctcacatgctaggtaagtgtgcactctgcttacattttattttgagacagagtcctactaagttgcgcaggttggacttgaactcattctgtctcctggacgggtcttgggtacctccaagtaacccgagtataatttcgagcggctggaattatagatctatttcactaggctagagaaagctttctttttttttttttccattttttattaggtatttcgctcatttacatttgcaatgctataccaaaagtcccccatagccacccaccccctctcccctacccacccactagagaaagctttctgatattttgttttgattagtcgtgtgagacagtgcttattatacactatgattcaaaactcagaactgaattcagtcttcattcaaaaattacttactgggagactagcaagacgcctcagcaggtaaaggtgcttgccatgcccagaaccccgtaaaggtggaagggagaggaccagttcttcaaagttgttctctgacccagacatacatgttgcagcatgagcacccccaatgtgtacacacactacaatgaagtttgttttaagacgagatctctctgtatagctctagctgtcctggaactcactgtgtagaccaggctggcccagaactcacagggatcctcctgcctctctatcttgcaaatctgggactaaaggcatgtgctgctatgcccagctagattccttaaaaactatgcattgaattcctcctacctgacatctatgcaaagtactggtttccagtgaagagggaagactgggctttggttcccatggatttagtcaggtaaggaaaaaagatctgaagaagagggagagacaatggaattaattagaattatgctaaatactatttaggaaataaaatgaaggagtcatacagaaaacagtggccgaggggctgggcactcgaagaagggcctggctaagataggagtgtggccatcctcagcacacccatcgtatttgaagccgggagaatgactggaatctcctgaagagagagttctgagagagggggactcaaagcaccaagaaatagttcatttggtcagcaacagaagtggggacagtagcaaaaatgctgccagcagatccttccccctggagactcagtagtgagataagagtgtggctgttacggttggacatgcaggagatgtactgcaatgaagatgggaggtaggctacatgtgaaaggggaggcttatttaatgcatagttttacatgtgtaaagttcaagactaggtaacaccattgatttagtcgctgttgcatgacataggtgatgttgcattatggtgggctatgtataggaacgagagggcttatctcaaacccagaagctgagatggaggggaggtggggggacaaggcgggcttctcttacagccctcttaatttactgtagacatgtcgtggaaaacaacagcaactgtctcttaagaactaccaagggggttgtggctttagagatggctcagccgtgaagagcgctcgctgctcttgcaaaagacccaggttcgcttcccagcatgatagctgacaaccatactgtaactccagtgcaagaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacacacacacacacacacacacacatccttctagatcaaaagatgggacagatggatgcctttaatctcagcactcaggaggcagaggcaggcaaatctcttgagtttcaggccagcctggtctacagagtaagttccaggatagctaagactatacagagaaaccctgtcacaaaacaaaacaaaacaaaacaaaacaaaacaaaacaaaacaaaacaaaacggtggactgtttatcataccaaaaacatttccttgcactgatctatagttacgttctccctctatgctcattaaacactgtttgggtttctaccatatagatgagggttatttgtgtttggattccattggaacagactcatgtaatacatgttttttctttgttcctggcttctttttctccatatattttgaagatctatatgtattatatttatagtacagcaacatcttttattattgcataatataaaatggaaatatacaacaacttattaatccatctttggtgatgtatatttgatacgtatatatatcttttctgggtaaataaactcatgcctctttgatatgttcctagacctaatatttctgggtaatacattgtgtgtttgtttagctttggcacaggccaccaaatgtttccaaagatgttggagccattctccctcttactgccaatgtcagagtcccacctgtctcacctctcagtgacactcactattgccagccatctttttacttttgagacattctggtgtgtgttttagtagctccttgtggttttcttttgcatttttcttttgagtaggatttttgggtattttaaaaaaatgtttattggttgctcagatatcttctttcctgaaattcatttgtttctggcttatctatttttaaattatacgtatgtatgtttgtatgtatggatgtatgcatggatggatggatggatggatgaatgtggagaggggtgcatgtcatgtcatagcatgtgtgtggaggtcagaggacagctttcaggagtcatttatctccttccactatgtgtgtcccagggatccaactctggtcctcagacttggtggcaagtgcctttacccactgagccagttcactgctcctctgaatttttaactcaacaagattgtgggctttttctttttctttttctttttctttttctttttctttttctttttctttttctttttctttttctttttcttttccttttccttttctttttccttttcttttttttctttgcctttttctactttcttctttttcttttctccttttccttcttctctctctctctctctctctctctctctctctctctctccctccctccctccctccctccctccctttctttctttttgataagggctcacataccttaggccgacttttcaaattgcttatgtagccaaggatgaccttgaactcttgatccttcctgcttccatctccaaacgcttgggttgtaggtacaagccactacacccgatttatggggtgctggagactgaacccatggccttgtgagagctcgcaagcactatactaatctagatctctagcccaagtctgtgattttttttttaatgtttagaagtgtgtaacttgtcagatgtaaatattttcttctcttctgtaactaacatactcctttatttgatgaggagaattcctatttcattccgtttttatatttatatgtttagtggcaacacataacatacaacataattcgtatctcacaactttattatttgttttagatagagtcttgctatgtagtcctggatggcctggaactctccgtgtaggctaggctgtcctggaacttatcgagatctgcctgtttttgcctcctgagtactgagatcacaggcatccagcaccacagccagcccggtctcatgtattcacacaggaaaagtttgagcatgcaagaaccttagagctctaatggagtccagtaggctaaaggtatgctcatcatttcctgtacaaatgtttaatgaaaaatagtagtgttaaatggagcactgtttcaaagatagtgtagctttcctttgagtttttttttcttttcttgagaccagatctcactgtttctcccaggctgaccttgaactggcaatgcagttgaggctgactgcgaactgttgatgcctctggctctatgtcccagatgctagtattacaggcacttgctaccatgctcagccagacatactttaagttatgctgtgacagtggaaccaggcattttacagttaggacacaaaagcctcagtttgaacacagtgggctcaatcatttaagcgagaatattttcctttaattggcatgacaggaaatgcccattctttccaatttttttcatattcatttggtggcatgtgacatccaagaaattagtaaaaacaaatggtaaactagaaatacataaatagtcatatttagggtaactgacttcacaggaaaaataacactggacaaccagcttgttattttattaataattgtctgcagttcttctggggcccgtagtgtagttctccattagatccttattttaggggaatattgaatactttttataaaagggcaggataaggcgaacagctaccgtggctgcaatctatctgtttttctttaaaaagatttcatatttcttaatcgtttgcccttagtcctgggactcagggaaggaagagtttcctgattggagggagtccctagctttttgatgtgttcttttcctttctcctctcgcctccatctgcagtaatgcacactcagccacctgagatgtttgaaagcattaggacctggaggtcactgctcagtgtggcctttgaaaattgtaacccacacagggagcattgaaaagcatggattaaggtccccctccccccaaaaaacagtgacactcactctgtggacagactggccttgaactcggagattcacctgtccctggctcccgagtgcaggggattagaggtgtgcaccaccacgcctggctcctgtgtctgaatcttgtctgtaaaatgggtacagctgtaaatgccattgctcccatacagcagtagtggcactgggtgaaaagaaccctcgctgtctgacttagctcaatgcttgagcctcctcacaccctttttatctgaaagatcaggtaccaacaaaaatggttccataagcaagcactcattgtggtcaggggactgagaggtagcacctgagtaatggcttacctgcatgaacccccaaaccgaaccaggaccttaagaccttaagtgggcattttagatgtttttaaggaagggcacaaacacacaaatgatgaagacctcagtgttgttggaaagagactgtaccgtgagagaatgttcaaggacatgcaagcaccaggtgacagggaggattgatgacctgctaaagacatcacctcatggttttttgctcttagggtcacttttcatcctctggtgacatatcaggaatgcctgtggtgttggctatgaggcctgtcagagggctttacagaaatgctagcctccataattacggtccaaagtattaattaaatttccaagatttatccagaaagcaaaagtggacattttagataagagaaactaatattttaaaaggggcttgggcataagagtgtcgttttaccatcgtgaggacaactaaaggctggcattgaggtattgcctgtgtggttgagggctgagcgcggctcgcattgagcactttaggacaagttctatctggtttgccattctgttctccttagcatccgcatcttctactaagtaaaccaagtgactggaaatctgatccctgaagaggagaattccctaagtgggtggtgactatttaatactcttaggcaatagaggcaagtgtatagccatctgagtaaaatctgctcacacattttggttgtaaattcgggtatttggcttttgttgtaagtaaagagttcaaagcttagatataaattctgatatcctagccagacctctgtcatttctaggtttaaaatttatttgtaatctatcacagtcgtgatataaatacagaaaaatgttggtatcttgaaaattctttaaaagatgaaaattcttgtgtgtcatctttggcagtgaaaagataatcaaaagggataaaaaaatggaagctgtcatcttcagggctgggtatacaggggtagagaatttgtttagcatatgtgagtcactgggttcaatccccaatcctaccaaaataaaatagaaggggaaacatgttatgaaattgtcatcttccataatgcaatggaggcctgtcttcagtactcatggaaagagacaactgaaattgctaatatagccataaatcactaacaagagtaaactgccgggagaagcaagaagagaaacatctttagtgttgttaccccgggggattcatccactgtctcaatcatagattagtgctgacctctgcaaagtttgctacttaggaggcaaatgttaagacgagaaaattacaatcagacctggagatggctcagtggaccagagttcgattcctagcacctactcggaatggctcacatcctcctagagctccaactccaggggctccaatacccttttttctggacgcctttgggcatctatgcctactaacctgggaaaaccttctctgtggtctagtataggctgtttgaatttctctgaagttactagtgctaaggcagtcgaaacctccctcttctttttagagctgcacccagttatctttgctgctgttgtacacacaagctatctgaaaagtgttgacaccaatttaaatgtcatcgccagggagcttaaaaggtcccgggaccaggactttttgcctttagaccaccaaaccaaacccaaagtgactttgttgcatgtaactaaaagatgttgccacaagacggttgctcgcaggcctttgaactgcctttcctttgttccctttaagaatcctcccagcacagttgaaagttttgcagccagcttccccctcagccccccttttacaattaaagaaaaaaatactatcaaactcacagaaaagttgcagtatagtgcaaaaagtactttttttttttcggaaaatgtgagcataagttgctgagttgatccgtatcacttttatcactttgagctctttaaagtgtaggtcctatctcaggcataaaaccacagtacagccagcgaaaccaggaaatgaacattggtaaattactaccaatttatcccctgccccatcagtgttctgattgtgtctgtaatactctttcccacgagaggatttagtccagagcactcgtggtccccgtcacatctctacttgcagtctagaacagtccctcttgctgtcacgactttggcacttcccaggattgtcagccagttactttgtaagctctctctcaagttaggttgatccctcatggcatgactcctgctctgtaagaattagggtgtccaccatagttgatcacgtgtgacttcacgtgtgacttcagggacatgaaatgtgactttgtgtcaaccaggctttgccactatatagctattctttcacttctatggttttaagcattgaaaagaagtactctggggacctggagagatggcttagctcttaagagcacctgttgctcttccagaggacctgagttcagttcttagcacatattaagtggcttctcatcacctataactccagctccgaggaatcagacaccctcttctggacacccctggcacccccgatcacacacatggaatccactaactcagacacatacacataaatcaaactaattcacaagtattttgaaactatataaatagtctatttatcttcagacttacttttttaactaattagatgatgtgtttattttatttcatttcattttattttattttattttattttattttattttattttattttattttatgtgcatgagtgttttgcctgcatgcatatatgtgcatcatgtgcatcatgtgcatgcctggtcttcacaggttcagaagaaggcattgaaccccattggacttaagttagaaatgggttatgaggcaccatgtgggtgctaggaactgaaaccaggtcctctgctagagtaacaagtgttctccggccccttcatcagattttcaacagcttatggtccagcactgtttatttcaatgctcactaatgccagttgggtagaggaaactctttagtgatgacttctgtgcccaaagacattctcttccttctatgatctctttcttgccttctggcatagaacaatgtttccaacccatcttgttctttccctgacatgagctgtttctccagggagcctggttcctttaagaggagaataatatttggatgttctgtcagaggctgggagctgtctgtgcttctctttccagatgatattggcaaagagggctgtatttgtttctgagtattcatgtcatacatttatatgtgtgttttatatttagtagtagtcatgggtttgtgtctatgccttcagttccaacacaaccagcttacatattcagtattaatacattccttttgaggctagaccccagacccttccatatgtaagccaagggctctagcactcatagacaagccagagtttccattaaatattattgagacctattttaaagggttttaaaggttcaagggaaacacagccttttgcattgcagccaccaaatcaaaggctatcttgctatatttaactaaaagatgttcattctatatgacagttgctcatgaaacctttgaactagctttgtgttcccctcccccccacgctgagaatcttcagtgtgcacgtgaaggtttcacagctgtcagagaatgaccttgaacccttgataccacccacccccacccgtgcctcccaagggctttggttctgatacctcatgccaaactgcgatttttttttaaatttttcaaattcatgtgtttcttatgccttcatattttgttgctagcatggaatggctgatatactgagctttcccaattagaatagaatgtatatagagtgattgtatctttcaaaccgaccgggaacataacctgattaccgtctatgctatgacatatgaaatcagtattgtcctgagcagttttgcataaaccattaccatgcaagtaaaagcagatctcaaaaattttcagctacacaggagctaccaaacccttattcccagagaaaacaacttacagattctatacatgtaattaaaaaaaaatctatcacctgaagacattagaaacagcctccgtcttaaacctctgaatgatgaaagcttgaatccagaatctacaaacttagttaaaaccacaacaataataacaacaacaatgaaaaaccatccgcaattagaaaaaatgggaagaactctgatatggaaaaagccaaaagggaagtatgaaatgtctggttgattctggaagagtgtgtgtgcatgtgtgtgggtctgtgtgtgcatatgtgcgtgcatatgtatgtgcttgtgcatgtttgcacgataccccatctgaagctgaactatgaaatttatgtttcctctgggtgaccagctcattcaggtatccttggaattataaaatctctatggtgctgttggtcattctggctgctgcttaccccaggtgaagagggagaaatagaacttgaacccagataagtcaactacatgttttataaactgaaaacaaccacaattaacccacccccattcctacatagttaagagaaatataagagaatgtaggatttctgcaacatagcatttataatgtccagaatacaatctaaaattgttgtgtcatacgaagaagcaagacaatgtattacttcctccagggaaagaaaaactattgatgactgggctcagatggtacagggatgttgggaagatattggggagaatctaatacaactgtgagtatttgaaagatgtaaaggaaaaaacacacgcaatgaattaacacatgggaaatgttggaaaagaagctataacaaaaataaaatttctagaattaaaatcttcaagaaactctatggatggacttaacagcaaattaagataatttaagagtgactgggatcttgtggtatgtccctgaggtcccaacactaagaaggcagaggcaggaggaggatgaattcaaggcttgtctaaaccacaaagcaaagcaagtttcaggccaacctgggctacatagtcacagtctgagaacaatatatatcattcactgtgagtgttagaggtgaaatcactaggatgagaaagagcagtgtcaagggaggtgtgggaaatttggaaatatctaacgtacttgtaatcgaagtcctagaagaaaaacagaacatcagagaggtatgtggagagctgccctcgagaacattttggtttgttgaaagccctcactttattgaagagttcaagtaggagaatgcaaataaaagtcctgtcgtggtcaatggctgtaagtcaaggtaaaggggggatattcaaagaagtactgaaaaaagaacagaagcaagaatataccaccgactcttcaccggaaactgtagaatccagaattcatgctgtctttaaggggatagaagaaggggggcggaggggtggggtgaaaaacctgcaaagctaagattccgtttttggtttggttttaggtttcactgagtagtgcaggcaggcctggaacttactatatactccaagcttctaactcagggcaatcctcctgctctgtttttgggagtactgagatgataggtgtgagctgctgtgcctggctcaatccagaaacatatattcacaacagggtctcacggtgttgacttggctggcctatagctcattatgtaggccaaactggccttgaatttagagagtttcctatcgctgactcccgagtgctgggattaaaggtggcatacctgcaatcagtgttctgtacctaatagtatttcttttaaaaatgttttagttatttttattttatgtgtatggatgttttgcctacatgagtgtgtgtgcaccacatatgtgtctggtgcctagggaagtcacgagagggcgttggatgtcctagaactggagtcatagatgattgtgagctgccatgtgggagctgggaattgaatacaggtcctctggaagagcacccagtgttcttaaccatggagccacctttccagaccccaaataaaatttaaccccgaaaataaagtaagggtgtagccaaatacatgaaagttacaagaaactgttcccatacttagagtagttgactactgttactgtattagccaaagctttaagctgtaggcgaatttctgttagacaagaaccagacattcatgaaaaaggaaataaaaagcacaagaaaggttaactgtgtgggtaaagctgaagtaaaatctcctctcgattactgtaaaataaaatgtgactatctacagcaaaatttaatggcattgtctggtgacgtttgtgatatatttagatataacacataacaaccagagtgtaaagggtgcagagcagaaaaaaagggttaaaatggctgccagccgctgtgagctggtgagctggtctaacttcgttaggaagccaactgtggaaaactgaagatgtgtgttccagcctctagaacaggcagaaacagacagacgaataatagcgtttggggaatttaagagtcttccttgagcagcttagacagccagctagctagaagtacagtctcagaaggcgtgaatggtactgtcagtcactttagtctcattgacattcaacagccagttcacccagtcacagagcaatgtgtttttccaacaacatatcacatcttcttcccaagaaaacaaaccttcataactataaaagcccagaaatttggggagattaattccagggcttggtgggcagaggcaggcagatttttgtgagttcaaggtcacctggtctacataacacactctaggccacctagagtctcaaaaacaaaaacaagctgggtggtagcagcccgtacctttaatcccagcacttgggaggtagaagcaggcaggtctctgtgagttcaaggccagtctggtctacagagagtttcaggacagccagggctacacagagaaatcctgtctcaaaaaacaaaacaaaacaaaacaaaacaaaacataaaagcaaaaataacaacaacaaaaacaaaaaccgaaacaaaacccatcctgaaataaataaagaaatggaccgaaatcataggctttttaaagactgtagtagagtagaattaaaagaatcttttttactttttgctttgtgtttccctttttgcaaaaaagggaattgaaccctggaccatgcacatggtctgccatggagttacatctcttgcccagaaatcaataaatgtgaaagagcagagagctcagattctgctaaatgtctacaaattaaacaaagtttaaataaagccaccaatggcctgaagaagtcccaaggagattgtaactaagttacagtgagggtaaagagtcaaattcctaagttggggcaagaataaacctcaggggacaatgtatagcctaggtattcacaattacagtgcaggaattaaagcagtttaccatagtttcgccttaataggctaaaaaaggaagggcaaattcaacccaaagtaagcgacagggagaagttctgatgggcagagaaaacgcagagaaaatgatctaaatcagaagttggttttttgaggagatgagtgtccctaacaaggaaaggctactgtagattatcaaaatggaaactgagacaagagtgcctgactgtagctcctgcaggaaaacaaagagatgtcagggtgggtgggggtgggggnnnnnnnnnnnnnnnnnnnntacgcaaaacctttgaaaagtaaaactcaccaaaacaaatgggataaaagtctgaattggcctgtatctgtttaaaatacgggattatctgtttaaatatgttacaataaacatttgagaggaaacatagtcagtttgacatgattttaaaaaaataataataataagagggaatgcaacaaaaacaacaaaagaaaagtataacaaagaaattttataaagtacaggcctaaaccatccagacataaactcacaaatccttaataagctggctagtggtggggtcctcagtacacaccacagtggttaacgtcataaccaggcagggatgtgtcccaggagtgtcagaaacataatctcaggaatttatctcaccgtgaagtcaatgaaatgcacacgggtgaggacgcagagcaacaggcagaacgcatattttgctgatggcacaaccgcttttgaacaagttctggcagtttctattaaaactaaacatatacctactccatgacccagtaactcgacacctgggtgtttactcaagaaatcggaaagccaatggctcctgaaaggcttttttttacacggatcgccataccacagtctactcatgagaaaaacaaacacctcccagctgagggacagcctctgaaatacctgactgtcactcaaaactgtcaaggtcacccgaagaaggaaagcctgagacactaactaaccaagaggaacctaagggacacggtaactaaactaatgccaaccagcactggacggaaaggaaggaaatctggattcttagtacaatgaatggatatctgaccgtgagttacagcagatgtcccacaggaacaataaggtattgattaagaggagaggttcgatgtggagaaagtgggagccttttgcacttgatttcataattttccaataaacttaagactatcttcaaactcaagctcactgttaaaaatttttaaagatctatttattttatgtgtatgagtgttttgcctgcatgtatgtgtttacacctgtgcctcctgccctcagagtgctgtagaggggacatcacatcctctggaactggccttgcaggcagttgtcagctgccgtgtgggtgctgggatctgaacccaggtcctctgcaagagcagaaatgctctcatctgctgagtaacctctccagccgcaagtctactttttacaaataataaaaaaaaagttttatttataataaggaaacctagaaacagctgggctttaatcccaggaggcaaaagtagatagatttctaggagttcaaggctagacatgtgtatgtagtgagttccaagcaggccagggttacatagtgagacataacaaacaaacaaacaaacaaataaacaaacaacagcagcaaaattagacatagtttaaatattcctcgacaggagagtaggtaagtggtggattcatatagtgcaatatcactttaaaaaacaaaactaatgagaatcaccactaaatgcatggattccaaaacattaagttaaaagaagccttagacaaaaggatttgcatcatctctctgtataattccgttttcacaaagttttagaataagctaaaactatagaaaagctacaatggaagctgttgttttctggaggcagcatgtgcgtgcgtgagtgtgtacactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcatcttggggtttttttttttgtttgtttgtttgtttgtttgtttcaagacaaggtttctctgtgtaacaatactggttgtcctggaacttgatttgtagaccaggctgcccttgaacccacagagatctgcctgcctctgcttcccaagcactgggatttaaagcatgtgtcagcactactcagctaagcttcattttcaatcagtggtcagcaaccatttcaggaaaaggttcaggaattcatgatataatctctttcctgggtcctttgctgtaggagttgtttttaataacctttgaaaatgttgaaagcatccttccccctggacctctacaaagcagggatgatcaggcgtggccttgggccacaggttgctgattcatgctccaggattaagcaggaggatcttgacgaattcaggtcagtgcaggctatagtgaagctagcctgggctacatagggagatcctgttttgttttgttttttaagtaccaagaaattaatgaacaaacaaccctgggttccattgtaggtttttttgttttttttttgtttttgtagaatcacacttatgatataaatacaatagaaaatagatttggcataaagaggtttctaggtttccttttaggaaagcatttcttccaaactgagctctatcagttatgttcaggctcagtgtctcttaaaccagcacattaatatttgttgggaatgtaccattctcctgaatattgtgagttacagcaatgaagacagaagtcctgtctagtggttctcaacccatggatcttgggccctttggggttgagtgacccgtccacagatatttacatgaagcagtaatgaaataattttatggttgggattaatcaccacaacatggggaactctactaaagggttgtggcattagggaggttgaggagcgctgctgtcgatgcagcatgagttcattataatgtaggtgtaggaagaactattcacaaggatgcagactggcagagggatgcatgcgcctcattcacagttctaggctttgagagcttccatatctgccgctgctgcggtgagtgaagtggacgctacttgtcagagccggatgctgaggctgggcactagatgaggaacactggctatcactgctgatgaccgtgaagtcaaactcagcacatggttttacaaacctcttcaagctgactgcatccttacaacctcctctgtcttccagagagcccagacgctctgaatgactacagcttgcccaaacctcatgagatagaaaacgtggacagtagagaagccccagccaatgaagacgaagatgcaggaggtaagccacgctccacatgtacatgcctcatggtgacagaaacagtggatgtggaatcaactcaaatttgtccgattcacgtatatttgcgtttaatagcttgttacatgagaacacggatattggggttgggggggaagatggctcagcagttaagcactcctgctgctctgccagggtcctaggttggctcccaccgcccatgtcaggtgactcgctataaccagtaactccaggtgaccttatggtgtctatgggcacttgtgctcactcggcatacagacacacacacacacacagtcacatgcattacaccaatattttgagaatttaagatacttattcattgttcacattatactaactttactatatgttggccggatttggtggcacacgtgtatgaccccagctcttatggagctgaggtaggacaagcatgacataagaccattctgggctatgtatccagaacaatgtattcagaccctgtctcaagcaacgcaaaatgaaatgcttgttttaccgtgtttcattataaaaataacaagtgtccgaagttgggggtatctcccaacagccagttctccagacgtaactgattagacagcaattcaattatttttaaatttttatttatttttattggaggtagaagtgtctgtgaaggtcagaagacaccccatgggagtcacttcgctcgcgatcaaactcagggtgtcagcctttattttcatatttcctgtattcttgctgctctggcattgagggatcttatgaacccagggggagactataatgctcttgatggggagtttgtttttgtttttttggggttttcatgctcaaaccaactactcccgagtctacaccaacaattacatccttatttccagctcctacaccaagtcttaaatcaacttaaggcctcttactggacagccagaaaccaatcctctgccccaacaagagcattctaagtaacctcccctaaacttctggctccgccttgcctttctcacagaaactccaggaaagagttttacacgtcatcttaacaccaatggtgcgttcttcatggcaccataataaaggaaactatcttcttccttccaatcctccttttcatgtctctgtacattctcacatgcatgcttaactttggcatttcctgtggcctggttctgggcctattcagcaggtggctatccagccaaccataaagccagccctgcatggcttgaatgggaggtatagctgctgttctatctggacgatccccttggcttatgagaggagttaggtaggtgactgcaagttaaacagtggctcatcccatcttccaggctggtagtttcctcaggaatagtccgtgattggggatcctgaatcagcccacgcatgcctgactattggcagcaggaagagtcagtgctagagggctttgctcagggtagagtgtgtacttatcacactcaaggtcctgggttccattgccagctagaaagaaaaagaaaaatgaagggttaaaataccacccctaaataagctcacagttcattctagtaagggttcatcaggaggttgaccataaaggcttacaaaataacgtcactccgcccacactctacccctggcttcatttcttggttgtaccctcccatacctggatctctctctctctctctcttggcaccccaagtgtgtgtgcatgcatgcatgtgtgtggaaacactgcagaagcacacgggtgagtgggggttagcggttaagatggagtgtcttgactgattgctccccactttctatgttgaggcaggctctcccactgaacccagagcttgacgcttgtctagtctagctagtcagtttgccggggagatcccctgtctctgcccctgatgcaggggtcacagttgagctaccacacctgcctggtttttacatggctgctggggatttgaactctgatcctctgcttgtgtagcaggtgcttaagccgtggatctgtctctgtagcccttgtccagacacaggcggcatcttgttcctgcgtgatttcttttccctttagagacacagcatggaatctaatatccaaagctcaggtcagatgtaatctgagcttggtctggcttcaagacttgatccaatgcgttctttgcctataatttaactattacaatagcagccaaagggttaaacatcttactcctcatcttagctgcatccttggacatcccagtgccttgggagttggccattggtaacttttgcctttagtagctgattggaacactgtcgttgtggccccacaccctgagtaacaatacagccacccaggaatcaaaggttcagtactcccccccccacccttttttttccttttctgtaagccacagctgagctgtcaagtcctgcttcggacaccagttctgaggtgttttccacactgacaaccaaaggcagagctttagttgttgagtgtctgtttagttctggcgttaattcccaggattgggacgggcacagtgggttaaggcttccatcttataagggagccccctgcttcagacatcagccacagtacagagcccggtgcagcttggacaaacacacagacatcgctttacttactgttaatgctttattataaatcattcgactcagaagcagtcaaatggaagggagcacaggccagggcttgggaggaagcaggtagaactctcatgccttctccaggcatgtcccccgttcccaacagcacctccgtgtgttccccagcatggagcctctcaagttcactgtccaagattttatttggatctccagcccttcatgttctttcccagagatcagtgggtgagcctggggtcccaacctaagtcacctcattagcataaactcatgaatagtgaaagggttttgttgtgaatcacaacatctcatgatcacgaagaaaccacacgagttttaggagttgtgtgcctagaagaaagaaccggaacaaagaccaaatacatctttgcaatgtactttagtctgtaaggttcatagaagaggaaagcaagaagaaaaaaatttcaaagcaaaacaaaacaaaaaagaccaaaagcaggaaggaaaaaaaatctgtattccactattcaaacattctagactgaactttggggcttttgttggtgtgtgcactgaatttcagcacggagtgcttgtttgcaatgctcttatgtcatgcagataaatgatggtgacaagtctcatccactgctgccttgcgaatgtcactgggatctcatctaaaatatcatttctttagaggtttccctgacaacctggtcaacactttaactgcattttattctgcagtgctagcctagcaacagataactctcctcctgtatccgttaactgtcattctccttcccctctttcttgactggcatctaggacatcttttttactagtaggtacctcacccatagtagatgtgcaataaatgtttgttgtatgactaaaagaaagccctgggttaattgcgtgtgttcctacatatttctccgaagaaaagtgttttcttctcagactctctcttttgcccgatcactcatgaccaagaaattgagttccttgtctaaaatttctgagattcaaatcacagctttagcgcatattcctgatctgccgagctatacattaattcgtgccagtttttaaccacagagtcagcaaatactgctgcgcaggatgtggtcgtgtgtgctgaggaaaggcgcatggtggctctgattcggcagcttctcgatggggacatccatcgggttacattcaggatgaggcaaagctgtgtccacacttttctaggttagggcttctgagttctggtagtcaccacagtaagtttttatttgggacgacagcaacctctacacagcggttggtctgggaaccgataatccatgttgggatatctgcagggttttgaataacctcagagttagtactccaacataaacatggaaacagatagttctcatgcaacaataagaatttaaaatactcatatggcagaggcaggagaatctctgtgagtttgaagctaacttgggttaatagaaagttccaggctagccttggatatatagagactttgtctcaaaatattaaaaaaaaaataaaaattaaaccgacccgtttaaattctgtaaacgttcaactttccaagttggtggcgtcaggaagtgtcatgcagttcttggtagcaatttgaggtcgtgatctgttactctaagcaacttgggaatcaggaagaagcagggtaacacgctcctttaaaattgtcttagaaagaaattaatagaataacaccggtgttgaaagattattctgtgatcgtgattaactttcaaactgactcagacactataaatgtcaaaagtgtgagtaatttgcctttgaaaagggtagttagcagggcacactgctttaagaaagaccatcagcgtgttcggattatacgtgccaaacaataagacttacaaaactggagaggaacgttagctgggcattgtggcataggcctgtgacccagactttaggaggcacaggcaggaggatcaaggccagcctggaccatatgataatcaaactcattgtcaccatcatcatcatcatcaaacaacaaaacagtgcatggcagtccaatgttgaagccagagttaggattatatttataaattttaagtaggaagatgtagctatgatgtagtaagaattatagaaaacattcggagaatcctgtatatttaaattcgatgggaacattcttttaagtgtccttagaaaggttgtagaagctaagacctacccggagtgtgttgaattcggactaattataattgtatttataaatgtattttcactaaaaagagggggaagaaaaaattaaaaagaggagagtagcacaggcctatagtctcaccacttaggaggcagaagcgggagaatcgggagttcaaggccagccttgacaacaaaataagtttgaggcctctatgaactatgtcataagaccctttctcaacaaaacaaaacaaaacaaaacaaaacaaaacaaaacaacaaaacaatcataaacattaagtgaaaaggttgagtcgggtttataagctctaaggtctcagcccagggcttctcttggccctatcactttgggctcgtgacaagataatcatggcagggagtccagtggaacaaagctgttcacttcatggttggcaagagacaaaaagacggagaggaaggagctaggaccccactaaaccttcaaggactcctcgcacttcctccagtgaggccccgccccccgcccagtgaggatgtccaggccaacagctcagcaaggaagattctagcgccagctctctggggccaggagcctgttttggctccaaaggctaacagtggctggatagggactgcaaaaattagggacccagtaagacaggaaacgcaggacactggtggcctaactcagcgtccctaaaatttcaaagatcgtgccagcctaacaagcgtgctcatggcaaactccttctgcttcctatgtggaaagtggagatgatgagaatccagtttcgggtgaagaacgaaaggaagaaccggggcttccacctcgttgggagggtgctccgtagcttcatggtgtctacccgaggtatccctgggcacgctgaagtcaaacgtgggccggttctaaccctggttttcagagacttttattgttttggggagtcaggttttttttttcccctttgccatgcagatcttgggattgaactcaggtcctcagacttggtagcaagcaccgttgcctgctgagccatctctctggccctcaatatatctatttaggtcttgcctggttccaagaggaaagttgaacttgatactttgttgaaaggccttaaatattttctatggtggcacccgagggatagtttaagataaagatgggaacttggaaagtttgctaggaaaaaaaaaattgtttcttcctcagaaaacatagctccatgccttggtagctttccacagcacggctcctgtttggagtgggaggaggactggaaaaaggagctccgacgcggactgtagttaaggccaacctgtagctcactccgtaacaaaagttagccttctactgtggctcaggctcctgttcccaagtgctaagattgcaggcccacggcacaggcatctgacaccagtggcgaagccttgagcctttctgatgtctgtgatcatcttgtgcttataagaaacattaacacaagctactctgatgcccccgaagggaggaaaaacaagccacctttgcgacttatggatgctaatgatgctgtatgttgtgtgtgggaggggtgcttggagcagctgggagagaccaattcagcttcacctctgttcaccaaagctcagcgagcagtatcgctccgtgcacgcaaatacctgccctgaaaggaagtgccacgtcttatcaatatattacatctcttgagcccagagcacacccccctgctcatgggatgcaggagttatctcacaacatcagcagtgtgcccctgcagaaatctacttcttctgtatgcattgtgatgggcaggctcacagcttccccagtgtcaaattgtggttgtgttagtgataaaaccaagatgtctctccttgaatcttcttgacaaaaacaaaggcatctctgggctctctctctctctctccctctccctctccctctccctctccctctccctctccatccctccttccttccctcccccccctctctctcttgccaacccatgaagcacagttaagttaaaggaatgctatctgcagaagaatagacagttgaaagggttaaaagaatagacatccacctgctctttctgggggctctttggggagattgccacctcttttcaccatggtctctgtggtatgacggtattggcatctcttcttaggctgatggacacatgacacccacaggagcatgcatgtcacagcagctgctcctgccaagtgaattctgggctcagataaagtttggcattagctagggaaactggcccatgatggctctccgtgcagtttgctaccatgtgagaaaaccctgctgagggacagagggatcccggcggtgtgccagagccagcgtgtaagtcacttgtgaaatcttcaggaattttgtgagctggcaggctttgcattggtagcttgaaactggctgtggtggagtatttatagcacggaaatcaacaagcctttccccaacccatggtaaccattcagcgtcaccagctcactgctagactaggagctgaacacgctcttacctggctctcacgctgtgtgtgcacgtgggagcagggtggcggctgttatttctaattattgcaaaggacaatgatgtgagagataagatctctccactaacatagcaaataggatgtagaacttatagagtatagaggtctcattatcatggaagtaatgaatatagtcagtgttgtgtgtactgtcacaaaaggtatacagcaagaacagagacattccacctgggcacagttggcatgagatgcgtgtcacattaaaatccctaaagtctcacatagcagctactccttacccacttccatgagataaaggccaatcactaccatgttatagctccattttgactatctatactgttttatggtaggggtctactgcaggttattgtgccctaaagaattttcctcctcttcctccccctcctcctcttcctcttcctcctcttcttcaaaagcaaggtcccagtctatcttagaactcattatgttatccaggctgacctcgaacttagaatgatcctcctgcctcagcctcccaagggctggaactatagacacatcccatgaacctatttgtattttttaatatcagagttctgggtagacagtaaatgtctgtgtttgttactttcattttttgcctttccatccatccacctatccattcatccatccaccttctcatctatctatccatcatccatccatccatccatccatccatccatccatccatcaatccattcatccatcaatccatccatctatccatccatccatccatccatccatccatccatctatccatccatccatctatgcatccacccactcatccatccatccatccatccatccatccacccactcatccatccatccactcatccatccatccatccatccatccatccatccatccatccatcaatccattcatccatcaatccatccatctatctatccatccatccatccatccatccatccatccatccatccatccatcaatccatccatctatccatccatccatctatccatccacccactcatccatccatccatccatccatccatccatccatccacctgttcattcatcccagcactgtggacaagtgctcactagacaattgttgttttatcaagtgatgagcaggtaaagacatcttggcgatatgttttgggggttgggaggagtgagcttcagccttgagccatctctccagcctgacaacatgatctttgttagcaacgaccttcaaaccttggtgggtggggatgattttaagataatttctaggttcttgacttcagtgtgttcttttcctgaaactggtcttacaaaggttgatattctccttttcaaacaaacctattccaactcattaaagaaaggttcatcttttaccatcattaaggtgacaactttcagtgtgactatctaactatctttttggatagttagataattttgttgaccaaaattccacaaattatatccactctgcttttctcagaaacgttgcctgaacatgtctgcagtaccaacattcaagaggcaaacacagggcagtgtgagttttaggctagccttggctacatagcaagttttagcccagcctgaagaacagaaaaatcaatttcttaatagagagagattactaattattaccatttttatacttaataattacttaataataactatagctatattatttaatcaatttcatgctaattattgtcataataatttgatggaggaaagcattgagcatacctacaatgcttatactactatttataatctgttgaagcagaccgatcactgtgagttaaggccagcttgggctacctagtgagttccgggacagtcaggattaaatagagagaccctgcctcaaaaacaataaaaaaatacaatacaaaatttgatacatacgagtttttttttaacatgtggcacctcattgcaacaaaaagtaagtgaaaaattatttttcttgtgtaattttaatgaggaaacatataccaagatgtttatagtgtgtaggtacagagcaatagaagttatggctcttgtttgttttgttgttgttgttgttgtttgattttttgagacagggtttctctgtatagccctggctctcctggaactcactctgtagaccagactggcctcgaactcagagatctacctgcctctgcctcccaagtgctaggattaaaggcgtgcgccaccactgcctgcctaggctacagctcttaaaagcagaacactgggatgagattttattgggaaagaaaactggaaatagaggttacgggaatatatatatgagacaaggtttctctgtgtagttctgcctgctttagagcttgctctgtagctcaggctggcctccaactcagagatcttcctgcctctgcctcccaagtgctggaattaaaggtgtacgcctctgtcacccagcttcctataaaatttttaaaagctcatttatatgattgttaatttatgatgggataaatctcatgactaatactgctgttcactggatgccttttcacatctatcaattcatttattatgtgtggtcagaaagtaacttgccaaagctgactctctttccaccatgtgggctccgaggattgaactcagatcatcaaccttggtggcaagcccctttacccactgagccatctcaccagccaggataactttttaaaaagatgtggtcacagctctatctgtagccaatgggacacatgcacccctgaatagctctggatgtggtccatcacagaatctttaagtctacttaagaaacagacattttgcaatttatttttttctgtagcccagttccgtgattctcaaaagtaaactttgtaagtgacaaaattgatgtatgcagaacctccagtatctaagacagaaatgtttctggttctgtttaagagttttaagagtaaactatgatgaaaaattgtaaatgttaacctagcaccctcttaatgtctcagtgtgtaaggtgaaaacatattatttccaatttcttttaagggtacttgtgaaaaactttgaatgccaaaccactgtttgttcaaagcacagtgtagagatagctttcatttaagcctgagctgatttaaagatatagggcagcatctgcagccttacacctcggggtttgggaaagatctctcagtagcaaggcacgtttcatgctgataggcatgtatatgttttatacgttttatacatgcctatcagagcagaaacgattaacaagatctgaccgaagtatataaagtcttagggctcacttttaaaaatcacttcttgtgtgcgcgcgcgcgcgtgcgtgtgcgctcgtgcctaagtgtatatgtgtgaagatgcccagggacaccagaacagggatctcctggaacgagggcttcaggcagttgtgagatcctggtgtgggtgctgacgactgaaccctggtcctctgggaaagcagagaatgttcttacttattgaaccatctctgcagggctcttgtcttcaatgtttctttaaatgattattttcatgttgtagttccaacgtaaacaatcttgttttctgcttagatagagaaaaatatatgctaattgtaaaaatcnnnnnnnnnnnnnnnnnnnntcccttccttccttccttcctcccttccttcctttttacccgcctcagtgttgggaattgaacccagggtccttgctcaggtttggtaggcatttgacccctgagcaacattcctttctcttctgcagtccccaaacttaccccaggaccatcttttatttttatctcttgctgatcaagactgctcatttttcttggttttgatggaggaatgttttgagtgctttatccatacaaaaaggatggacgggaattaagaaaacatttttttaagaggatagtcagcctccctggactctctggtcaggtggtcttttttagcatttaactgatggcccagcaacaggttgacagaggattccagttcagagttagcaaaattacatttagaagtgatggtctaatttctacggctttggattttcaaatgtctctatgcagcagaatgaatatagatgtcagagccaggcctgaaggaggaccctggtaatccagcccttggtgaataaccttcaaacatcaataaacaagattaactgggtttaacatgtgacctttctcgttttgactggtaagcacagatgttttctcatttagctgcctagttgaaatctccccttgctgcctgcagttggagctagatttgaggtctcaggaatgacagtcttgaaaactatacccctcagccagtgacactgtctaaacagtaacatatggacacccgtggtttaataattaaaaataatgtgtgaccttacccataataaatttgttaattatgtcaactgaagtagtaaaaaatgggatcatgatagatatttcgctatttttgttggtctggtggcattaaagacagtgacaagatttgttagagccagcctttctgcacctgcgcccgcggaggcagaaatcccagccaagtctttgttaccctttggtattcctcaaggaagtgcagagaaaatacgagaggctttgattagcttctcctaagtcattctaggcttgtggccatacttcctacccatcaaactatagagacaactgtgtggtcctttagtgcccctttattgcttgaatcccagaaccatctctggcatttttatgtgacctgttacttacccggtcagcttgctcttcaggtccttcaggctacactcgcttcctttctgaggtcttgcagaaaaagtaactctagtttcttctcttgtcttacgagagcactaaagccatcatccctggatgcgtgtgaacacctccccatgtccttctgctgcctcggatgcaagggctataaccattaattaattaatagatttctttttaaattcatttatttatttgttatttactattgtgggagaaagcatgctgcatcgtgtgtggaggtcgagccggttcctcacgatggattcaggtcgccaggtgtgtgcagaagcaccgttattgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactctgaactccatctctatagtgtcaccacttctgggactttcatgcaaatggaataatacaaattatagtcttttacttctgcctcccttttttcaagatgttttggaagttcatctgtggtgttataagtaccactggtttgcttcttttttaatttagtattttatcttaatcaagctagccttgagcttgtgacctgcctgtctcggactcctgagtgttgggattaaagccgtgtgccatccttcctggcttcgttctgctttgtttgatatctgagtaggattccattgttgacataaaccagtttgcacagttcacaagtggataagcataatgtcacaacaaacattattatataggtcttatgtgagtatgtgctttcgtttcaagtgggcatttaagagtggaattccagggttgtttggtctatttatgtttaattttttttaatttttttagggaactgcctattttgggtaccaaatgatgggtaagaaatgaccacaaccctgaaccatttggagacaatgcaaatgggttgtctcagaagcaccactgggttctctgtctcataggctctcccaagattctgatggagacactgacctgaactgctgtctcctctgaaaacttgacaagagaagagacaacccaaaactcactaatggccatggtcaggagtcagtcttaacagttgtcagaccaaaggcctcattttttctccccgctggagcttggccaggcactggctctaattccctgccccttgagctatccagctcacctaccggagaatcacaaagcatcaggatgggagagaaagcaagatccaagtcaccatcttatataacctaagcacagaaatgacgcctcttctgccaactgggaggcatttgggaggctgcttgccacaaatgctaattggttttccaaatggccacaccatttcccatccccaccacccatacacatgaggattgtgttttcctcgtgtccttgtgtgtcttttttaacttaatctttccagagggtgtgaagaggcatcttgtagttttatctgcatttctctaacaaacaatgataactattaccattagcccactgttcatttgtacaatctatcaagtgggatatcaatgcagacttcctatgtgcttttaaaaatctgttatgatagtgctagcaactgaatctaaggtcttgtatatgccaggctaacactctattacttgagttatatttcattttttaaaagatttatttatttattctatgttgtagctgtcttcagacacaccagatcccattacagatggttgagagccaccatgtggttgctgggatttgaactcaggacctctggaagagcagtcattgctcttaactgatgagccatctctccagcccttgagttgtatttctatccacttgtgtgcctacaactgagcttttagtcttattattgaattatgagacacttcttgtttatgaatcaggattttagtatcatatctaagaaatctttgtctaaatcaaagtcatgaatataccacatgttaaccattacacttggactgtgcgatatcatgatgaatttcattactgtaaaaaccccatgaggtatagattttatcgctgcacaaatgagaaaattcacagaagtcagattttcattaaagccctgggctggttagtgtgaggcattggattgtagtttcagttggaaaaaaatagttagattccatattgtcattgtcctgtggctgtcagtccctgctttattctttgattatgaatggtcgacagtctctattagggatcgctaggaatttccatacaacacagagagagaagctgtgggctcaggtccttggccagcttctgctctggtttccttctgttggacagcattccctccacagtctctggtagagctgagatgtctctttgcttgcagccctctggtgtgtgactggacagctgttaagcagttgtgctccctgctccagggatgagcacgttccagtgacaagatagcatattccctggtgcgctttcatggtgcatattcacctagaagacagcggagcccctcccgcttacttatgctctcgtctcattatttgaatgtcaggaaggaaagaatgaacagaaaggagggctgaaagttcaagtgatacgttacagatggtcaactttatactctttctttacacatgttttatttcaattaatttaatattaaatgcaaaagactctcttagatttccatctctgcgcttttcccccactccccactcccacccccacccccgatagttcctcgtatgctttgggtctgattgctgcaccttcacttagaacaattgattggttttcctctctgctaatgtgctcgctttaggcaaagctacaatctgtgcaatttttaaaaacaccatcaaccctaattttgtacttggggcaaagcgcggaacgatcgttcatcttcttcccctctcacctcctttccttgctccttccattggcttggtgagcagtcccagacccgagccaagcccagcagtcaccgttgaaggtgcaaggagagcaatctgccgctattggaagcgaaacacgatgtgcacacccattgtgccagcactccggagactgggcaggacagccatgagttccaggacagcctgagctacgaggcaaaaccctgtcaaggcttgggggtggatgtatcagagttcagttagaggacagcttgtcccacacaaacaaaactgcaggttggtcgccctctccccggcattgcattgactgaataaggtgtcacactcctagaatccgcacactgaagaagtagaagcagaaggattagaaactcaaggtcaccctgaccacatagtccaaagctcgtctgggatggatggatttagaagtgggaagctattgtggtagtttgtggatcgtgaagcaagtgtagaaaaccaggaagtgactacccgtgtccctgggctcagcagggagatatagtcaggcagttaggagagaatataaaagaaaaatggaaaaactttgaaaaaagcagagcccttcccgccttggcctggttgttatcaatgaattggttcaggctacatgagcaattcattcattcattcattcattcattcatttcctagagtaactaagtctgcaggttctggaacagccttgaaacgattcctagtccataagggaataaatgtgttatctgtcccacaacacactacatacaccagcagctacatgtgctgtaaccatggaagacatttcggttcacctgtgaccctgagtttgatattgtgataatcagaaggtttttagccaatttgattatatttgaattaacagcctttgaattttcctaagaattatattttaacatatgctatgtagatgtagatgttcatacatgtctacatgtatatttgtttgggatggtatatatctgtgtcagatgccttcctctgttgctctccaccatattttgtaagacagggtctcttactgggacctggtgcaaactaattaatcaagattggctagcctctgagctcctctgagctccagggatcctcttccctctaccaccccagtgctaggactaaaggtaccagcacatcgccctttccactgggatgttggtggtcccaacttagccctcaggcctgtgcagtaagcattttaccagcagaaccatctccctagcctctaagtaaatgcgagagcaagcaagagagagagagagagagagagagagagagagagagaaagagagagaggaaggaaggaaggaaggaaggaaggaaggaaggaaggaaggaaggaaggaaggaaggaaggaaggaaggaaggaaggaaggaagggaaaaagagaaaaagttggaagccaagcatggcaaatacactcctataattctggcacttggaaaatggaggcaagacaaccaggacttcaaagctagcctggcctatgtgagaaaaaaaaaaaaaacagtcaattccagcactcaggaggcagaagcaggtagagctctgtgagtttgagactagcctgggctatgtagtgaattctgagacagccagagctacagagtgagatcctgtctcaaaaaaagagggatagatcccctggaattggaaggttggctggttgagagtcaccaggtaggcgctggggattgaacctgggtcctctccaagagcaacaagtgctctaatcatggagccatcttgtccagcctgtattttcattcatttttcaggcatagcaattactgctcagaattacaaattctagataaaatatagattcaaacaatagataaaagaaatctctgtagagttctttattgtattattttatgtatatgactgctttgcctgtatgaatatgcaccattttcgtgcctggtgccctcagaggccagaaaggggcattgggtcccctggaacttaagttacagaaagttgtgaaccatgacatgggtgctgggaagcgaacccaggtgctctgtaaaagcaacaggagctcttaagggctgagccagatgaagatggtctttggaatgggcggaactaaacgatgctttagacttacagtgctatgtggttcgggagaagccttcatgcgctggttggttcttcaggattttcggggtttttttcaatgaagggccatgcctggttccatgacatttaaaaagcttcgctaagtcaggttgctgaaacctcacctatccctgggtgcagagtattcctgatgttggatgtagccaatcttatctaaatggaaagccaagaaatgtactgaaatgattgaacaaagtcattgttgctattatctgaatgaactgtgtggacagtcaacgaccaaggcacagactggtgtccttggttaaactggcggggcgagggtgtctcttttgtaactgttaactttgggggagtgcgctaattctcttgcaatcgaagtgacatggtttacccagtatgtgtgtaaatacttgacagagaaaattgaaaggtggaggaggacttgttttcatgagcaccttaacccaagcctgcttgctcgctcttccgcgtgcttgagatgggaacatctcatcccttcgtagatcgggtcgcctttcccgtttttttgatcttaaaatagacacttcaaaaaataacaacggcccatcatcttatctttaaaggccagagaagagaaaccgtaacaggtcctgccaatcattgatcagaagtttaatatgcattgagactttagagttttagtaaacacccaaaaccctccatattccttagttctcaaaacatcagagtttctcttttctcttgaatgccttcatacataaaatggtgaaccaggaaaaggaaaaagacgatcatttcagtgttttcattcttgatacaaagaggacatcccgggaaagatgtacagacatcacgtttatgagggatctagtggttctagttacctgtgtgtgtggacactgtgtgagtgtgtggacactgtgtgtgtgtgtgtgtgtggacactatgtgactatgtttgtagacactgtgtgtgtgtgtgtgtgtgtgtgtgtgtgtgtgtggacactgtgtgtgtgtgtgtgtgtggacactgtgtgtgtatggacaagacacctacggaacctgcgtctcccggtttgcttttcctccatcaggcttctaaatcctattaacagctgtcaaaacctggtaaactatttaggtgctttcacaatttgtttaattggatagttaggaaatggcatgctagaaaatccccccgcctttcttttagcctggctgaacatctgtagcattagggcctcattatctctgaattggcatagcaagtcggcgcatcattaaaatgccacattaagatgattaagcgtctttgttatccagttgacttttgcatgtgctgagggtttcatggttacgaccctccatccttgtaaaacacttgaacaacatcatcccgttttttgtcttccccggtctaacagcctctatgttgttttgtcccttctggccacatcgctggcaaactgacggccattctttcacccctggccttcctgttggactttgagatctcgtgtttcagagtggaaattcagcacctcctattaatactcggatgttccttcaagcaacgcgccacccgaggaacccaagttgcctgttctgtgtgtctttgatggggtctgctctccaggcgagcattttatgtgcctgtaaaaacaaacggaggcacagttggctgaggctgctatggcccctgaaggacttagggtctggatcctttccaggacccattgtttttgcagtgtctcaggtgaaaccaaaaatgtctactccaggagctcgagcctttcaagtgataagcatcaccccaggaagtgaaaccatgtgcgtctgccccagtgagccaaacctttgttctcctcagcctacaaaattctctctagggggtgtgtgtgttagtgtgctccatcctcctaagcggcctcctgaacacagacagcgatgggaacaatggtcccccagagcagctccttcagaaagtttagtttaatctaatttcctatgggttagattcaattcaaacatcttttcctccctctggggatgtagagcaattacttttatcagcaatttgtggtttgctatgttctcttctccccaagttcaattacatgaaatttacttaggaagcctttaatattttttttattatgaaatagatcatacacacaaaaaggcagattataattaaacttacagtttaaagaacactaataaagtgagcatcgagagacccatcacccgacttaagaaataaatcttactagtgcctaagcggcttctcggtgctgtttgaagagtcaattcagattgtctgagaaacctgatctaattataataaggttagaatttacaaaaccaagtgcgagattgcccacattgcaaacagttcattcactttacaaaagacttcagactttggttgggaacgtaactcagtatgtaaagcacctcttgcctaagtgtaccaagccctcaatccctagcacccacagggttggctctccagtacctacgtgcacacctggtacggtagcgcttgcctttacgccttcctcacatgatagaggcccttctccctaattagtagatcaaggtgagactccaaaaatatccaggttttattttattttatgaaatagggaggtgaggggcagacaggctatagtgtgtcatgtgagctcagaggacaatttgtaagggtcagatgtccccttccactgagggtcccaggagtcaaactcagatcatgaagcttgcatagcaaatgcatttacccgtctcattggttccacaatttctgttttaaaaaacatgcaatcatgccaggccatggtggcgcacacctttaatcccagcactggggaagcagaggcaggtagagctctataagttcgaggccagcctggtttagaaagagagttccaggacagccagggctgttacacatagaaagcatgtcttagaaaacaaacaaaaaacaaacaagcaaacacgggcagcccctggtcttctgaggtctttttgttttgttattgtttttccagtgtttgcttgttttggttttggttcaaggtctcactatagccccagtcggtcttgagtttcccgtcctccagtctccaccttcagagtacagggattactgatctgtagcgccattcctggctagtttgattgctgttattacttgggttttagtgtttttaagagggaattgggggactggagagatgctcagtggttaagaatgggacctttccagaagacctaggtttgagtcccaggacccgcatagtgtctcataactgttcgtaactccggcttcaggagatctgataccctcttctggcctctacaggcatcagacatgcaagtaatacacagatagacgtgcatataaaacacccatatgtgtgatataagataatttgtcttttattttgttgttgttgttgttgttgttgagaaagggtttctatagccacggtttatgctggaactcactatgtagaccagactggcctcatactcacagaaatctacttgcctctacctcccaagggctgaaattaaaggcattttctaccatacccagttacaagataaaataattttcaaaaaattaaaagcgagtattttttttacttgattttgttgttgttgcttaacgcagtcttgttatattgcctacaatattctcaagcccatgagctcctgtggtccttctgccttagcctcctgagcagctgggacaccaggtacatagttaagcccagctcctcaactcattaaaaggaaaaaagtgtgtgtgtgtgtgtgtgtgtgtgtgtgtgtgtgtgtgtgtgtgtgtacacgagcgtgcacgtgtgagtacaggtacccacagaggtcagaaaggagtattggataccctgtggctggaattacagatggttgtgagttgcctagtgtgggcactggagacagaactaaaatcttcagcaagagccaggtgtgctttgatctctgccacccttttctagggcagccccacctctgctctaggtagctactggcaaagcagtgtcatagagaatacagagagttacagagagagacagagacagagacagagagagacagacacagagagagacagagacacagagagagagacagagagacagagacacacagagagagagacacagagagagagacagagacacagagacacagagagagagagagagggagagatacagagaggggggggagagagacagagacacagagagagacacagagacacagagagagagagagagagagagagagagagagagagagagagagagagagactactagcccagggctgtggcttctgccctcagctagcttaacagctgtagggaataagagagtttataagcagcctagaggaagaaagaatgggctatttcccagctgagggaatccaggaagacagagaggggaattggcgttttgctttaggcttgtggcaatgttggggaagactgtgtagtcagtggaagcaatgtgaacagaccaaggacacttagaagtttagctggatgaggagatttcaggactaagagccaacatcccaaggataagcttggcccggatctcaaaaaagcccttttagttttgttcctgcattttgactttattttgttggcagtggagaatattccagagttttggcagctctgtgacatgagccacactttagttttaacacaaaacacagtacacgggatgagctggaatggtccatatcatgaaggctccggataggaggagaggacacggggccagggagtgatgggtgtgggaggtggtgggtgagcatccttgaatgtgtgacccaaacaagaagaacagaaggtgactgcagggctcacagcctgagttaactaacggggaagaaatactttgacttgagaggatttgaaaataggattggagaggagggaagtgtggcatctggaactgtatacatctggggactgatcacattaggccttggtgggacccttaagaatggttgggattgccctagagaagtattcaggggggaaaaaaacagagggttagcctcagaacttaggaggtaagtgtgggcaaatgagtaaattgtcccagggcacagagtcgattgcagatgccagattccagggaatttgggggagctagaggcagtaagtgtaaatccaactagaaagctatgaggagagaatgagcttaggttccttgtgatgcgatgctcacctagacagatatcgctcctcaagagctgctcaccttgttttttgagacagtgcacatctctcactgagcatacttgtcagcatttccttgtggcattagtagattgcctgtgtttctttggctccaagaaatcttcctcccagagtatagaatgaatctcttcagtgggagtccagtggctttcctggtttgggttcagtggcccattttggaggctgagggcccagtggcctctcaggaatcccatctgtacctttgtgtctctcgggttttgagtctgcacctctatttgcctttccatgataaaccataaagttgctgaaccccagtaactttattagttaaattgtactgtagccccgacggtcctggagctcttttctgctgcccctttcagtcctgctggtcttcagttctcagtagaagacgtttttccgttgaggttcttttaaacgcctacatgcaaactgaagtgcactcaagctttggtggaatgtcacccacagctggaacagcggaggcaaggggggacaccagccttgagttcacacttctcttaaatggtgaaaaagaaaaacaacgctcaaggaaacagattccataggaaagcaggcaagatccaggaagaaagaaacagagaaacgaagaaagaaacgaagaaagctagctaatctctttccctgtaagacacagaaatcatttcccatccaagcaagatgcagcaggagacaacgtggcccagccacccatagctgcagtcaaggggtcgtgaaccacgacctgtgacaagcagtgaagcagtgtggccctgacgatggtggttaggccttgtcttgctccattaagcaaacacagttaatacagatgaaaggaaaccctgatagaagtgaaaattgaaaccagggtggaaggcacaagccccgtgcagctgccgtggcacttccttctctgctagcaggatcaacacttctgatatgttttggaagggatgtagtttttaaaaatatcgtgggttttttttttttcttcacagtgttttgggtttttacatctaccccagtgagagaaggatgtggaatagagatgttaaacagatgtgggaggatggggtccaacccaaccacctggtagtttaagtttagcactatttatttattgatttattgatttatttttacatgtatgaatgttttgactgatagtatgttggtaaccacctgtgttcctatggaagttaaaaaaaaaaaagggacttcagatcccttggaactggtgataggggtggtggtgagccaccatgtgcatgttgggaaccaaacccaggtcctctgcaagagcagccagtcctcataactgctgagccatctccccagacccagcataacctgtgccaggaactggctgtgtaaaattaggaaaatgactgactcgtgtctgcttccatatttcctgtctgagaaggaaaggggcgggggggggtgggggagttggattagccaacctctaaattctcttttgctctaaattccattgatttgtgtttcttcgtgggaaagtaagccttccaatgtttaaacactcagtgcttgaaagaataagcacctacatagcaagctttgcttatgaacatgtcttacatgttggtctcatgaggcaagtttttagagggttttttgagagggttaatatataaacttgccttctccatttcttctgttgtttggctttattttgggggacaggacctcattctgtagcccacactggccaaaaactcactgtatagaccaagctggcctcatactcagagatctacctgcatcctgggcctccagagtgcttgcactataggtgcaagccaccatgtccagccagccttctgtgtgtcttacgtcctcccagttggcaaagtgtttgccacacacacatgagaacctcagtttaatctccagcacccaaataaagcagcaggtatgatggcaggtgcttgtaaccccagcactgaggaggtggagacaagaggctccttggtgctcgctggctggccagccagcttggcctgatcactgaacctcaggtcccagtgagaggtgggcactgtctcaaaaaacaaggtgaacagctcttgaggagcgacatctgagttgacttacacacacacacacacacacacacacacacacacacaagggttgtagcaggatagaagagagcaccaggaagtggaatgctgcttctgttctgtgttctgttccccctgactgttcccacctgcaaaaaagaacgcacaacacaacagccctttaaagagcggtgtttagtcatccagcttacttaggtcaggtcagtccctcctctcaagtctagtcctataattagtcttgagtttagtcttacttagggtaggtctagatatctcttcccccgatggggttgcactccgctcatccagatcaatagaagtggttcgttggcttggattaaagcgttacttcccttgtctgtctcaacactgttggccccaccagatttcctctgctttcaatgctgtctctatcttttccaaggcagagagataagagaatcttcccaccattcccacagaagcaaagcagcaaagcccagcttcaactcagaaaaaaaacagtttcaaatccatgggctggagagacggctcagtggttaaagagcactggctgctcttccagaggtcctgagttcaaatcccagcaaccacatggtggctcacaaccatctgtaatggaaactgataccctattgtagtgtgtctgaagacagagacagtgtactcatacataaaataaatgaataaatattttttaaaaaaaattctcagctctcgatattcacggtctgcacgaagacctttgtgacatcaaaatgagaggttcatcttgaaaccaaagaccatgtcccatcgtctttttaactgcagccaccaataaaagatctgagaacctttcttctctccaaggactagggacattttgttcagaatgtttgtgtcatggtctctgtgtgtggtcacacctaaaacttgtctctaatcttctgggcagcctaggactctgccattttatgtgtgtatgttgggagggggtatgtgtgtgttaggatgtgtgtgtgtgcatgcacacatgtgtgttcatttgtgcatatgtgtgcgcttgtgtgtgcgtttgtgtgtgcatgtgcatacatgaatgtatacgtgtgtgtgcatgtgtatacatgtgtgtgcttttgtaagtgtgtacatgtgtgtatgctgctctaactgtggttccgaattcaaacagtgaatggtctccctcacagcatttttttgttttgattgtatacaacattccgtgagcttactctgtccttagttgtcagttgtgggtctcttttctgagccgcttcacagcttcaaatacagtcatcgttcatttcttgctcttctgtcccctgcagaagattcgatgaaagtgaaagatgaatacagcgacagagatgagaacattatgaagccggagcccatgggagatgcagaagagagtgaaatgccttacagctatgcaagagaatacagcgactatgaaagcattaagctggagagacacgtgccctatgacaacagcagaccaaccggtgggaagatgaactgcgacgtgtgcgggttatcctgcattagcttcaacgtcttgatggttcataagcgaagccataccggtaaatagtctcctctgtccattctcagaactgtcctcatgcagtcctgtgaggagtgaagtggcagaatggggggtctctctttggactcctccattgctgtctgctataatgttggtgcctctctttgcgttgccaatttacccagtggctcctgtttgtgcttcgctatgcgtttggcaaacacggtgcaaatactgtggctaaagagagacgagcaaaggcctggtgtaatgtctcacacctgtaaacccagggtgcgggaggcagaggcagacagatctctgagtttgaggccagtctacatagtgagtttcaggacagccagagctacattgtaagactctggaaagacagagagacagagagagtcagagagagaagcagggagaaagagacagagacagagagagatagacactcagagagacagagagagggagacagagagatatggagtcagagagatagagagaaacagagagacagggagagacataggggcacagagagatagagacagggagagacattaggggcacacagagagatagagacagggagagacaggtcctcttactgtggataaaaggatatgagttttatcgtcagtcttaaagacatcttcgtttggtaagcaaggatccataggaaggcctgtgaacaagtcaacaccgagtcaatagactccatatgacgaagagactctgcacaggcagactggtgccttgatccctcgttacatcgcgcatctaagcatgcctccgtggctcagtcccagtactcaggaggctgcagcaggaggaccatcatgatgagtcccatgccaccctgggctgcagaggaaaaccctgtccaaaatcccagcaccagcacaggaggcagaggcaggcagtttctgtgagtttgggactaacctggtctatatagtgagtttcgagccagggctacaaagtgaggtgcagtctcaaaaataagaaaatgaagtcttgactctgtgagtccgttttgcaaaggcaactgcattcagatgccaagaaatggagaaacctctagaaagctcctgaggcagctcgtgttcctgactcaagcaagatgacagctagaattgctggtctgagtgggggcgttcgttcttcacggaggaagctcccacaagtctcttcacctgaaaaaacccagttcccaagcgatctatgtcactgtggggagaggtgcccagggatgggccttcaccttaggcctctaatctgtgcgcccgccttcccacttaccttgtgatcagcgatctcctttttcctcctttctgaaggcgaacgcccgttccagtgtaatcagtgcggggcatcttttactcagaaaggtaacctcctccgtcatattaaactgcacacgggggaaaaaccttttaagtgtcacctctgcaactacgcatgccaaaggagagatgcgctcacgggacaccttaggacacattctggtaagtgaggacatggacatcccatacctagttgagtgtggaggcctccatctgtcacctcccccaccccccacccccaggggttgcatcagcacggtcctctagggctaatgcacttccattaaggcattaattgctctccgtctgcctcactggaaaccgttcccccagcagccttgtgtctggagagcagcagcaatcaaacaaattaccacgcctttgtgattttttttttggtgagaaaaattgtgtccatcagtatttttatggtaaactaattgttaaggggttgttttcttaatttgacacacacacacacacacacactttccagttttccattcagaaactatacatgcaaactatgtacagcttgtaaattattataaaatataaacaggggtggggcggaagcgctgaagcgatgacgcagtggttaggagcccagattgctcttccagaggaccaggattccgtgttgacatccatatcttgttgccttatagccaacttcagctccatctccagggggtccaacagctccggtcaccacaaatgcttgttctcacgtgtatatacaccacataatcataaatttaaaaaagaaaagaaaaactgtgactcagatataaattattatttgaagttcgttttggttgttctgggctaaatttttttcttcattttgttttagtttttgagctaggagccctgcgttgtagtcctggttggactgaaacttactatgtagaccaggctagcctcaatgtcatagccatcttccttccttaccttcggggtgctttaatcgcaagtgtgcaccaccctacccagcttctggctaaatttcctaaccccaacttcccccttcccggcctgcttatttttaagctctaagagcagcctcaagaattcttaaaaagccacatactgccttgatcttgtcactccttgttttgaacaagcaagatgacacttttttttaacattgagaatttccctcttagaaaaataaggctagtcttattttcaaaatcgggacctcatgttcttgatgttatctgtcggcattttaatttgagagagaaagaggtttgtttttatgtcagaccatgttactgctttgactaaaccccggccccatctcaaagctactcccaattcagaggaagattaaacaagccaacctcagcaaaacccaggacagatcatatgtgtcaaagaggggttctctctctctctctctctctctctctctctctctccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacctagtaggtgttttgagacagactccagtagcacccaagttatgcaggaatgaacatttttagccattgcaaacctgtactttattttgatttaggacttcataaggatcctttgagagtatttttactcccaaagcaagaggaattagaaaataaaacatttcatgacagaaccgggtgactcagtggtagcatcttggcctagtacacaggaggctctgggcttgctccctcatataccagaaacaaaagggggggaaacccatttcagtctctaaaacaatgacaattttttttaggttatgttttatcaatagacaaaaacaaaacaaaacaaaacaaaaccttgtaaagaaagctgaaagtgttgctttcccatgaataaacttacggggaaacttctgatttgctttagaaaattagttgaagtcacttttgtaatttgttctttcatttgttttgtttctttgttttaagacagggtctcactttgtagaccaggctggcctggaacccacagagatctgcctgcctctgcctcccaggtgctaggattaaagggttgtgccactatgtctggctattgcaattaattcttaattctattattaaaaatattccttgttaagcagtcatggtttggccatgcttgtttgaggccacttgataagaatggcctgcacaccccaaaatgtgggtgtctgatttgtctctagcctgatcccaatgcccacaaacctcctagttccttacttaaagtagatagttgtcacagcacaggaaggatgccttcccattcccatcaattttatgggaatgggcattttctctgcacacttgtgcccaaggaggtcagaaaagggcatcagattcccctggtcctggacttactctggatggtggtgagctgtcaggtgtgtgctgggactcaaaccctggtcctctctgagagcaacaagcactcttgccaccccaaccgccccagtagtaagtactcctaactgccgaaccattgtcccaggtcccaaataaagtgctttgttttggttttgagacagggcctcactatgtagaccaggttgatatcaaaatcacaaagagcctcctgtgtctgctggggttaaagacattgtcaccacatctggctgcattgcattttgtaccaactacccaccttgaagaacaaatggctatggtttctctgtttgtcgtccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgggggacgctggtgagtggcacagtgctaggtcgctggcccatgtcagtgaacgtctgttcttctaggtgctggagacagatcctagatggaacaaatgagcaaggcggagagatcgtgagtgctatggagaaaaacagagcatagagggtatggctgagcttgggaagctgccaaccgtgcaacatgtcaggggacttaaaggcatggcagggagccccataggtcgcttcttcccacctgtttcccatccccccatagggatgcaaagccagaggggagaagggaaaccagagcttatcaggccttgtagtctatcgtaaaggcctttgagagaaacggaaaacctttgaacatggacaggtgatgtcaccggaccgctcacttgaaagccatcatcttacctgtttatgaaagtaggttgtgccgagaacaaggcgagatagatctgggggaatccagttaggagtctgtggcaggaattcacgccaagggaaactgtcttggccctgaccaggtgatggtgttccgattctgtaaacacatctcaaaggtagagccagggcggagccagcaggatttcctaatagtgttggaatggcacagaatgtggcacaggctggggagtggtcagtgaagaaccagttaaaaagtgcaagggcccaaaggtgatgtccttgtctgcgcatgtgacttactgcgatgtctgtgtttggctttaacaggtttcttattttctccagggatttgaactgtctgcttcctgatcgcaggttgaaaagctctgcttctcctccacgtccagggtggcttcatttccttctcttcttctacttgcatcagcctaaagcttgtcttgtacggcatctctggtggtcatccttcctcctatccatttggccttcaacctgattcttcagtgtggggtggggacttggttgtttggttctgagaaccaagtgcttgtatagcgggaagcagtcctcatgggcattggtgtctgacagctgtaactgcactgggaccttttgagtggcctgaagcagggtgattacagagtgcgaccgagcagaatggaggagttgtgaaaagcagagtggaaatcctgagtgctctccctcgtggagtggaaggagactgagctttagttaaagcctggttcccgagtccagcgctgggcctcagaagcctgtgggtctgtgctcacctctacctctcattctgatggcatcttgggttttatcaaggaccctcattgaccgtcttggttctggagagtgatgcttgctcttttaataaaacaactaaagcttggcgttcaccctctttggcagcatgcttagtagtgagtttagtgtttgcctaaaaaagaaacatctaatcctgtgttcttcatttagacgtggaaaaacaaagacttgtcaaaatccattgactaactgaaaaaccactagaactttagcttgcttgtttagattgtgtgtgtgtgtgtgtgtgtgtgtgtgtgagtgcactcaatttgtgtgtacatgtgcatgtgtgcatgtgtctagccatattttttgtttttaaagtacaacttaaggtgcagttcatacctatttgtagctgaaaaagagtccacgtacaaatttaccacattctgcttttctattcatcgattaataggtagctgatttagtttccatttgggggaataataagctatatttttagtgatcttatattatctggatagcaaaagaaataaagcaacacatactgaatagatgtgtgtgtatacatgtgagtgtatgtgcatgtgtatatatgtgtgagtgtgtgtgtatgtatttatgtgtatgtgtgtatatgtgtgtgtgtctgtatgtataaatgtgtgtgtatgtatgtataaatgtttgtgtgtctatatgtataaatgtgtgtgtgtctgtgtgtgtatgtatgaatgtgtgtgtatgtgtatgtatgaatgtgtgtgagtgtgtgtgtgtgtgtgtgtgtgtgatgattctcctggaaacaggaggagaaccagcaagttttctttgataaacaatatatttgaagtgattattccccatgccattttagtgatttgaagttttaaaagttaacaaaagaagtatttagatcgttcagaagtgctggacagttggggaggcgctgagctgcagattaagctaatttgtattcataggggtgttcgatggatgcgtgcagcatagtttaagtctcagcaaaaagtgaagggttaaccaagtcagcaagttttgatttgattctttagtttgttttggtttgggttttgagatgtggcgagcctctctatgtagccctggctggccttggacctgcagagatccacctgtttgtgctttctggatactgagattaacagaggggtgcaccaccatgcctggctttgatttttttttaggttacatcatgggtaaagtcacagcttaataaagtataaataccacatgccacatctctatgactgagactcttcggtcttaaatagtgtccatacattttttttttctgagatccaagtgtgaaggctttctgatccaacccaagccaacccctcatcgacaacattggtttcccatttctatttccttcctgtaactaggagtccggtgtgaataccgtgttctatcccaagcctgaccaatgcagtaaagtttttctactctctgcctccatcctctctccatgctgggattacaaccatgtaccaccatacccagtctgatgtggcaaaagaagcattggctttgtgtgggccacacaatcaagcagctatacttacccgtagtgcggcacatcctaaagctttatccctctgggtcccttctaaaatgctatccgaggcagagcgcagtgtggcaacagtgatacccgggatgctgcggtaggatgattctgatttggaaggtaggatagcaagaccctgtctccaaagaaaaaaagctgagtaagttaagttgcggtgagagacgagctgaggacaaagtcgcctaggctggaaagcaggccttcctggaaggagacaggtgaaatgccctcagagtaaagcgcagcctctgagagaacaccagcgtgaagtgacagaacctccagctgtccattcttttattcggacacagccggttcaagtctagatgtgccacatctcgtgtcagaactgtttgcaaggatgaggaaagctaaactcctgtccctgtagaacacccagtccactgaggcactgctctagtaagggagacacgtgaggtattgcaagttcagcccaagtctgtgcaggtgccgtgggtgacatcatcacagtcttctggtcctgctgcctaaaggagtccaggtgaccagaggagcgattgaggaccacgagtttcctctccgtgtcaccttggtcttcctggggtccaagtggcttcatttcacacgagttagacttgtctaattttcttgtgagtaatcatgcattctggcaataaaaaaacctttttgtttgcagtgccaaaactcaagccagggccttgtgcattctagacaagcactctaccgctggtattaacatctataaagtaattggctaaaccctggtgtgacagcacacaccttggatccagcacttgagaggcaaaggcaggaggatctctgtgagttcaaagccagttctgtctacagtgtagactctacacagagagaccttgtcaaaaagaaaaaccctaaagtgaccaattaattatgtttatttgtgagtctaggagttaacatttctcttctctctgcttgtctcagttgagctaatgcaagcacaagggtttcaggatttttttttaagcaaggtaacacactttttcttctaaaagtaaagaaataaaataaaataaaataaaataaaataaaataaaataaaataaaataaaataccaactctgtttccctaagtcctcacctcacttgctcacaggacaacagtttcatgcaacttttttttgtttgaacctgccttgtctttgatagcgatctgttgttagacaatcttgttgcacaatgactcctcttgttcccgtccctattagctgctgaccacaccatagaagcgacagggaagcagtgactggtttaagctccatttaacacttcgagccctaaggaaggattttgcaaaaagcaaaagcaaaacaccaccacttagtcaaagctgcaatcgccttgagatttttttttcttttaaatgcattatggaaacaattaatagctaaggcacgagcagagatgaaaggcagtgggtcacttctgcgattgtgattttcaatgacgctttattatttttccagtatgcctttacaatctattgctagtaaaagttgacattacttaccatgtagtagacacatgatgtgaagggacagtgtcccagacctacccccgtgcccactcaggaaccaaatatgccaatgtctaccatcccggattccccacccccaccctggcaacattaagctgacaaatagcacctaggaacggattcctatttcctcatctaaactcatatcttcttcccttgccatcttgccaaacttgttttcctccatttacatttctgagacatttctgtagcaagatagcaaggctagacagttgagtcgggaagacccggagccagaaggctctcttttgtcttttcagtatagttcctaagcaatcgctttgctcagaggacactgacatctgacttagtgtttcagtgtttgctattcagctcttttattcatcagatctctgacaggtcagaagtggaaaggtctaggaaagaaaatagaagtgtcctctatgttgttgccattagcctaggtccacttggcagttagaaaacacttgagtctgtggagataatctcagccccagaggggttgttccctgtggttgggggacctggaatcagagagtcagtgaatgacagatatggggagggtgcagggaatgggaatctgcctcttggtttcttgcagaaggtacctccctctaagcagaactgtgaaatagggaaataaaataggaataaaaaggaaagcctcgaaagtctcgtgcttcaggttatctctccacccatgaacactcctgaatgttattttttttttttatgtcagccatttggtcactgattgctgtgttgagagttatctggaaatgactgtttgagaccagcttggtgggtaaccaggaatgagaaaggtgatgttatctcagaaggctgccatttagtgacatgccctaattacagttatttaggtcaacgtgtccacgcatcagcatcctctcaaacgcagaggatgttgattgcgtgtgcccacaaacctgctgatgctgatggtgacttcggtgcagcataagcagtggctcctaaaagataagtgggaaaccaaggcactgcgctcgctcagggtaggtcctaggtcatgatgtgcccaggaagggagcgaccgcaagggacagaacacggtggtaagaaatggggtcaaaaggaaaaattccctaaatattttcaacttcatttcaatctagatcatttcaataagagttacaagagtgatcctctcaatggcacccctagagtacagacatggctcccctgcttctaagagaaaggaagtgtaaagaaatgatccctcatattgggaaaggacttcaaattccagtctctgcctttcatctctctgctcaaggggctttgggtagcgccacatctggtggtggtttgtgtgaacggaaataatacgtgtgatcgtttcctctttggtcattttaacctgtccctggactgaacagaatttgacccacttcagtgggtagcagggttctgtctacaagtaccagagtccaaagaccttacggagtctgaatgctgcccacgcccctggccctgagcatggtgtgttcatttacataaaccctgttgacagctggagcagaactcaggatgttttttgacaagagccaggagtttttttttttcaagagccaaagtcaagtaatgttggcgttgtctctacccccttttttttttttttttttacttttggagacagattttcttttattactgactttaaaatccacacaaagttttatatggtatgacacctgaaatagagttcttttgatgatggtactaaagtggaaaataattaatccttggaatgatccttttccaatctggcattgactctctctggcccaggctgactgtcctgccctgcagttctttctctgctgttcattttctgcaacggtaaccatggtcacgtgtcctacagaccatgtgctagaatctcttcacacagccaatgcccagactcttctattatagagcaagggctgactcttccgggacctgtcctaggagtatctcattctggaagctgtcgttagcttttaaaatctagttccttaaacgaattacattttcttcttccttagacacgttagagatgtgtggctatttagcttagaccttctgacgtgctcagataaaacagagacatgttcataacatcatagtttttgctaagataaggatgcacacaccatggcccttgagccgagtgcagccagcaatctgtctgtgcacaggacttttaccatttacctattgtataggtaatgtacgtgtgttatatgaacatgtccatgtgagacgtgcctggagccagaagttgacttgggatgtctttctcaatcactgtccaccttatttcttgagacagggtctctcatgggcttgcagattcagctagattgcgtggccagtgagcctctagggtctactggtcctgtttccctggtgccggggatacaggcctgggccacagcactggggatcgacattcaggttctcaggcttatatagcgagcatgtcactgactgagccactgcccagcccaatgtttacatttttaaagagccgtagagtaggaaacatgagtatagaaagagacaatacaacccacaaatttaaaactattcacaaccatcatgagcataaaagtgtgcgtgtgcaatcccaggacttgagaggttggggctgtgtaacagaaagaccctgtctcaaaaataataatgataacagaataatcatacatagtatttttactctttgtgttttttgtttgtttgttttgttttgttttgttttgttttgtttttaactggaataatttaatgatctttgagcctggctagcattataaagtcttaggccttgtacttatagcagctagggagtcttccctctggagccgtgatgtctctctcactagctactgctggctgtagcaaactcaattatatttgttcagtgtatcggcactatttttatatccctctagtggactgaaattctagctcctctccctccccagagtttcacatggtagtctaggatggcctacaacttactgcatagcccaggctagtctcaaatacatggcagtcccctttgcctcagcctcccaagtattggcattataggtgtgagccactgtctcctgttgaagctgtcttttaaaatcatcttagcaagctttgaaagcatacttgtcctggcctctctagaataaaagggaaccttcctatagatatatcttatgtgtgtataaggcaattaggcaatactactttacagccgggccagagagctctagcctgtgccatctgatgcctagagatgggctgatcacgaatccacagtctcaggcagttgctattctcccttttcagtagaaatataatggaaatatagtaaaacaaattgctctttaatttcaaaacaacagtggggctcaggcacactttaatggaaacaattttcagacgtgaggaacatacaaagccacacacagaacccagagaaacggaatgtgaaagataagaacagagagaaacgtagtaaagaaaaaaatgactcagtatttcaatacccaaatcactgagtagatttcttgctatctgggtgagtgtatctattttcaaaagtgctattagcataaacagagcagtaaatctggggcaccatgccctcttttttttttttttcaaagttgttaagaagaattatatcagtgtgcaggtgtcacgcgcggttactcagaatcagaaagaaggccgatgggggttaggagacctccatctatctatctttttgcaaccaaccacgtccaagctatttcttcaacacttcctcttgctaatgaaggtactagctggggatgggtcgggctttcccatctcagcataagactgcaagatttgaatgtgcccctgaaccggcctcactgaccacagcaggtacccggggggggggggggggcagagatctaagcaggaagaacaggtaatgacagcgctgtgcatctgacctgtcgcttcttcccacctgtttcccatcctcccatttaccagtgtgttcttctccctcttcttccaaaccagcaagtgtggaggcaagacacatcaaagccgagatgggaagtgagagagctctcgtcctggacagattagcaagcaatgtggctaagcgaaaaagctcgatgcctcagaaattcatcggtaagaacacacggccctctcttgcttctgacagcagacaccttggatgagataacacagagatgtcgactacccttgcttgcctggctcagtctgttaaaacaaggcttcttactctgtgtgattggttcactttggcggctgtcgtatatagatgtaaaaaaaaaatattaactcagaagtcttagctaaagaacaggggagcatttggtgttgtttcttagacggagttggtgtttaaaactctgctccttcctcttcctcctgaatgacatctgttgcatagatttatgcaacttacaccagtaaagtgtccaagatagcatcttggtaaaattttgcaatgatatgttacaagttggttctgttagcatgctctaaccctttttttttttttacgttctaaagaatatcaccatattttcttgaatttgattgagagctggctttagcagaaagttgatggagaaaaatgtggatttaaataactcagtttgacttgatcactgtcttactgaagttagatttttatgtcgttggttttcacattgtcaaaagtgtcatgtcagacaattatgctcagacaagtgttgggtcttacaaatggtggggctatttctttatttgcccagatgtttaaatatttgtgaccatagtgttttaaaatagatttgtagctggaaattaggaagctgagtttgagtgtgtccattttattataagttgaaagttggtggtgttgagcaaaggtagttactatataaagaaaaatctacgtaaataaagaaaatttccaataaaagaaagaaaaggaaaaatcttcctcaacacggataatattttaaaatttgtcaatacctttttgtaaagctgcttctgactttagtcttcttgtatttattgatcttagtggcttttacacacaccgagtgcctgtctacttttgctttgttttgttttgttttgctttgctttgctttgttttgttttgttttgtttttttgagacagggtttctcggggtagccctaactcagagatccgcctgcctctgccccctccccatattgctgggattacaggcaagtgccagtaccttctggtttgcctgtcaacttttaactcaaagattattcgggcctaagtaacactttataagtagacgttcaattgaattatatatcgaaagaacccatagattttgaaatgattgaagttggtgtttctgcttatttattttattgttattagctggatatattctgtgtggtttttgtcacttcaataacaaaatgtagcacaggcctttaatcccagcactcacaaggcagagaccattagtagatcccagggagtttgagaccaccctggtctacatagtgagttcctagccaaccagggctatagagaaacccccaagggtatggtggattgtttctacattctcagcgcttgggaggtagaggccagagcatctggagttcaaggctatcctcatcacatagtgagtttggggccaggctgggctatatgagaaaccctgtctttaagaaaaaaacttagcagtcagtgaacccatcaataaatcccatcaggctgaagttggtgtgttttggtttatggagatttgtgtcttctaatcatttcacctccccacgaggagacatgacatgggaaatggagtgacaaccacagaaagattaggcgcatcggaccaatcaggatgccaaagcattactcgggtatcttctgatccacgtggatcgtcagactctagaaatggctgacgctgatgtgggaggagcacgggatgagaggggcaggggagcacaggtaaagcgtctcagttccagccccattttactcagggaatgaaagttccagagaggctccatcatcccggcagtttgggacagttggcttaaatatacggctgagcaaaaccctactactgtggtagaggttactgtgtgttgccattgctgttgctgttgtcattgttgctgttactgctgctgctgttgttgttgttgctgctgctgctgctgctgctgctgtcattgctgttctcaggtctcctgtgtccaggaccacttggggagccatcccgggctttctgaccataggatttcagacctgcaaactcatagaaatctgcagactgatttcagtccggaacctcactgcagcagtgggctttgaaaggtctggtttctccttttctgagccagtccatcttctgtattgtaggatcaagaactcaggagaggtagtgctttttatttattagtaaagcttgttctttgatggcttcgtattcttttttttttccatttttttattaggtatttagctcatttacatttccagtgctataccaaaagtcccccatacccacgcacccttcgtattcttttagtacctaatgcattccagtcactcttccctctgctccccaccccttgctagctgtcccctcccttccctgcgtttctcagccatttagacaatcctttctgggtccctgcttactcatgggagagtaaactaactggggatgaagtgactggggcgccccgagagtctatgggaattgaattggaaatgtcagggagaaccagctcgtgtttcagagaacctggccatgtgactttgcaatctcttctcaaggctctaaggataaagagttcgtgtcatacaccagggtccagctttgacctgggtttttttgtttgttggtttagagggtggctcctaggggcctgcagtgatgcaatggtgtgagcacccggcgatgtgatgtaagcactctagtgaacgacatcttagtctttaaagcttgtgttagttgggttgggttccttttttttttccccttgaggaaaaaattcttaaagctcagactccagatcaaataattacatgcatctacttgcttaggacagcactgtgcagcctgctcttgtgttcattcatcatacacagagtaacctgagggtgggagtgggggtggggtatctctaatgcctgtaaccccagcacttgagagatggagggaaaaggtcaccttctcagtgtcaaggacagcctgtgtgagacactgcctcaggaagcaaagacacaaatgtttactcagccttttgctaagatcaagtgtagtatctgttcttatcagtttaatatcctgatacgtcctctatccgaagagaatatattaaatggacttttggagaggaggggggagaggaagggagagacagagagagagagagagagagagagagagagagagagagagagagtattcttgttatgggggcatgctcataatcttctaacattaacttgtatcctaagcctttgattatgggatttttattttaggacacacaagagacaagacagatctctgtggttctgtaccaagaattctgggccaggtagaactagatagtgggaccctgttgtgggatgggctgatggacaaagatgaagaccagagttcattactcatccccccaccccccagaacccacataaaatctcttataatgcggtcaggagtctcaggagcttgctggccaacctctctcgccaaattggaaactccaatttcagtgagagactgtctcaaaaaataagaaaagaaaaaagtattaaggaagacacccttaaggtggacctctagtctctacttgcacatgggtacacacatggagacacactcaacaaggtatatacatccatacacacacacatacacacacacacaggaagaaaaaaatgaagaaaggaggacgagaggaagcaaggaaagaaaatccattgtaaacggaaaacccttggagcatctagctgagctacacattgtgcctgagagcagtgaggtccagagaaggaaagcagagcaccccctgtgggatgagggatgcagcagcatgagcccaggccagtgctcccctccctctactctccctcctccctttcctttccaaggcaccattttctgaagcactttgttgccatggaaatggcaccatgtgaagaatgagtcaatccctttcatccttgcaaagtgtgcacccgttctcacaccagccctcgctgccctgccctgaacggtgaaggcaaaggtcaaacagaacttggtcagtggaccccttcccctgcaggggtggaggccctcatcgaggtcaagatgatctctttccaaggtgggcttgctttgcttgtagcatcctggcctgaagcttgtcctgtgataaacagtgcttgaccatcctttaggtcaggctagcctcagatagttggcccaaaacagaggacagatttctctccctcaaggaagggaaacacaacttgttttcctggtttttctcccccgaccccacccagcaaacagaactcaccacatgtgagttactttattaacaaaagttcttgtgttgaaaagaaaatgaagacaaaaaaaaaatactttgtcagtagcagtaaatgtgtgtgtgaggttttgacacttctgcaagcagcatcagctcacccactttggttaacagagcagcagggagcaggtttaacacctatgtccctggttccatagacattgagatgttcttaattaaggcacattctgttgggaacctacagagaagtccttagactcaggaaggacagacaaccagagcaccagggaaacacagcttagataaagcagggcgagacccaggtcagcttgatactgaggcaggggagctttgggcagccagaagtctggtccctgagagctggtggtggggaagccctgaaaggtggctgttctgtgtccagagggaagaactgtcttggctgcctggaattccttatatccaagcagtgtgtcacagatgacagagacctggcctgcagctccagctcaggtctcctccccattcagtgtttatactttcttcccttcctgctgctgcctgactccctcatgtcctgaaaaggagtgttagtaacttccagtcttccttaagttgaaatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccttttctttcttgacatgtggttgcagtaaagtgagtgggaacagccatggtacataataggaagcagcaagaaacacacttaagtgacctgaggaacttcaagactcaaataatatccatatatttccattgcccagcgttgactgtaatattggatttgcagtttgtctggaggtcaaatcatttttgccttcctctttagataataaaacccccataagttgctcccagtggagtagaatccccagaacttgcctctcctggtctagcagtatagcccagtggcctctgcccagcctccctgtgctctcccttcacttctctctggacgcccccctccacttccaggcaggccttccttcccagattccgggtctggatgccctcccatccctgttcctgctcctccctgtgcccattctcactctgcacttcaagcccgtgcagtcttctacccttcgctgtggctgcagtcccctcctccacttctgatacctgctgatgattgtgagaattaaacaacaaggagccatggtggctaccactcggccctctgccctgtctgtgagaactatctcactgtggagggctgagccaccatgagcaagaaagcagccagcatgtgctaagacgtgactcttaaattgcaaccatggtctggtcaccatggacaaccttggaaaaagtgaagcagtttgaggtctcggttcctcttctgtcagagacagcaatccaccttgaaagctttcagccttgaaggggtggcaaagtgtggcagtaagcttagtctgtagcacaaagctcagtactgtagggctgcaataaaagtcgcttttatcattagcatcttatatgcaatatatagtggctcttgaccttagaccctgcagacagagctctaagtctgcgtgcccagtctgtgcatctaggctcccaacaaccttgttcccgttgcttcaatacaggcgtgccgttactcacttgagaaataccaaaatagaggttagccgcctttaagaaggtttataaggaacaagtggcccaaccaggcagcctctgagtctgcgttcaggatcatttctgtcttcatcagaagaaaatctctatgagctgccttggaagcagttctactcttgtggtttgcctaacctttcttatgagtgtattactaaagaaacgtgagctattggcttctcaattactgtagcctaccccttctgcgtttcatacacattgagtcatccggtctgcaggtgactgataaccatctgcagcgatcaggttacggtaactgggagatgaggggatctgatcagagtgaactgtgtgcacgtgaagatctggggcgctcccctcgtcgagttgaacaatggtctgcgttaaaccacacaactcccgtcacctgactccattcttccagggctttggtctcccttcctgtcttgtctctttccacctgtggtatcccagctgtttgctttgaggtgcttcgggtggtgtggatgagaggggaggtggtggcgtgcctacataaccctggaaacttcccagagcctctctgtcataagaaacagtgattagagatctcctggtacttagggaggttagcagagccagccacactgggaaatgaccttgaaaagattaagaaaccagatttcatcagcccggtgccgtttccaggggaacgggtgtgggtgaacttggtgtttcctgctcttggtgtcattgatacaggcagccatcatcatgaaggagagaaccagtctgggagctgggaagaaaacccactggttactttggcaaacttgtacattcttctgtggcttcctagtgagttgtcaagttagggctttttcttttctttttctcaaatattagtgtaggaagtaacaggtccacaaggtcacagggatgcagggtaaacgcatctcagatctcctagctgacctttctgcctccccgccttggtctggcacatcttacacattgctgttcattgatcacgaccgtctttcctcagaggcaggtgaccacttgctgcgtgtttgaatccaaccacactctatggctggttattcagaatgcctatcatttggccctactgtatgctttccagagtcctctgtttgattgtggccctgggatcaaccctagggcttcacacagatagacaagcactctgcaattgagctataacctcaaatctgtctttaactttagagacaaacattcacaaagctgcccaggctgaccttgaaccccctttgcagcccaggcagtcttccatctggtcctcttccctcggccttgggagtagctgggattataggcctacctctttctttttgttttgttttccagctctttctttcccacaatatgggatacctggaaacacacaggacatttgtaaactttgatctctatgaacagaaaacccaggccattgaggtggctcagcagatgagggcacttggtgacaagcctggtaacctgagttcaaaaccaaggtcccacatggtggaaagttagaactgagtcccacagttgtcctttaacctcaacaaacatgctgtggcacacgtgtgcctttggacaaagcaaataaataaaagtaagaatacaggaacgaagggagggagggaggaaggaaggaaggaaggaaggaaggaaggaaggaaggaaggaaggaaggaaggaaggggaaaagaaaaaaggagatgccagcatgtgccaggtgctgtgtatgtgcccagtcctgccctgagtgccttccaatgaccctgtgaggagttactgtgttcctttcacacagggtcacacaactagtagacaatggaaccagaatcaaaccagcccaaactagcccatgtggctgaagcccgtctcaactaccactgttaccccagtgtgtggccattacagtgtggggctctgtgaagtctgagaaacgccttctgtggctctctctgcctgcctgcatctttcagccctcatctcctctcctccctcatacagagcaatcctggtcctaccagttcatcaagtaacccttctcaagagttggattttcccaagaattcatttctttcccagagtacttctgaagtcttgtcatccccttaatgttgcaatatacagttcataccaaatggcttcactttgcctgtatataacaccttacaacacacacacacacacttttaacagaagacaaggtcttcccttggttcaaacatcaaatgggacatttagaataaaaccacagatagcctccgtagatgagcagccttctgtgatgtccacgctgtagcttgtctccagcttttacccctgaaagtcttgtgtctgccctgcaagggtagagtccactcaagagcagaacctgactcctctgatccctgtgttttcttatggcaccataagtaaattagtaaaaagtaaattaggattaggagacaatcctaagctataagcctcaagctactgaggctgatcactgacggctctattctttgcagtactcattacagtggaatagcagttaggatggcgccagttaagggaccacacagtggcagagcagaggcccctggctcctgacagcccacccaccctgagctggtcccactgtctttgcatcctgtgcccacccccttcctccagtgggcgcacctcatgacatggcctcacctaatggcatctctgcccttctcctttatccactggcttaaattaacaagtcaaccacgtacagcacccctaaacatgtgactgatgtaccccctgagactgtgtggctgggtgcctcccgccctgtggctgggatccagtgtgcagcattcatagcttacccttcccctcttctgagggactctgggaaacaactttccccactctgcctcctgctgtttcttctgtaacctcccctcctgcttgttccaggtgagaagcgtcactgcttcgatgccaactacaatcccggctacatgtacgagaaggagaacgagatgatgcagacccggatgatggaccaagccatcaataacgccatcagctatctaggggctgaagcccttcgccccttagtccagactccgcctgctcccacctctgagatggtcccagtcatcagcagtgtgtaccccatagcacttactcgggccgatatgcccaatggggccccgcaggagatggaaaagaaacggatcctcctgccagagaagatcttgccttctgaacgaggtctgtcccccaataacagtgcccaggactccacagacaccgacagcaaccacgaggatcgccaacatctctaccagcaaagccacgtggtcctcccccaggcccgcaacgggatgcctcttctgaaggaggtccctcgctcttttgaactcctcaagccccctcccatctgcctgagggactccatcaaagtgatcaacaaagaaggggaggtgatggatgtgtttcgatgtgaccactgccacgtcctcttcctagattatgtgatgttcaccatccacatggggtgccatggtttccgtgatccctttgagtgtaacatgtgtggctatcgaagccacgatcgctatgagttctcctctcacatcgccagaggagagcacagagccatgttgaagtgagcatctgtcctcaatgcgagggtcaacattgttttttaaagctgatggtagccttatccagtagactgaactcaaacccacagtcccacccagttctgttagctctcaatcatgtccacatgaacagtcagggaaataactgtcttcattcagaaactgtttgcagagctatcatgttactctgtgaaacctcccttcccatcagttgagtttgatgggatttaaaagccaaagaagtatctggttcattatcttttgtagcaatagacagccatctactggagctcccggccaattggaacagtcctccgtgggccgcaggagtcattcactggaatacagcagccatatgtggaaaagccctttgatcctatgcccagatccacacagcggaagagccgcccagctgcccttgctcttgggcaccaacacaaggcagaagccttagcgtgtagtccccctcccttcacgttctaacagcaaggaagaggtggccgtacagtaaggacctgctgatagtaatggaagaccctattcttggagcatcaacccacttcctatcaaacaaaactgaagccacctgagcaaggacccttctcctttacctacggtcacaagggtgaacctcagatgatttggcctgagccagaccctgatcctcctgcctccgtctggaggaaaattctactccagaagaactgatgcgtttaaatattgggtatcattgaaaccgcagagtcatgcaccgaggggtggtatttgtctcctttgattgggattggtagagcaagtggtggggacatagtttaagggtacagtgcctgccaggtacaaccaccacaccagggggcaaagagggaagaaagaaaatggagggaagagaggttggctgagtagagcgtgtaaggttgactggttggcaacccttgtcaccttggtggagtactggctgaaaccccaaagaacatttgaaaagtgatttttggcaaaggagccaaaatgtgctgcttagttccccaccacctcccaccccacaggcgtgagatcagggacagaaccacagatgttctctcaggacggtgtgacatcacactctcctgggttagaaatgcatggtttttattatattactctattttcaaaacagggtctcctggtgccccggcaagcctcaaactcattgctggctgaagctgcccagcactctgagcctcctgcctcagcctacagagtgctgggttgagagggttatcagcaccgtggtgttgggcttctgctgtcctaaagaggagctgccacatcccactgagagtctgggaaggctgatcttgttctgtagatagaccaggtagtcacctttgtcacacaggcaccaagacatcaagattcttggaaaaatgctccataaacaagcactggaatcgaggccaccaaccgtgcttgccaagctcatatttgcaactaattggttaactctaaaagacaaatggcctcaaccataaaataagagtagcatccaaaccctcttgatggtcacttctggctttgatacatgattattcaatagccacaggttttttgcttttgtttttgtttttttaacttcttgatgtgtgggcattaagcagacaagtctgcgtgtgagaatgtgtttcatatgtctttgatgtgaaaatatagttgtgttaagtttttccttcagctactgagtcatgaccatgaaggaggcgatgaggggggactaaggacaggaagggttttgatcatgcagtcgtgtatacacgagctggcatctgcagcagccgtgtacacacgagctggcatctacagcttcttgccggagcccttttcttcctttccttttaaaagaacttgtgttagggaaaaataagttctgcttacagggacggcttcatggagcctatttacaaattaagagcttagcttttatgaacatttctgccagagccaggaatcccaaattcccggtatgttagcattttccttctaaggggcttatggattcggctcttactcattcatgtatacgatgccagtaattaaaacattcctcctcaaacacacaaatagcttagcctgccttgtagcatggtgtctgtctcagggtaaggggggtgggttatgagattccgtggcaacaattctgtggcaacaatcccgtgtcagcttaagggctaggtgtcttcagcacatctctgcatctcagcagaatcggatgtgagctgcaccacattgttcatgcccactgtgaaagaggacctgcctagtctaggcttgagatatctcacatcctgttgtcttggcggggagagggtgagatacaaagagagggcgttgggaagcagggactagaaagaagagatgcagaaatgggggggggggcgtttccaccatagtgctgttgaaatcagctgcaggggggcagacacannnnnnnnnnnnnnnnnnnnacaccaccaccaccaccaccaccaccaccaccacaaccaccaccaccactaccactaccaccaccactgaagaaaatggccccaggtgtcttctgcaaagagaaatattttaaaacataaaatcttaattgaaatatataactagcaaatgtcacattgacataaaagttttctgagaaggtctacattaccatccccctcagcttctttgtccccttactgaatgtgaagattgtaacactttgagagggaaagtcttacttccaggctagggtgcagctcagcacaagaatgtccgcctagcactagcacgagagaggccctggtttccaagcctggctggaagagaaagagatagacagatgagagctgatagatagatagatagatagatagatagatagatagatagatagatagatagcaacagacaaattgtagttttgaaacataccccagagcaggcaggaagactatgggaacaaactagtctatggtcctccctataaggtccattgtcctccctgtaaggtgcacgccactgaaaggcatgctggtctctagtaaggcttggaaatctctgtgacaggacagacttgggaacgagcttgggcatctttgaggatgcagaagccttgaatttagacttctgcagtcaggaaggaagaagaaagagtggtggaagaggatatatattgtcacatttcagaggacagcaatgctatctcatgcaaagggttgtttaggatacttcaacagacagtgattccgggcgtcacgattggggatctacactcttcatctgaaaccaacacctgaatctgggtcaccctggggttgttctctaagaagacaggaccgagcagccgtggggatgggcaataaggatagagttggggaccacagtttctaaggacaagggacttggaagagcctagagggcaggtgtgggctttgacccagagtgagctcagagcgtaatggaagtctctgtctcttgccttaccaaagctgtgacctccatcacccaccaagccatcaccatgctaaataggtgtttttaggaagaagtcggatacaccgttcccctaaaccctccaatggcagaccatctgatccactgataccactcggttgttatccaaaactggaacattcacgctttgattttaaaatgaaggtcctaataatatccaccttccagagttttgtggagttggctgcagtcttgtctgtaaagttgctttgggggaagggaggttaacactgtgcaagcgtaaggtttctactgtagcttcctgcatctggttcgaaggacatgaaaatgttcaggatcacactggggccagtgccatggcaaacggaggccaccgatgcctaactagcagtttcttagtgttgtgtggcatagagcttaagaatctggagccgctgtaagtgagccacatacagcctttcatggcctttcaccaggacagtagaatagctttgctccctccatgtctgtgagactacagccattagccctcacagtctttccagagggtccccgccctctttcactctagggagcccattcctgagagcccagagagtagtagccccactgggttccctacctttctcaagcacagccctatttctttacctcccaaaaagagacacacatttttaacatgttagggaagtggagcagcctttaaaattgaccggtgtggcagccagtgactcatcgatatgagacctttccaggctcactggcaaagcccttcctgcttggcctgcctctgtggattcacggaaaccaaattactgtgggttgtgaagaattagcaggtcatttgaaaagcagacataccttcacccagactgtggtttttatatgctcagtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaggacttagagcagcaactccttcagcgcagaagaggatggagagcagcctagccttgtatgttagagtaaagcatttaaaagtagctttcccttagtcaaaagccagacatatatgtggacttccccaagcccactccctcccaagcagaatcagctgcgggagagaaagggaagacaaggaggccttgaactctttttccgaggagatgggggagggggtattctttccagcctaagtttccctagctccagggaccagtgttgccttaaaggggtgatgagcccagcaagagaagccacccgacacctgcagacttccccacccccaacatcactgcacaacccaggccacctgcaagtttgaaggacccaaacctccacctgcaagcaactgccacctgagggcagggaggccaaggaccaagttcctctccctccaacccatccttaaacccccagggcattagagtccagactgccaggattggcccgaggtaagtggtaaagtgggatggttcacccaggccctaagttctgcccctggagcatccccgggcagacggttgtttgcataaaagccaaaagccactgcacctgggctggggaggccctctagggaggtgctccttggcttgggggaaagggggaaggaaggtgtcatggaaagtccctgaaggacacgggtgttgagtttgctgcggttttgtttttaactcttgtcttgacctgtgaagtctgcagctgcctccctgcccccaaatagcagagctttccccccatatgtaacaagcacaaggaaaaaggtctccgatggaaagaacggaggttagagtgcctgtgagtgatgtaacctgccaccaccgccaccgccgccccctacccagtagtgagggggcaggaagccccagaatctttttcccatcaaccccaccaccacccctctgccccctggcccagaagagcagcccagtcaaataaaccacagctctggatgggaaccaggggggcaggtgctacctcctcccccaactttgtcccaccaccagctcaagccccatcccacccccactggaatgacattctcagcctttcctgtgtgtgttttagggagagaggacctcagcaaagctctggacagcttgggtgctggtactcatattccggtctcagtcttagcctcacgacttgctgtgtgacctcgagtgtttcactttctggactttaattttccctggagtcgtgaatctttccgatttctttgggctgggactctaagctcaacgtcaaccccattgctctagtagactctagagacctgtcctctaacaacaaaaacaaaccccggggagagagaatcctgttcccgttcctttctctacacctcggggcttctagagggtggccacgggaggtgaagagtgtagcctaacattctcgcaagaggtcactttctcaattgtctgtaaggacagagaggtaccaggctcctcctgactcttcatctgtgggaagctctggatgtgggggttggggtgccctacacccctttctcagggtggataccgattcctggggtcagggaacctaggagagacaacccaggaagggctccggagaggtgaaagggtgaggtgcaaggtgggagccaagagggtgagggaaggggcagctatatttctgagaaacagccaggcgtcccagcagcctgcagattaacccggagcctgcggcttcacagctctccccttctgccgcccacgccgcccagcgcctcttgggggtctgcagcctcgacggggcggtggccgctgcggacacgcaacagatctggggaccgcggaatggagcctgggggaggagggggcggggcgggtggaaggtaagtgcaggaaggcgtgggtcgcgtgacaccccaggggtcccgagcgccagaccccgcctgcccgcaggtaccgcccttgccctccccacccaagtcctcctctcccagcaaagcgggatccagaagtgaaaccgccagggtcacagcccagcgccatcgctgcgccgcgccgcgccccgcccttccgggcactgcagcgaggtaggagctccccgcgcccctgagcgcggctttgaaacgggggaggggcaggggaacctcgggaggtgtcgcctgtagttccaggaatggccgctgggtgacactgcagccgcgtggctggactcgctcgggatcccggggggggggcggggggggctcgcggggcgccaacccgaggctgctgcgcgcacctgccggcacggcgctgcgcggggaaggattcaagatgtgatgtcgctgcagaccctaggaagggtccagggaccgacggcgagtatttgggtcctcgttcaaaaaaaaacgtcaggttgtcagcaattgtgttgtcgtgcaggcgagttggccgcaggagggcagccatggacaccggatcaccttgcacacatctgtgtgggtgggactcccggcgtgcatgcgctctccaactccaacccggtctcaccagcctggagcctctctttattcactaaacccactccaggtcccttcaccaccccgtcgtccagtggtgaggggttgcaggaagaataccaagttcatcccttagacgcgtgggactgggcggctctacagcttgggaggagggaacccaaaactgtgaaatccgtatagaaactgatgattgtgagagagcagggtagaccagggttggcggaggttaaaatatgctggaatccgacggggaaagtaggcaggtacccagaaggaaggggttctaccgtgtgccaggccttagaaactggcaggttaaaggatgcacaagccttccataatcacgtgtgcgtggtgtgcccacagcacgtctcactcccacacagcttttcctcaactccaatcacaaggcccatttccaaccactgataccctgccgctgagccactctgaaagccctcaaaactatttatttatttatttatttatttatttatttatttatttatttatatggaaggtcacaggccatgatacatgtgtagcagaggaagtcagaggacaacttgcagaactagggtctctcctcccaccaggtggtagatgccatccctcatagctcttagcacccccccccatcctcccccagggctggaaaagatggtatctacggtctgcaggctggactggccgtttctaactttctctgtgaccccaggtgggtcactctttctgaggctcagtttcctatgtgtaaagtggaaggcctgtcagtctcagggattctgacctgctagttgacatagaaggggtgagctcccctgcctgggacttcaggtgctgggttttcttgggggggacagattaactcctcagacaggcttaaaggatgactcatcttggtcccccagttactcgtgaatatatttttacagcgagtttgtgtcatttcgctgtcatgtctaaatttcttgtcatttctgtcactgaagtagaaattgagctatcctgtttcctggtccagattttgataactgtcccatgtcaactcatgtgttcttgtatttctgggaaatgagtttgatggaatcaaagttgtttgattttttttttttttcaaaatacaatctacttaggattcacattctaaaaactgttctccaactggaggaggaggtgcaggtgtcgttggacgtgcgttcttttaaggctcccgttcagtgaagggatgaaactctgggaaaacacagcctggctgagcagtgggcacacttgcacagtacagaactcactctggaagttgaaggacgggctggagagagaagacagactcggggctgcgtgtcccttcccttccaggctttctgagtgagggagactatagggacagagagcagatctggggactgcagagagggcgaagaggttggtagaaaacaggggcgtgagggaagtgagaccactctcccctgtggcatccgtctgtcagtcaggactcattgtccaccaactgctgactcgtcttgctttggtttgtggagagaagggaggtggtgagacagggtctcatacagcccaggctggccctgaactcttcttcctgtagctgctgccggagtgctgagattctaggcatgcatcacaggtcccagatctaggctgtcagaaaagcccagtcccttggaggagggggactgaagagatggcccagtggttaaaggcatgtactactcttgtggaagacctgagtttggttaccaacatccatatcagcacacagctgactctaactacagcttggagggatccagcgcccccttctggcctccttgaacatttgcgtgcactcacacacatacttatatacacacagacataatttt

SEQ ID NO: 1106 - DNA, 1758 bp, Mus musculus
cggccgcggagcctgagcgacagctgcagcccgcgcggcccgcggcgacatggaagagagcccagacgctctgaatgactacagcttgcccaaacctcatgagatagaaaacgtggacagtagagaagccccagccaatgaagacgaagatgcaggagaagattcgatgaaagtgaaagatgaatacagcgacagagatgagaacattatgaagccggagcccatgggagatgcagaagagagtgaaatgccttacagctatgcaagagaatacagcgactatgaaagcattaagctggagagacacgtgccctatgacaacagcagaccaaccggtgggaagatgaactgcgacgtgtgcgggttatcctgcattagcttcaacgtcttgatggttcataagcgaagccataccggcgaacgcccgttccagtgtaatcagtgcggggcatcttttactcagaaaggtaacctcctccgtcatattaaactgcacacgggggaaaaaccttttaagtgtcacctctgcaactacgcatgccaaaggagagatgcgctcacgggacaccttaggacacattctgcaagtgtggaggcaagacacatcaaagccgagatgggaagtgagagagctctcgtcctggacagattagcaagcaatgtggctaagcgaaaaagctcgatgcctcagaaattcatcggtgagaagcgtcactgcttcgatgccaactacaatcccggctacatgtacgagaaggagaacgagatgatgcagacccggatgatggaccaagccatcaataacgccatcagctatctaggggctgaagcccttcgccccttagtccagactccgcctgctcccacctctgagatggtcccagtcatcagcagtgtgtaccccatagcacttactcgggccgatatgcccaatggggccccgcaggagatggaaaagaaacggatcctcctgccagagaagatcttgccttctgaacgaggtctgtcccccaataacagtgcccaggactccacagacaccgacagcaaccacgaggatcgccaacatctctaccagcaaagccacgtggtcctcccccaggcccgcaacgggatgcctcttctgaaggaggtccctcgctcttttgaactcctcaagccccctcccatctgcctgagggactccatcaaagtgatcaacaaagaaggggaggtgatggatgtgtttcgatgtgaccactgccacgtcctcttcctagattatgtgatgttcaccatccacatggggtgccatggtttccgtgatccctttgagtgtaacatgtgtggctatcgaagccacgatcgctatgagttctcctctcacatcgccagaggagagcacagagccatgttgaagtgagcatctgtcctcaatgcgagggtcaacattgttttttaaagctgatggtagccttatccagtagactgaactcaaacccacagtcccacccagttctgttagctctcaatcatgtccacatgaacagtcagggaaataactgtcttcattcagaaactgtttgcagagctatcatgttactctgtgaaacctcccttcccatcagttgagtttgatgggatttaaaagccaaagaagtatctggttcattatcttttgtagcaatagacagccatctactggagctcccggccaattggaacagtcctccgtgggccgcaggagtcattcactggaatacagcagccatatgtgga

SEQ ID NO: 1107 - protein, 461 aa, Mus musculus
ATAAARAARGDMEESPDALNDYSLPKPHEIENVDSREAPANEDEDAGEDSMKVKDEYSDRDENIMKPEPMGDAEESEMPYSYAREYSDYESIKLERHVPYDNSRPTGGKMNCDVCGLSCISFNVLMVHKRSHTGERPFQCNQCGASFTQKGNLLRHIKLHTGEKPFKCHLCNYACQRRDALTGHLRTHSASVEARHIKAEMGSERALVLDRLASNVAKRKSSMPQKFIGEKRHCFDANYNPGYMYEKENEMMQTRMMDQAINNAISYLGAEALRPLVQTPPAPTSEMVPVISSVYPIALTRADMPNGAPQEMEKKRILLPEKILPSERGLSPNNSAQDSTDTDSNHEDRQHLYQQSHVVLPQARNGMPLLKEVPRSFELLKPPPICLRDSIKVINKEGEVMDVFRCDHCHVLFLDYVMFTIHMGCHGFRDPFECNMCGYRSHDRYEFSSHIARGEHRAMLK

SEQ ID NO: 1108 - DNA, 118931 bp, Homo sapiens
  misc_feature (1)...(118931): n = A,T,C or G
cagatgtgctactccaaaataacacatcttgatactccagctctcttttgagaaagaaaaaaaaatcacatcttgaaataactaagaatctcataatctcagtttaaaaaactgaaaccaaaaatcaataatacttaaaaaatcaatattattaatactttatattcgttttttaaaaaataatttttcctccttagaaatgattttattattgataaatattcacaagatggagaaataggtttttaaagaaacgtttcaatataacgaagtatttacaaaaatgttttaaatagctttattgattttcaaatacttcctccttggctgagggaggaagatcacttgagcccaggagtttgaggctgcagtgagctatggtcgcaccactgcactccagcctgggtgacaccctgtctctaaaaaaagaaaaagacaaatacttcttccttaccatgaaattctcacctggaggatattatgattagtggtatcttcacagtcaacagatccattgcaagcacctttccaccccggcgcaaaaggattaactgaagagaaaaaaaatgatagactcacaaagggattctgaaaagttccaaacatttcaataaaggtccaagtgctgaattccatgtgcatgcaggcacatgtttagtccagctatctaatcctagtaataaaacaaggtgcacaatttgaataatttatacttgatggtttcactgcatctgggggctaatgtaagtaactacaaggctttaaaatgaatagaaataaatttggtttgattattcacttttactaagttttcaaaaatacaatttaaaattctgtaagaagttataagtgaaatattagctgcataaaggctgtattaataaaatattgatttttaagaagcaacaatatgtcatatttgaaagtaattaattagtgtgttaagttttaaaaccataaacaggctaaggtcaactacatactttagtgcttaacaaacatgtaagacctattacttttaaaatatcttatattaatatggtaattttgtaatctattatggttcaggactaaattcaaaattaaagaaattttaaaaattttaccttgaaatgctataaatagctcatgtatgaggccatgttctggaatttcaacagaatggcatttatatgatggctctatgacatggcatgacaaatcagaaattagactatccaagattttcttcagcactctaaagaatacatcattgtatctccctatacaagaccttgtggtaaaacgtacagccatctgatatgaataatcaggttcccgataggctttaaaaaaaaaagaaagatgagagtgaaaacaatcgtacctagcattaatttcctctaccaaacaattttcaaatactatgtaatactaaatcccatcaatcttgcagtcagcatagaaacataacgttttatcagttagtcctcacaaaaatacataaaactattaactttaatgaaaaatgttattttcatctgatacattatctacttggtacaacaagagaaatggcttctgtgggttggctatacagataacagtatcaagaaaaagaaagactttttggggagggccttaattcacagaaattgtcattgctgtcagcacaacccagtgaaaggatcattaacttgcttttatagaattaaagatcagtttttaaattacctgctaaattgtgataaagtagatgcgcttacatatctagatagaggcaagtagggagctgaaagaagattatttaggataaactatcttgatgtcaacttaagagtttgcttagtcaaatacatcccaaaatattttgtaagtcataattggtgacagtcacctattacagactcattttcattaaatgaagaaaccatacacttaattacgatccaaactaaatgtataagttaaaatgtgcctaaattcttaccaaagaccataaagtcatatctctttttgactgttttttcttcttgagtttctgctttaacagtcttataagaaagagtacatgtgtaaagtccagacaaaggctccaaaaaatctttcaccatcagctgtccagtttcagttatatttattctattatttcctaaacagaatagtaaattacttatttaacatataacatatcaagcattatttagtacacttggagttacaaatagatacaaaaattttaaaaattaatgaactatctcaactttaaggatcccacaaaatcttaattctgtcatattactctgtggaagactacatgagataagtacacttttgaaatatattttggttttctttgtttcttggcatctagtttcaattggttcatcccagtaattcagaaaaagagattgcactgctctgtactactatacaatttcttcagacaagaaactaattaataatacctatgttccaaggcactctaacatgatgaaaaattatatattagttatttcatctcctattactggtactacaatgataaattttaggttttataaagacctttgaattaatacagctctgagaagcagggcacaaaaattactgcttcagtttttgcataaggagaaaataaggaagtggccaaaatataacatgatttttctaagtagggagcaagagaaactgccattaaaattaaatttcaatttgttctttccaataagtaacagtgattttctaaaaatatgttcacatcattaaaaaagtacatattaaaatcaaatttacctgttaacgtcttttcattaggcccaatccataagtaggtggggtccactatttcttttttagaaagcttaaaatccatacagataaggactggactattttgatgtaactctacatatattttgtctgtgatgaaataaaataatgtataactacattatatagcaaaattaaattaagaaatatactcctaccattttgtgctgaagacacgaattagttcttgttggatttcactattttaaaaatcaatatataacatttagaacgctcgtctgaagtcctttttgcttctcatagtaagttttttaaaactctacactgttagtcacgagtcatgatatttttccatattacacttttgtttataaaaatacacatgatatatttaaagttcattttaatgtacagattcagaactcactcaaatcataattttttggagggttggtggaagcaattaaaagttcagaaaaggcctgggcacggtggctcacgcctgtaatcccagcattttggaaggccgagggagcggatcgcttgagtccaggagtttgagaccagcctgaagaaaacggcaaaaccccctctctactaaaaatacaaaacttagcttggcgtggtaatgtgggcctataatcccagctacccgggaggctgagggaggagacttgcttgaacccgggaggcagaggctgcagtgagccgagactgcaccactgcactcccacctgggcaacagagcaagactccctctcaaagaaagttcagaaaaagacttcagcaaaactattctaaagatgatcagctgggagcggtggctcatgcctgtaatcccagcactttgggaggccaaggtgggtgggtcacctagctcaggagttcaataccagcctgaccaacatggtgaaaccccatctctactaaaaatacaaaaaaatttgccaggcatggtggtgggcccctgtaatcccagccacttgggaggctgaggcagaagaattgcttgaatccaggaggcggaggttgcagcgacccgagatcacaccactgcactccagcctgggcaatggagcgagatgctgtctttaaaaaaaaaaaaaaaaaaaaaagattggctggtgctgtggctcatgcctgtaatcccagcactttgggaggctaagacgtgcggatcacctgaggtcagaagttcgagaccagcctggccaacatggtgaaaccctgtctctactaaaaatacagaaattagccaggcgtggtggcgcacgcctgtaatcccagccactagggaggctgaggcaggagaatctcttgaacccaggaggcggaggttccagtgagccaagattgtgccattgcactccagcctgggtgacagagtgagactgtcaaaaaaaaaaaaaaaaaaaaagaaggaaggaaggaaagaaagaaagaaagatagatgatcatgatcaccctaagggaaacctgatgtttaactgtaaattttctccattgggaacaataattaagcctatctgggcatattaggaagatgtgtgattacttcttgtttctggtttggtggacagaacgatggtatgcttggaatcactgcaacccagaaagatattaattttaaagcctactgaatgccaggctcataaagacaacgtcctacaatttggttgggggtcggggagagaactcaaacacagaaggagtctaaacatgacaaattctatcaactggctcaatttatctaaaattagctgtgtaactaattttccttgggaaagtttcactgcagagataaaggacatttgagctgagccctgaaggatgcgtgggagtttttccagttaataaggggaggattaaagatattccaaacagaaggccttggaaatcactcctttgcgtgggtttcccgcgttgcaaagcagcagagacacctggaagtgagatggcatctgagagagagatctggaataaatcccagccctttgtgagctgtaaggctttaaagcaaggcgacacaatagggatcgctgtaaggatgaaaaaatgcgaccgtcgtgaactgccaagcagatgcttagtataatagatgctcaataaacgctggctcgttccccttctctccaggaagctcttccgggaagagcttcgcagttccggcccctccaatgggcccgcgtgtgcagaggcccttattacctggctgtcctgtcttgccataaatgaagcccttcttattgaataaggtaaaacgcgggcattggactgcggaggaaataaaacactgacttttagttagaagaggagcagggttcagagtcgggcagggcagggcgaggcgaaggaggcaggaccgggaagctcgggcagagggagaggcctggggaccgggtggagggagccccacctcctgtgaggcaccagagcaccgcggagagtaggacgcacgttcgcatcatcgctcaggggctggcgtcgcaggaggcgtcgagggacagactccctcctacctcagccctggcccaacacctccccacctcctccacagtgcggagcagaacgccggggtcgcctcccctacccgtccgtcgcaacggcgggagcggacgcgcaggagaacgcgtgcgtgcttcgattctcgcgcgcgggggcggggcgacggcgctgcaggcgatcgccagatcctctggcgcccatgcggcacaggcatgcgaacttttcgcgcctcggtctcggtgccatttttccgagctcctggctccttgctttctgagtggcgacaaggcaagaagataataaaggaaaagaagccactttgtcgcgttccgtggatttcccattctatgagaagaaggaatcaattagagaacaccgctagtccataatacctttgtggagtatggctataatgctattgatgagaaatccacttataagtgactgatgaagctaagtcttttgacaattactctcatgtgtatcagtaagtccaatgtggattttctaggtttctttctcatagtactgagatcgatgtccatctctttaattccactcgttcttacctagttattattaacaataaagtcggagcatagagacatattgaacaataatggcctctggtcttacgatctagataatgttctatatcatgttcagtgtagtattacgtgagtgtagtagtgctggtgcannnnnnnnnnnnnnnnnnnntgcgtgcttcgattctcgcgcgcgggggcggggcgacgggcgctgcaggcgatcgccagatcttctggcgcccacgcggcagcaggcatgcgaacttttcgcgcctcgcgtccggcgccattttcccgcgctcctggccccttgctctctgagcggagcggaaggcaggaagagaataaaggaaaagaagccacggtgtcgcgttccggggattccccagtctaggggccgaagggatcaaggagagaacaccgcgaggtcccaaggaccgtggtggggtagggcggctaggggatgcgatgaggaatcccctaggaaggggacctgaggaaggcagagacttgtgacaatttcctcctcacgtgaagcagaaaggcccgcgtggggatttcctacgcctctcttctcatgaacgctgaaactgggtgtcgaatctctttcaaactgacacgcgatttttacctaattgcattctttaccagcaagaccaagacccagaagagccactactgagccaagaaggcgcttccgggccttcccactctagaggaacgttgaatcttcattttcacttcaagtatgaggcgatgtgagagacctcccccagtgcaaacgtatctaggttgatgaagtgaccttgctttaaaaatgggcccaattgtaaggcccattggccttttctgtagggatggagcccgattggccttttctgtagggatggatgactagtcaagatcggggagctccaaaggggatcatgcccgcgtctttgatggttccttcttggctactagtttggtggcccgaaaggccctgtgtgttgtctgtttcttagcagcgggacaccactctcagtagtggttttgagtaggctggttagtagagagagcccaaggttcagacagggtgcagaatggttattttgggtgagatcaagagttttcggttttatttcctttgagccgagtcagtacttggactctctcatatggtccaggagcaaactttgtcagtaatttcatttttagtcactgttaattttacctatatagcataagccatgaaatgtgactcagtgagtcagatccacccattttcagttaccatgtctggatacatggtctggtctcaactgttctcttcttaaggtgatgataatgaagacagatttaggcattatctttgattccctacaagttcttcattccagttttagtcaaagtacattatatatccacagtgtgttttattgactttttggttactgtaagtaattgatagttgtaaatcctgtgtgataaactaaatcctatgagaggagacttaaccaaatgagtaatagttgtcaaaagtacccatccactctttttatataaactttttattttagaagagttttagatttgcagaaaatttgcaaaaacagtacagagagtttttacatactccctcccgattttccctattattgacatcttacattggtatggtacatttcttacaattaatgaacggatattgatatattactattaactgaagtccaaactttattcagatttccttagttttttactcaatgtcctccctacctcgtttgtttttttgctccaggatctcatgcgggatcccacattacctatagtcatcgtatctccttagattccccttggctgtgtcagacttttcttgtgtttgaaggtcttgacctggctttaattggtgaggtattttgtagaatgcctctctactggaatttggtgtctttctccatattagactagaattatggattcttaggaggaagattacagagataaaatgacattctcatcacatcatatcaaggggacatactatcaacatgccttatcacttgatgttaaccttggtctgctggctgaggtactgtttgtcaggtttctccactgtcaacttattcccctgctttcatactatactcttcggaaggaagtcactttgtgcacccacacttaaagagtggggatttatgctgcatctccttgaaggtggagtagctacataagttattttaccaattcacttttaatccccttaggtatcactctcgggagtccgaaatactcagtattgaactatttacagagtactaacacgttccactgtcaaatatacagaagaacattgtaatggaaaatcataaagtttccttacaactttttttttttttttttgagacgaagctcacctctgttgcccaggctggagttcagtggcaagatctcggctcactgcaacctctgcctgctgggttcaagcgattctcctgcctcagcctcctgagtagctaggattagaggcatgcgccaccacgcccagctaatttttgtatttttagtagagacagtattttgccatgttggccaggctggtctcgaactcctgacctcgtgatccacctgccttggcctcccaaagtgctgggattacaggcgtgagccactgcgcctggcctacaactttttcataaccaaataacttttcatcctcataccatccctgtgaaattttacagttcctcttctgctacttttgatgtgctatttttgcttttagaaactaacaaacaacaaatttcccctttcagtactaaaattagacctagtgtttagagtatttctccaaaattgacatcctgcagaactcccaactcatacagttatagagatgctactgtggtgcttaaagccagtgtagtttttcacccacttgaatatatatacacacatcacatagactgcctataccaacgacatactattgtttaaagctacaattcataaaattacagcatgtatactttaacttgtaagtgtgggtttcttctgatatggacagctgatgcacaaaccctcagccttaagtctcaaatatatttgtatgcactaatataattttctaatagcggtgacagtggccttttgagactcattcgtatattgtcccacacgctggatatctttagaagggctcacctgaacaatgtcccttagacctcaatgtgaagaaaagttctgctttgaaaaacagttttgtggtcacttcccctttcctctctctgcagtcaaatgtgtgctttacctctggacagtagggagggtgttgggagaagatgttgactgatacatatctgtatactaacatctttaagttaattttacaatcttactgcccccaccttccacccttagctctactttctttgcttaattttctggtacatcatatatgtatttttgtaaggtgtgtatttagaagaaggcaggctgggagaaaataaacacactctataaaacactccctctatttatatagagtgggtagtattgcgtgagtggtggcaaataaatcaagcagttcccagagggaaaacaaaagtgagataaatgcttccaaaaattaaaaagttgaattgatagaagtgccaaaatcctttccaactgtctgaaaacttggaccaaaaacttttaccatgtgaaatgaaaaagtgaggaaggaaaaaaaaatactttgaaagaagggggttctcattgatactttccacggctgttatcactgaatctagacaaaaagttccagatcttcctcaatttaagataaacgtctttgaacttcagcttgccaagaaagcaaggctgacccccgaccctccgtgtgatgtcacttttctcatccattatccttctaaaatagacattttgagacaatttagtgatgcgacatttccatcctgtcggggttccttgggtttgacattcgaaagggggctggaggcgcggaacccgcggcactccgcggccagcgtcctttaaagccgccgccagccagcgccgctgtaaccccgcgcaccggcaggtcgccggctcctgcccttttcagtctgcgccgacgcggctgccggatcccggggactccccgcgccgggaatctcccgccagctgcgcgctgagtccaggcgacggcaggagcacgtggagaggccgggtagccacagcggcagctccagcccggcccggcagcgacatggaaggtgagcctccagcccgcttcttttctccggggtctttgagaaacttaacctgtgcaagcagtagaaagagtttcttctgaatctcagttttgcttctatttacttcttttgtcaaaagtaaatatgaggtatttcagaggacaaagcgcgtcggttctcttaacgtctctcacttgtccttcccccgccctttggaaagtgataacttcttcgcaattttatttctaaagagttgtcagacatggggggtctaccctacatctgcagaggaagagcacttaaggggtgtccctgaaatggctgcaaatctgggggtggaataatcaacccttttggatattttttccttcatggcctcagtgtttattggaattagactaatctgagtaacttgttttcttccaagggtaaatggtgtcatatgggaaaggtacattttaaagcggttggcatttgcagttcccttggaactcgatcttctaatgagtcttctttacccagcgcaaaaaatcaggttcacattaggagtttcatatgaattaattttgaaagtcgtaacactatccttgcttctcaaacatttttcattctgtacttccttgggatacctaaaatttcacactgctactgtaaactcttcaatggtcttttcaacaagtgtttctaaaaccttgaaaatggcaaatgcatctcaactcggggggggatggtgggattaagaaattcagaatttcattctattaaaaatgagatattgacacctaactaaaatgttactttgataaatatgaagatcgtgggtattttcttcataataatggaagaatctctaattaacaatgaactgatctttggcagctttatttctagagtatataaagttgttaaaatatcaaaaactttatgcttttaatttttttaattagggcttgaaaactttaaaaattttgcatttttaacatttaaataatggtttattgaagtgtaatttttaacaaaggttttattggccaataacaaggaaaaaaagttgggctgttgtatactatgggaaaaataatttttgaaaagctcatatgctttaattattacaaatgattaatttgtttttatgaaattataaatcagtactccaacactatttttcctagccgtaaccataccacgtatcaaggataatgtacagaatcatgtaaatccatagaaactggagtatttctctataaatgttaatacttccaaattcatttatttaatgtgcaataaagaaactaaatagcatatcttaggttattggtgtactaacacagatgtttaataagcctgaagactcccttaagaagaaaagaatgaaaacttgtgtagaatttaatttagagtgtgtagactataaatggaaagagaatgtagatcaataattttttaaagttgtgtttacatgattagattaaatctataggtccatggagatagatagtatagattatgcttaatgaaaaaactttaacatttaaattttaaaaagaggttaattatatgaatttggctattttaatgtcaggtccttgcgtatagagtatttgatgtggtaaaatatctggttcattatagctacccaaaatagactaatctggcccatgtttttgatatttaaaaaatttttatatcatcttgtggttttgatctcagtctagattagagatttggtctatagtgtatacctctcttggcaatgtaagaaagtagaatacttcatggaatacctttattttctgcccaatttgggggtcacattgattcataacagtttattgtacaatgcaatactgtatatcattccttcagcatataaagtcatttaacaaattcatttatcttttaattaatttattgagactttctatgtatgaagatgtcagatgaataagcttttgaaatagaaatcttgtagaaatgaagatttaatgaatatactaaaatcagaagctataactttttaattttctcacaatctgtgaccttaaatattttctacccaaagactgtttatgaatcactaaattttattatttgtactataacatctcttctgtctgttatggtcgggaaatgaggtggttcacaaacatgaatttcacaggtaatggcagacttcttatttaatgtaaaacatttttatttttaacaatattgagtaaagatttttctaagtatatttattacacagctccctgctttataagcaaggtacataagagataagtttatctcggcaactctgagttactgttctcaccatcagatcatatattattccataatatattctcacaggggttttgagctgaatgcccctacaccaaacatacctaggatattgtacaatttttgtctccttcttgatgtcagcttatatttcttaccacatagattttgtggtagtagggttttgtttcaggtccctttccatgttctggatggctgagattaacagagataaagcctgtagatgatggaatctgtttgccctccattgtgagcgtatggaggatgaaatgcgaaggttttaagaaacaaaagccacagaaaggccgtggcgtcctggtagaacataatttttcaaaattcctgtttgtacttcctttaatccagtatgctatttcatgcttccatgtctttgctattatgttcacccattctctacttgcttatgcctactcatctttcaagactctgctcaggcatcatcgccatgaaggctctctgatgaccttcttctgatgacctcctcctagtgccttctggtgatcacccctacccagtctctcatgttccttcacctcagctaagggcctctcctttctgtgtatacttctaccacattgtgttgaaattatttattgatgtaggtgtttattccccctctggtctttaagcttctggagaacagagactgtgtcttgtttttgtacactgaatgcgaaggacagtttctggttcatagaaggccctcagaatttgttgcattcaattaaaatagtgctgaaaaagtactttttattatgtttattgtgatgcattttatttaaataaatttttaaagtaggagattggggctagtaattctttgataaagctcagtaattttttaagcacttaaactgtataattgaaaaagaaagcttggaaaacaaaaatgttattggatattttttgctagactgtcacttaaagccaattttaacaaaattagatttagggggtacatgtgcaggtttcttacataagtatattatgtgatgctgaggattgggcttctattgatcctgtcacccaaataatgagcatagtgtcctataggtagtttttcaacccttgccctcctcccacccttccccattttggggtcatcagtgtctaatttgggggtcacattaattcataacagtccatgtgtacccagtgtttagctccccgtcataagtgagaacatgcggtatttggttttctgtttctgtgttaattcactaagaataatggcctccagctgcatccatgttgttgcaaaggatatgatttcattcttttttgtgtaaagccaaattttaactgttaaatttacataagcagatttcaggatcgcaattagtccattaaaatatccattgaatatgagcagaaatttgttttctcagtcagtaagatatagatgatgccataaaaatagcatacgctttcaagtgatactttaaaaatacattgttataaacttttcattcatatataaatgtatatacttacacttatttaggactaaaagattattgattattggtagatcttttatcagacatccagtttttttttttttattattatttttaaagagatagtccttgctctgttgcccaagctaccacaaactcctaggctcagacgatcctcctgcctcaaccttctgagtagctaggactacaggcatccaccaccataacctggtaatttattgtacaaaccgccatgacctgctgatttattatctttcattttttgtagaaatgggggtctcactatgttggtcaggttggtcttgaattcttggccacaagtgatccttccgcctcaaccttcccaagtgctgggattacaggagtgagccactgcacctggcctagatagatgtccaatgataattggctcatatgtcaagctatagttccagaccatgtatgagaagaactgagtgattaacacagaaacttgcctatagtaggtgctcaataaatgtcttttgtcctaaggattcattaattattttgaaaagagaccctacacatcacaaggccatagaatgtactctgctatttagcctttattaaatttagctccatattaactggtatatttatgataattagaaattataaggatgaggccaggagtggtggctcacgcctgtaatcctagcactttgggaggctgaggcgggcagattgcttgagcctgggacttcaagaccagcctgggcaacatggtaaaaccctgactctacaaaaactacaaaaattagccaggtgtggtagcacatgcctgtagtaacagctacttggaaggctgaggtaggaagatggcttgagcctgggaggtcgaggctaccgtgagccatgagcatgccactgcactgacatgagcatgccacagcctgggcaacagagcaagaccctgtctcaaaaaaaaaaaaaatcataaggatgacaccaaggccttttggatcactaaaaaaaagatgcaataatgaaacaataattataatttatttataatatatatagattgtttgaaaagtaatctgtgtataactttattaattaatattactatataactcatcaaaatacttttatccctagtgattctgaatgaggttattttttcagtctaattgaaatctggtttttgcatccaaaattaaaagttttttttttaattaaaaagttacttaaaaaatttaagggctgggcacagtggctcacacctgtaatcccagcactttgggaggccaaggtgggaggatttcttgaggccaggaatttgagaccagcctgggcaacatggtgaggccctgtttcataaaaaataataataaaataaaagtaaattggcctggtgtggtggtgtgcacttgtcccagctacttgggaggctgaggtgggaggatggcttgacctgggagtttgaggcttcagtgggctgtaatgacgccactgcactccagcttgggcaacagagtgagaacccatctcaacaacaacaacaaaaaatgtaagtccaaagtggtatacagtaaatgaaaataatatggaattaccgtattatattaaataccaataccatatgaaaatattatgttagatatgtgtccaatccaggagatatttaaaaactgggtacttgatggttacaggcgcctgtagtcccagctactcgggaggctgagacaggagaactggttgaacctgggaggtggaggttgcagtgagccaagatcgcgccactgcactccagcctgggtgacagtgtgagaccccatctcaaaacaaacaaacaaacaaaaaactaggtacttggtaatggatatgaaacaaagtgcattactctttacttattgtcagtacttaaaatcagcttactgagtgattttttataacagtggaattggcaatatgtcacaaattgtacttagtagtgttcttagagatgaaatttttggcagattaggttattgtgggtttacaaaggaaacttttctttctttccttttttttaatagagacatagtcttgctatgttacccaggctggtcttgaactcgtgagcacaaaagattctcctgccttggcctcccaaagtgctaggattacagatgtgagccaccaatgcccagccaatgaaggaaacttttaaaataagaaatggaaaacatttcaatactgtcactcatgaaacagaacaaaactattatttttctactctgaattatctaaggattatgcaactaggtttcttgtttattttgttgattaatacacctatagccccttctagactgttattttccaaagtttagggatctctctctctctcttttttttttttttttaatttttgagatgaggtctctctacattgcaggctggtctcaaactcctgggctcaagcgatcctcccacctcatcctcttgagtagctgggactagaggcatgtgccaccatgcgtagctggggatctttttataatcggtggtaactagtacccaacccagtccccagcacatagtaggcctgtagtcatatttgtttaataaattaatgaatgagttgcctgtgtgtttggtcatttgactcttttcttgcccagcttttatagtaaaggggggaaggaaaatagagacattgaaattggtaaattttgctggctaatttgttaaaggtactgttaaaggtttggtagaagagattgaagtattggctaaatccaatgcgtgaatacggccatttttctaatccatgccccccacaaaatacaatgccttctaacttttggctttatttaataattttggtacattttttatttcagtgaagcactgcagtttccactataaaccttttcttcacaatagatgttttgattcttaaaattgttgaacatcacttaatttgaatactctatcacagcaacatcagttcatttaagaagtaatgtatattagagagactattaatttaccagaatatttggcacatcagaacaatttcctctaggagtttgtggatatgagaaaaagatcactctcacaaacctataacatttttatggatatggaattacatcataactgatggaaaatattgtccagtatgaaaactggaagtaactaatttttataatatataacaactagtcatttttgctgtcatctacctctatctcttagttaagaaatcccttgacctagactgctaaaaatcactaatagttgatttatatgcttacatacagtgtaggcagttccacaaaggtgcttcacgggctaacttgatttaaatttcatttgaatttcacataaaattccagactttaaagtattgaagatgatcagtgtataaatttatcctctgacctcaaaatgaggcttttttttccaaatattaaaattttataaacatgatgagtaaaatcatggtgctgctggtcttttttctcctgtgcatattttctcatgtaaaattattattattattattattattttgagatggagtctcgctcttgttgcccaggctggagtgcagtggtgcaatcttggctcattgcaacctctgcctcccaggttcaagcaattctcctgcctcagcctcccgagcagctgggattacaggctcccgctaccacgcccggctaatttttgtatttttagtagagacagtatttcaccatgttggccaggctgatctcgaactcctgatctcagatgatccgcccgccttggcatcccaaagtgttgggattacaggcatgagccaccacgctgtaaaagttatttaagtaagaatattattaacagtttgtgaccagctggccaacatggtgnnnnnnnnnnnnnnnnnnnnnnnnnnnnnnnnnnnnnnnnnnnnnnnnccaatctgggtgacagagccagactccgtctcaaaaaaataaataaataaaaaagaatattactaactgtcttattccctgtactttattaagtgcctgtaaaggctaaggctcagctgcttgggacatgcttctgtcacagtatagtaatcaactactcactaacaaagacatgtaacatgtaaccttacaagcatttaaaagagttattatatacatgttatattgtacatatacaatatacatgttatattgtacatatacaatatacattgtatattataatacatgttacatcatcatcgtatattataaatcttaaatacttataataaagttggggcatttcttgtttgatttttatgttcagaatgaaataaaatgaatgttaaatatttttgtgattcaactttgaagcaaagattacttatcatcctttctcaagtttctgggagtagtttaattaaaaactgttctgaaataataaggtgaagcactcctgcctcagcctcctgagtagctgggattacaggcatgtgccaatactgcccgactaatttttcagatttgaattagtagggctaggagaccagaatgcacaaacaagtaacagcttctaagtgtgccaagccaatagcatagtatgcacatctcaataaaaggaatttggagattctcaaaggactctatagatatccattgcaaacatcaatgacctagtatggacttagttgccccagacctaaacaactagaacatttttacacgtaatccaatttggggagggagatccaatctatataataggacaaataatgactgaacaagttgatattaggaattcatgtagtgcttatagattttataactactactctacacaatgagacttgatgattacacgatgaccttgaggtatttcactgttagtctcacatttcaacaagagttaggattagacacaaaaacaagacaaaaacttgttttttttgcaacaggacaccgtttataccaaaatcttatgtgggatcagatgcaagtgtaatgttccaaatgagagattggagaaggagcaagagaccactgctaagcctatcttcctcttgccatagatcagccctgtggcagccctctgcaaccctggattccataaaacacattttgaaaatgactgatttagaccgttacatgtttttcctactagtaaccctgtatctagacttgcctcttttaatctgttttgaggattgctgccagaatgatcttcctaaaacataaagttattctcctactcagacaccattttaaatattttttggttggacatttaagatactccacaacacagcttcagtacctttccagtggtatcttctgtcctgtaatgtgactctggactgctgcttagtgttccctgttcaggcattgctttccctcactccccatttttctaatgctgttcttccaactcaacaagtccaaaaatgaactaattttctctccaatccaaaccaacttctcctgacttcccaacactgttaatagcaccacaatcatgccaactgaaatcctcactcatccattatggtctatcctaaatgccatctcctttaggaagccatccctcattctaagaggaataccttccttttctgaaacgtagtgacattttttgctgtctaatgacttctagactgtaactccattttatgttcaaacatgaagcatttttgcatggttttagtacactcaaatttatctaggattggaattaccacctacattgagagaggatgattttttttgtttagtttagagcttagccacttttaccattattattactgtttttcatttgatccatggctttatttccttgttttttaaattttatttccttgcttgtttttttttttaaattgatgcagcatgcatccttctgcatttagctgttgcattcatggtgattctacaaatacgtctatctaccttattctgtcttctggaataattgtgctggtgcatttacattttgaaatatagaatattatttactgtcatttatttcacctttatattacaattgggactttgtttttttgtttgagacggagtcttgctctgtcacccaggccggaatgcagtggcgtgatctcggctcactgcaacctccgcctcccaggttcaagtgattctcctgcctcagcctcctgagtagctgggattacaggcatgtgccaccacgcccagctaattttgtatttttagtagagacaggtttcaccatattggtcaggctggtctccaactccagacctcgtgatccaccttcctcggcctcccaaagtgctgggattacaggcgtgagccaccgtgttccgccttttttttttttttagacggagtttcgctcttgttgccaggctggagtggaatggtgcgatctcggctcactacaaccttcacctctcaggtccaagcgattctcctacctcagcctcccgagtagctggggttacaggcatgtgccaccacgcctggctaattttgtatttttagtagagacagagtttctccatgatggtcaggctagtcttgaactcctgacctcaggtgatccacctgccttggcctcccaaagtgctggaattacaggtgtgaaccaccgctcctggcctgttatttttttaaaataaaaaaaattttgacaagcattgcctacagtttaaacagtatcagcaaaacctatcatcactctgatagcatacattgcatcagtggtgggtcatcttcacatatgtacttaatgtatgttttttattgtttaaaagattttaaaagatagttgaagaacgacagttttataaagtttaattttgatgaatcttgtaatacatttattatacaatataattcaaaagtcagaaatcttcattcttcgttctaaaactatttattgaataccttttttgtgtcacatatgcaaaatactggcaatacagtggtaaaaaaggcagacaaagctttggcccttatggaatttggtaaggtaaggaagacagaccaaagaacaagtaataacaattgaaataattaaatttatgctaagtgctatgaaggaaataaaaagaatgctaatttggagagtaatggaaggaggcagggtcagggacctctcctctaaagaagaggtctggctagtgataggaatgtggctttggctgttttcttcagcacatggatgatattttgttttttttgagatgtagtctcactctgtcacccaggctggagtgcagtggtgtgatcttggcccactgcaacctctgcctctggggttcaagcgattctcctccctcagcctcctgagtagctgagattataggcacgcaccaccatgcctggctagtttttgtatttttcgtagagaacagggtttcaccttgttggtcaggctggtctcgaactcctgacctcttgatccgtccgccccggcctcccaaagtgctggagactatgggtgtgagccactgcgcccagccagtgatatttaaagccaagggaatgaatgggatcacctaaacagagaatatattgagagaagggctctcaggatagtgcctggagacatacctcatttggtcaggtagaggagaagccagcaaaagagaaagagcagtcagtgagacaggaagaaaaccagcagagtgtggtgtaacggaattcaagaaaggggagtatttcatgaaggagtgggtggtcagctatgttgaatgtggctgagaaatcaagcaagataaggacaaagagtgtggttggttttggcaacataacacttgctagtgaccttgacaaaagtggtttctgtggagtggtggggatggaaaccaaatcgaagtgggtagagtgggaatgggagtagaagaagtagaaacgttgattacagaccagtttttccagaagtttagctatgagggtgaagaagagaaatcagtgggatgttgctggagggaaatgtggattaagagaggttttgtgtttgttttgtttttcaaagatgagtgacatttacactatctgtagtgtaagtttattgagagaaaaatgccaatattgaaacattttgaaatcccaatttgcagggaagtttgggaaattagtgatcactgaaaatatcttcatatttagtttatgcatgacatgtaaataaatttctgtaccacgtgagttttaagctatatatggagcccattcagtgagtggttggtgtagatgcaacttataaaaattctgtagcaaaatcatgagaaactcttgaaattcaaagtttttttcaaaagcaagaagatactgttataattgcatttcttaggtttaggatttagatatttggagatgtgtgagtattcaatggattttctttaaattaaggaataacatataattaaagtgcatatatcttttgtatatagcttgattatttttcacctttatacaaccttccagatcaatatatggaacacttgcatcaccttagaaggtttccttctgtccatttattgttaatttccccctttgccccaaattaatcactattcagacttgtatcctcatagatagtttccctgttgttgaatttcatataaattaattttacaatatatgcttttctggggtctagcttcttttcctcaatagatttttgagatccatccaagttgttatatttattagtagttcactctgttttatgatcgaatagtatggatataccacaatttataccttctgatgttgatggacaattgattgtttccagtgtttggctgtattacagacattcttttgcatgtcttttggtgggcctatatgtattcatgtctcttgaatatatacctaggtggccaggcacgctggctcacgcctgtaattccagcactttgggagaccgaggcgggcagatcacttgagcccaggagttcaagaccaccctgagcaacatggtgaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatatatacatatacatatatagtatatatactatatagcatattatatatgtatatatataatatatatatatactatatatacatatataatatgctatatagtatatatactatataatatatatacatatgctaatatgctatataggatatatactatatgttatttatgctatatattatatatacatatataataggctatatattatatgtacatgtataatatgctatatactatatgtacatgtataatatgctataatatgtacatgtataatatggataatatgctatatattatatgtacatgtataatatgctatatattatatgtacatgtataatatgctatatatttatactatatattatatatacatacaatatgctatatattatatatacatacaatatgctatatattatatatacatatataatatgctatatattatatgtacatgtataatatgctatatattatatgtacatgtataatatgctatatattgtatatactatatattatatatacatacataatatgctatatattgtatatactatatattatatatacatacataatatgttatatagtatatatacatacataatatgctatatagtatatatacatatagtatatatacatatataatatgctatatagtatatatacatatagtatatatacatatataatatgctatatagtatatatacatatagtatatatacatatataatatactatatattatatatatacacacacacacacacacccccaggaataccatttctgggttctaatataggtgtatgtttaggtttgatacatattgccaaagagtttccaaagtggttggatcagtttaccctcccactagcaatgtctgagagttatacttgttccacatctttttgttaacacttgctattatcagtctttttaatttttaccattcttttgggtgtgtagtgagtggtatttcattgtggttttaatttaatttgcattttcctgatgagtaattacattgagtgtcttttcttatgtttatcggccattttggatcctctttcctgaagcgtctaaggttttctggtcattcacgtttttttgtttgtttgttttgttttttttcctgagacggagtctcgctctgttgcccaggttgaagttcagtggtgcaatctcggcttactgcaacctccacctcccagcgattctcctgcctcagcctcctgagtagctgggattacaggtgactaccgccccacctggctaatttttgtgtttttagtagaggtggagtttcaccatgttggccaggctggtctcaaactcctgacctcaggtgatccgcctgccttggcctcccaaagtgctgggattacaggcatgagccaccacgcctggctggattttttttttttaattgggttgtcttttttcgtactgattttgtgggctttttttttttttttccaggtgctatcacacctggctaatttttgtattgttttagtagagacagggttttagcatgttggccaggctggtctcaaactcctgacctcaggtggtttgtctgccttggcctcccaaagtgctgggattacaggcttgagccactgcacccagccagtaatgtgtactttgtcagatgtgtaatacaaatactttatcccagtctgtaacttgtttatttttcttaatctatttgatgaatagaattcttaattttaatgaagattaatttatcagcttcttttttgtgactaagtgctgcttatatcttgctaaagaattctttgccaggcacgttggctcccacctgtaatcctaccactttgggagggtaaagcgggaggatcattcaaggccaagagtttaaaaccagcctgggcaacataatgagaccccatctctccaaacatttttttaaaaattagctgagtgtagtgatgcacacctgtagtctcagctactcaggaagctgaggtgggcagattgcttaagcccaggagttccgggctgcagtgagctacgtcatgtcactgcattccagcctgtgcaacagagtgagaccctgtctctaagaaaaaaagaaaaataaatctttacctactccagggtcatgagaatattctgttttcctctagaagtttgattgtttcaactttcatatttagctctgttacccacttcaaattaatgattctatttttggctccagctattttacagttataaaactaggcattttacagttataaaacaagtcttcatttcaatatgttagattcaatcattttaccagaaacatctttttaaagtagcaatgacatgaaatgcccatttttccttttctctctgcatgttcatttggtagcatgtgatatacaaggtaaaattggaatgtatgtttttgtctacaacttaagggtaactgacctttgaaggaaaataacactagacactgactttgttgttttaacaacagttgtcagcagttcacctgtgccccacggtctacagtttcctcattaaacacttaatctaggagaaaaaatggaatgctttatttttttttaaagggggagggtaggaagaactggaacagtaacttggttgtatttgatctggtgtttttaagcaagcagtcttgatgtttcttaacatttaccttagcccaaggaaatagggaaggaagtatttcatgattggagggattactctcactttaatgcatgtctttgtttttgttatcttcctttcccctcaatcagcaataatgcacagtcagttagggtgtttgaaattaattggatctaaaatttcttctagttctggccttctaaaatctgtaatctgtataggaaggcatttaaaacacgatttaaattctctgaagcaacagtaaaactcaagagacaaatcctgcttctcttcttaatgtgtcactgactttgtgcccttgggcgattactggcctttatgttttttgtcattatttgtatcttggattttgtctgtaaaatggggaaaataataaatgccattgcccctatttatcttccagaattgttatgagaaaaaaagaaatctcattgcactattaggctgagtgcttgatgccacgtttttggagagccacaggcaaacaaaaacgggttcagaagacagctctcaccatggtcaggaaactgggtggtaacatctgagctataacttatcctgtatgttcccagaaagctgaactaggacctgaaatagacatttcagtaaatttgagttcagctacatttaagaaagaatgcttttaactactagagtttttctgaaatggaaaggaataacttctgtattattcgaagtgttcaagcagaggctgtataacccaagtagggggatattagaggacattcaaacatcagatggcagaggaaggagaggtaagctagttatgataataatttcgattctaatatgctaatttcatcggttatagggatcatttttcatcctacagaactgttcttgtactgatggaatttgaggaatgattatatatgatggtgatacggagaactggtaaaggattttgcagaaatgacagcgaacgcttctctgccacatttacagtcccaggtgttaatgttgcaattctgaaaacattcttataatcagtgcctcaatttctaaaacttttaattataaagtaaaagtgaacattttagataagataaactttttctttttaaaaaagaggtatgggtataaaggactccatttactattataaagaaggaatggaatatcaacattcagagatagctttctggcagctgccaggcacctctggtgcctgacagctggcaaactcaatacaggattctttctgagatttgacattttgctttcctttagtgcttatacttcctactgggaaaacagaccatggagtagaaatatgatctctgaaattaagaggaaaattttgttagctaatattcttaattcaatggtaattatttaatagtacagtattagaaataaaggcaagtttataaccattagaattaaaaacatgattgtacatttttgttgctaatgtaaatatttgattttcttcatagctaatttatacttgaactaataggtaaagcattcatatgtgaacttccatgaaatctcaattaactagactcctgccatttccaagtttaaattttatttataatctgccccctttcgttttacagcacatgaaatgttagaaactctgaaaaaaaaaaaaaaaaaaccttggtatcttaaaaaaactaaccggtgagaaaatttatatagtgtcatcgtcaatgaaaagagaatctaaaaagccaaaaacgaatttgaaattatcatctcttagtaagcatgtgatgaagtcttgttttctatactggtagaaaacaatttgagattgctagaatggctatgagtagctatgaatgggagagtgctgtggaacactgcaaaagaaataagctttaacttttacagtctaatatatatgtcagtatctcagtagtagactagttgtgtcctttagaagatgtgttatttaagagataaggtgttaatggaaaacacttatgttttaattaaaccttaaaacatatcaggagattggttatttagttgtggaaagagcaaaaagacaaatgaaataggtattaactagagttttctgctagattacaactctggcttttaaatgaaataagaaaatggttttatctaatgatacccaaaaatcctgatgaaaacatgatgctaagtatatatttgtatacatacatgtatgttcatttaaaaatattttatctggatatttggatatcctgtggtcgatatttttaccctctgaaaagtcgcattaatttttcaatcagtgacatttgtaaagtgctttgtatgaaaggtgctgtctaaatgttttatttctttgattactgcgtcagtgaaaaccgcaactttctcttgaaattccaattgcagggttttgaaagtaaacatagaagtattagtaatagacctagaacagggctccataagctttttctgtaaaggaccagatagtgaatgttttaggctttgcaggtcatatggtctctgtcacaactacttagttggctgatggagtacaaaagcagccatagacaatatacaaatgaatgggtttagctgtgttccaataaaacctttttttttttttttcttttttggagacagagccttggcctgttgcccaggctggagtgcaacggggcaatctcagctcattgaaacctctgcctcccaggttcaagtgattctcctgcctccccctcctgagtagctggattataggcacctgctaccaagcctggctaatttttttttgtatttttttataaagacggggttttgccatgttgaccaggctggtctcgacctcctgactaagtgatccacctgcctcagccttccgaagtgctgggattacaggcatgagccaccgtgcctggcctccaataaaactttattgatgaacactgcaatttgaattttgtaaaatgttcaagtgtattcttctgatttttaaaaaccatttaaagatgtaaaaaccattcttagttcacaggcagtacaataacaggcagtgagccatagtttgcaaaaccatctagtgcgttcatagggatcaacaatagagatataaaacttcacttgttcattcaacaagtatttattcagtgtccatcatgagcagacactagtgtaggggctgaagatacagcaatacaaaacagacaacatcactgttctcatggagcttacattcttgtgggaaaagacagatttaaaaaaatgagtgatggtgatctgggagcctgaggcaggcggattacctgaggtcaggagttcgagaccagcctgaccaacatggagaaaccccatctctactaaaaatacaaaattagttgagcatggtgtcgcatgcctgtaatcccagctacttgggaggctaaggcaggagaatcgcttgaactgggcaggcggaggttgccgtgaaccgagatcgcaccattgcactccagcctgggcaacaagagcaaaaaaataaaaaataaaaaaacaagactctgtcccccccaaaaaaatgaatgatggtgataatgaaaaaattttataaagaaaaataaagcaggtaagaggaaagaaaatgacaatggaagatgacattttatgtagggtaattaggtaaaccttgtttgaataggtgacttttaagcagatacttgaatgaaaagagaaattgagccaagtggcttctaagaggaaagcattatagtcagggggaagggtaaatgcaaaggccttgaggcaggagcatgctttccctgttcaaataacaggagaaatgtagacaattgatgagatttatatttcaacaaaattaacccactccaagattcttccatcatttgccccagatatgtataaacatcagtacaggaaactatatttctatcaaaagcaatatagggactcttcctacttaactttgtagagcattcttttggaaaatatttcaaagctatgttgactgcctacacattaaaaagaccacagtagaccccatcaaatggaaactttttgtggatttgttaggggggactgaagtgtaaagaagttacaaaatgattaattaaaaactaagatgtttttgctgcatttagaaatatttaacaagtttctggtcttcatttgggagttccttcaccatctgtccactcctgtctttgaatgggcttcatgttcttataaataccttgaagtttaggggggaaatacacttcaatctatcttgttgttgtgttttaatttagtagctaataagaacattcatgtgacctgatcacagatggttttcctatctctttttttttttttttttaaaaagacggagtctcactctgtcgcccaggctggagtgcagtgttgccatctcggctcactgtaacctctgccccccgtgttcaagcgattttcctgttatgaatgctaaggtagtcagaatctcatttttctcttcgaaactacactcagttacttctggtgctatttacagtacacaaaggacactttaaaaatattgagagctatttaaatgtcagagggtttaaaatattcaggggaccaagaccttttgcctttagttcaccaaatcaaaagccatctttctgtgtagtgactaaaagatgttcccacatgaaggttgctcatgtgaaagctttgagctagttttcgttctttctttttttttttccctccgttaagaatcttttcagcatgcagttgaaagtttcatagttagcgtttttaaaaaacactatcgaacttacagaaaagttgcaatacagcacaaaaaaactttttttctgcaagtttttaaagtaagttgctgacacggtgctctatccctgtcctatgctttagagtatgtgccctgccttcacaataaaatcatcaaaaccaggaaatcaacattactaccattcaatcctcagaccccattcaagtttctccagttgcttctgtgatgttctttaccacaagatatttcggttcaggatcacacattgcttttcgttgtcatgtctctttcctctccttcagtctggaacagttcttcagtctttcatgaccttgaaacttttgaggattataagccagctgctttgtaaactatccctgcaaattcgagtttggttgtttctttatggtttgatttgtgttttgcatatttggcaggaatatcacagaagtgatgctgtgttctactcactatcagaaggcacataatttttgtttgtcccattactgatgatgaccacatgtaactttgctcagttacagtgatatcgaacaggcttttccattatataggtgctcttttctttcaaccttgtaattaataagtatttttggagagaagcactttgaaactatataaatatcccatctgtcaccacacttttaatttattcatttattaacatcagaatgttaataatatactcatgaatttgtacatgaataatgtactcatgaataatgtactcagaatgtactcatgaatttctgtttttttcccaatgagttatagtctaatactattattattttatgctcccttgtcccagatttggccaatggaaaccccttcaggatgactgctctatacttttaagatatccacttcattctgtgagcacttccttgctttctggcacagcaaaatgttcccgacttatactttcaattctcatgccttagccaccccagtagctagtactacaggcatgcgccaccatgcctggctaatttttgtatttctggtagagatggggtttcgccatgttggccagtcttgtctcaaacacttgaggctgaggcgggcctcaaatgatccacctgcctcagcctcccaaagtgttgggattataggagtgagccactatgcccatcttggagtaaaccatttcttcagggagcctcattcctttaaatggagaataatatttagaagttaatatctagacgctattgtagtttcactgttcctaggtgctctcagtgaacggggaaagggactgtatttatgtatacccatatacacacatttacatctatattttatctgtttttttttttttttttttttttttgctttgttgtcatccaggctggagtgcagtggcaccttcatagctcactgtagccttgaacttgtgagttcaagtgattctcctgcttcagcctcctgagtagctaggactacaggcacacttcaccacacccttctaattttaatatttttttgtagagacagggtctcactatgttgcccaggctagtcttgaactcctggtatcaagcaatcctcctgccttggcctcccaaagtgctgggattacaggcatgagtcacctcgcctggcctatctttttatatatagtagaagccatgagttcatgccagtacatccacttccaatacaggaccacaggcttccatatttgtaactcccttctctcacagaaaaacctggctctcattatccttattatatttacttatttgaccattcctccactatgtaatacaaccagtctcccattggcacttggcatctcctactcagcacagttgctctgcttgactcatttggttttgataatcccgtactgtggcctccactctgtgtggacattcttctcaactgcttgagctctgacagccccatgcaggactgcccctaaaatgtagatgccctcttcaccccactcgagttttggtactttgcactggactactcctggcattgaagttctcctcattccatttagcctctagtgggggctgccagccacttcattccctcttcattcccctcttcattccctctcaggctccagcagtccaggccaggcagtcctcctccctgcatgtcctcttatactgtttgagctctgacttttcatgctgtctgtccctccatgtggaaacttgcctttttttttttgttccagacagaatctctctgttgcccaggctggactgcagtggcactgtctcatctcactgcagcctcgacttccagggctcaagtgatcctcccacctcagcctcccgagtgactgggactacaggctcatgccaacatgcctggctaatttttgtatttttcgtagagatggggtttcgccatgttgcccaggctggtcttgaactcctgggctcaagcaacctgcccaccttggcctcccaaaatgttgggactacaggcatgagccaccacacctggcctgaaaccctccttacctcattcacactgcctaccctgcatggacacactcttcatgctggctggtctccagcagcccaccctgggctacccctattcattgcatggacatttttctcatccagcttggattttgacatcccatgccaagctgctcctttgcgtatttttaaactatgtgtatttcccctgcctttatgctttgttgctaacctctaatggctaacatattaaaagttttaaattagaatacaatatgactatagtgactgtattttttaaactaaaaattggaatatgacctgattatagaccattttaaatcagtacttttctaaatagttttgagtaaatgatcacagtcaaaataaagaacaaaggagagttttaatttctgtaatggaatagtacctcctattgaaccaacctttccacggataagaatgatagattctggacaaaatattaaaaaaattatcacctgaaagcactggaaaaatgaccaaaagcagcctgttttatggccttttatacaagggcaggccccatttcagcctcagagtggatagaaaatccacagttttgacaaaccataacaaccacagcaactgggaagtgaagggagacattctgcagtggagaaagccagagagggcttttttggatataaattctctggctgatccactaatgtgtagagttacactctaaatagcccaactgaggctaaaataactaaacagatttatacttctgcaaaggtgactaactcatcccagtttctttgggactctgaaagttctgtgttctaggaaacccctcaatccaggcatattgggacatttggtcaccccagctgctgcccacaacaggtgagacggagtttgagtttaagccaaggcaagttagttgcaaggtttaaaaagtaaaaagtctggtcaggcattgtggctcaagtctgtaaccctagcactttgggaggccaaggcgggaagattaccttaaggccaggagtttgagaccagcctgggcaacatggcgagacccccactctacagaaaatagaaaaattagctggacatggtgacacctacctgtagtcccagctactcgagaggctaaggtgggaggatcacctgagcccagggaggtcaaggttgcagtgagctgtgattgcacctatagtcccggctactcaggaggcagaagtgggaggattgcttgagcctgggatgaagagggctcaaatcataccactgcactccagcctgggcaacagagtcagaccctgtctaaaaaaaataaaaataaagaaacagtcctctcttcctttctccgccatcgtggtgtgtgcttgcctccacttctcaccatgtcttctcacaagactttcaggattaagtgattcctggccaagaaacaaaaggaaaatcttcccattccgcagtggatttagatgaaaactggtaataaaatcaggtacaactccaaaaggagacattggaaaagaaccaagctgagtctgtaaggaattgcacatgagatggcacacatatttatgctgtctcaaggtcacaatcatgttaccatatcaagctgaaaatgtcaccactgtctggagagttgaacatgttttattgggaatatattttttctctctgaatctcttatgaacgtgttggttgactgcattcagtaataaatatatgagacctttcatttcaaaaaatacgaaaaaaaaaaagaagaaaaattaaaacaaaaaggactgggcatggtggctcatgcctataatcccagctctttgggaagctaaggcaagaggattccttgaggccaggagttcaagacaagcctgggcaacatagtgagactctgtcactacaaaaaactttaagagccagatgtggtggcacacacctgtagtcctaggtactcagtagactcaggcaggaggactgcttgagcccaggagtttaaggttacagtgagctatgatcatgccactgcactcaagcctgggccacagagcaaaatcctatctcttaaaaaaaaagtaaaacaaagattcctacatgcttcagaggaacatatagaattcacaatttatgtaatatatcattcacaaggtccagcatacaatccaaaattatgtggtcatatgaagaagcaggaaaatatgacccatactcaagagaaaaggaaatcaatggtaactgacctcaagatggcatacataatggaactggcagacaagaacttgtataaactatagtaattacacttctgtaattgaagttatagaaggaaaagcgtgggagaatggaacagaaaaaatatttgaaagcatttagagaaaaatgaaaaggatataaaggaaaatatgcttttaataaacaaatagaaaacctcagcagagaaattaaaatgaactaaatggaaattctagaactaaaaattacaatatctgaaaaagaaaactcattagataggcttaacagcaaattaagatgacagaagaaagagtaaatgaacttgaagatatgaaaatagaaattattccttctgaatatcagagaaaaaagcattgtggggagataaaacaacaatgtctcagggaactgtgggaaaatatgaaaagatctaacacacatataattgaacttatagaaggaaaaggggaggagaatggaacagaaaaaatatttgaagaaataatggctgaaaatttcttaagtttggtgaaaaacgtaactgtacagatttaagaagttccatgaacccaagtgggatatatgcaaataaaattacagctaggaatattatggtcaaactgctgaaagccaaaagtaaagagaaaaatcttgaaagcacttagagaaaaggaacacattacctataggaaaacaacaacacaagatatcactgacttctcatcagaaacaatagaagacaggccaggcgtggtggctcacgcctgtaatcccagcactttgggaggctgaggcaggcagtttatgaggtcagaagaccgagaccatcctggctaacaaggtgaaaccccgtctctactaaaaaaaaaatacaaaaattagccaggcatggtggtgggcgcctgtagtcccagctactcgggaggctgaggcaggagaatggcatgaacctgggaggcagagcttgcagtgagccaagattgcaccactgcacttcagcctgggcaacacagtgagactccgtctcaaaaaaaaaaaagaaaaagaaacaatagaagacagaagacagtggaatgccatcttaaaagagctggaaggaaaaaaaaactgggccaggtgtggtggtttatcctctaatcccattttgggaggctgaggtgagaggatggcttgaggccaggagtttgagatcagccttggcaacaaagcaagaccctgtctctaaaaaaaaaaaaaaagttttaagaaaaaaaccctgtaaactcagaattctatatctagtaaaaatatcctataagattgaagacaaagtaaagacatttgcaaataattgaaaacaagaaaagtccctcagataattgcactattaaaaatgctaaagttctttagactgtagggacgtgataccagatcagaactcaaatctttatgaaaaaatgaaaagcaccaggccaggcacagtggctcacacctgtaatcctaacactttgggaggctgaggtgggaggatcatttgagcccaggagtttgagaccaacctgggcaacacagtgagacccccgtccctacaaaagaattttttttaaattagccaggcatggtggtgcttctgtagtcctagttacttgggaggctgaggtgggaggattgcttgagcccaggaggtcgaggctgcagtgaaccatgattgtgccactgcactccagcctggcaacacagtgagaccctatctcaaaaaaagaaaaaaaaggcaccagaaatgttaaatatgtgggtaattagaaagtactattttttcattttaatctttaaaatacaatatgactattcaaagcaagaattagcattgtatggtaaggtttaaagtatatgcagatgtgatacatatgacaactatagtataaaggttggagggtaggaaatgggcctaaatggttgcaagctttttacattttatgtgaagtgtataattttaactctaagaagcctggaaaattaaagatatattttatagtccctagaacagagagaaatagacaaatcaacagtcatatttggagattttaatactcctttttcagcaactaaacaactagtcaaaaattagtatatccatagatctgaatgacattgtcaactaccttgatttaattaacatttattaaacagtacacttgagaactgcagaatacctagaagcagtttctccactacttattgaatctccccctgtttctgcccacctgcctccactcccgcctccaccatgtccatcagggtgacccagaagttctacagggtgtccacctctggccccggaccttcagcagccactccaacatgagtaggcctggtgcctgcgtcagttcctcgagcttctcccaagtgggcagcagcagcagtgtccagggtgtcctgggtgccagcatgggtctgggtggaggctatggccgagctggtggttataggaggcatcacagccatcatggtcaaccagagcctgctgagcccccttaagctggaggtggaccccaacatccaggccgtgtgcactcaggagaaggagcagattaagaccctcaacaagtttgcccccttcatcgcggttcctgaagcagcagaacaagatgctggagaccaagtagagcctcctgcggcagcagaagacagcttggagcagcatggacaacatgtccaagagctacatcaacaaacctccgtggcagctggacactctaggccaggagaagctgaaactggaggcagatcttggcaacatgcaggggctggtggaggacttcaagaacaagtacgaggatgagatcagtaagcatacagagatggagaataaaattgtcctcatcaagaaggatgtggatgaggcatacatgaatagggtggagctggatggagtcttacctggatggcaagcttacaagatcagcttcctcaggcagctgtatgaagaggagatctgggagctccagtcccagatcttggacacatctgtggggctgtccacgcataacagctgctccctggacacggacggcatcattgctgaggtcgaggcccagtatgagaagatcgccaaccgcagccaggccaaggctgacagcatgcaccagatcaagtatgaggagctgcagaccctgcctgggaagcacaggatgacctgcgttgtacaaagacggagatctccaagataaactggaacatcagccggctccagtctgagacagagggcctcaaaggccagagggcttccctggaggccgccattgtgtatgtgtggggagcggtccattaaggatgccaatgccagggggtccaagctggaggccgccctacagtgggccaagcaggacgtggcgcgtcagctgctcaagtaccaggagctgatgaccatcaagctggccctggacattgagatcgccacctacaggaagttgctggagggcaaggagagccagctgaagtctgggatgcagagcatgagtatccatatgaagaccaccaggggctactcaggtgggctgagctcagcctacaggggccttacaagccctggcctcagctatggcttgggatccagctttggctctggcgggggctccagctcctttggctgtgcctgcttctctagggctgtggttgtgaagaagatcaagaccacgatgggaagctggtgtcccagtcctctgatgtcctgcccaggtgaaaggccatagcagcccctcccagcctacccctcccatggcttctccagagcctgtggaggaggccactgtgcaggggagtatagggaacaggagacccacctgaggctcagccctaaccctcagcccacccatggggagtttactgcctgggataccccccttgcccatgcctccagctacaaaacaattacatcatttttttttcctccaaaataaagcctcagccagatctgcaaagcaaaacaaaacaaacaaagaaaaccaacaaaaaccagaacatacatatgtctcaactacacatggcacattcaccaagaacaccagtcttaaaattttaaaaggactacagatccatcacaggtttggccgtccgcccaaaatggggaaggttacccttcaaagtcgttaaaannnnnnnnnnnnnnnnnnnnttttttcctcccaaaataaagcctcagccagatctgcaaagcaaaacaaaacaaacaaagaaaaccaacaaaaaccagaacatacatatgtctcaactacacatggcacattcaccaagaacaccagtcttaatacttttaaaaggactacagtcacacagactgtgttctctgactgtagtgcaatggaatttgacttcaataacaagttagctaaagaattcccgaattcccccaaatatctggaaattaaacacttataaataaccagtggatcacagaagactcgagggaaattagaactgaattataatcaaaacatcagcatttatgagatgcagctaaagcaatgcttacaggaaaacttatagctttaaatgtttacaattagaaaagaagaaaggaataaagtcagtcactaaaatttcaccttaagagggcagaagcagagtaagttaagcccaaagtagagggaagaagcacttttgaacaagttctagtttcactgtgttgaaactagatatatgcctcctaccctataacccagtaattccacacctaggtattgactcaagagacatgaaagcatatgaccacagaaatacttgtgcaaggatgatcatgctccagtctaatcatgagaaaaacaaacacatcccagttgagggacattctacaaaatacctgaccagtactcaaaactgtcaagatcatcaaaacaaggaaagtctgagaaactgtcccaaccaagaggagcctaaggagacaagatgactaaatgtaatgtgggatcctggaagggatcctgcaacagaaaaaggacattagatgaaaactaaggaaatctgaatacttagatagtaataatgtatgaatatatattcattaattataactgatgtaccatactaatataagatgttaataataggggaaattgggtgtggggtatatgggaactctctgtgctatctttgcaatttttccataaatttaaaactactctaaaatttaaaagtttattattttaaaaaggaatatcatagtagtttgacttataaatagcccaaactggaaacagtctaggtgtccatcaataggagaatggataaacaaactgggatattcatatggaatactacttagcaataaaaaagaatgaactactgataaacaccacagaatggatgtatctcaaaacattatgttgagtgaaagaagcctcgggcaaaataatttataccatatgtctgtgtgattctgtttttatgaagttctaaaataggctaaactaatctatggtggaaaaagtcaaaacagtagttgtctctggagtatgtgggtgggaattgactaggaagagatgtgagggagcttttctgggatgatggtaatgttctgtatcttgataggggtttgcattacatgaggatatgcatttttaaaaactcattgaatggtacacttaagatccatgcatatcactgtatgtaaaatttactttttaaaatcttgtaaacagatattgaattttagttaataataatcatgctgaaatgttaggactgaggtatactgatatctgcaacttattttgcaatgcgttgaaaaagctggatcgatgaatggattgagagatgaatgggtggaaacatatgtgagaaagcaaaaatagcaaaatgttaattgtagaatccagagggtgagtaatggatgttcaactgtgcagttctttttttaaaattttttattgatacataatattttacatatttatggggcacatgtgatattttgttacatgcatagaatatataataatcaagtcagggaatttggaatgtttatcaccttgagtatttatcatttctatgtgttggaaacaattcaagtcctctcttctagctattttgaaatatataatacgtcgttgttaactatagtcaccctactctgctgtcaaacattagagcttatgccttctatgtaactatatgttttacccattaactaatctctcttcatcccccattcccacccacacaccctgtctatcattctactttccacctccatgagatcaacgtgtttactgtcatatatgaatgagaacatgtgatatttgtctttctgtgcctgacttatttcacttaacatagtgacttccagctccatccatattgctgcaaatgacatgattttattctttttaattgctgaatagtatttcattatatatatgtacatatatatgtacatatatatatatataccactttgaactctttttttctatgtgttcataataaaatattggggaagaataaagaatatatgaaattatttctaatggaacccactttttgcatattgttcttggtgtaagtagatctctggcagaaagttcttagagtaacattgctgcatcaatatttttttttcatgctccttgaaaggcttttagggagaatatagagaaagagtaatcttgctctgaaagaggaattctgctgttaagttttccgaaatggtatcccttattaaatttggaatgctcaaacctgtagaaatgtaccctaagtagctaatatttataacctctttcttttcagatatacaaacaaatgcggaactgaaaagcactcaggagcagtctgtgcccgcaggtaacatcaggtctttcctctctggaaatatacctttactaaaaaaaataccaaagagagaggaatgtgcttattctggttgcagtaaaaatgctatggaaatgtgtgtgtgtttttttttaaatatggttgtctgttgctgatgaaaaaataactcatccatttagatcatgtaagttctttagcatcttagggccaaacatacactacctaatgttgatcactgtttgtttgtttgtttgtttgtttttgatttttcagctcattgctctgaagacagtttttgttgaataatatagtagcttgtatttgaatgacttgcgatttttactgtagaacagtggtctgcaaacttttttgtaaagggccagatagtaaatatttagactttgcaggccacatatggtctctgtcacgtattattttttgtatttcttacaacccttaaaaaatgtaaaaaccattcctacctcttgggcccacacagaagcaggctatggtcagacttgtacctcaggccatagtttactgatccctgctctagaataaattataaacatttacaataatttatttcctgaaaataacttctgtgtcctccattgattaactcactgtgtgaatcaaagcttacattatattacaaaatttaatttatcactgaaatgcctttttgtgttactgtaacttgtaatcacatctttctttctttcttttttttttgagacggaatttcgctcttgttgcccaggctgaagtacgatggtgtgatctcggctcaccacaaccttagcctcccgggttcaagccattctcctgcctcagcctcctgagtagctgagattacaggcatgcaccaccatgcctggtgtatttttagtagaggcggggtttcaccacgttggtcaggctggtctcgaactcccaacctcaggtgatccgcccgcctcggcctcccaaagtgctgggattacaggcatgagccaccgcacccggccaatcacatcttttaactgaacctaaatctcatattaattgtttaggtgtccactatattttagtcatttcaggcttgagaaaagtgaaccattgtttagaatggtatcttagagttcacagagtatacatcataatatgcagaaattagaaacttcagatattcataaatcaaacactgagtccatggtgaccacattttcaggggctcttagtgatgggttttgtgaaacgtgtttctctttcgctcccgcgtgtgtttggtcatggctcagctgaaaggagtgccactgcagagcttctagttacctccctacttcagcccagcctcagtgccacaggattcagtgtctttgactattttttatattaatgggaactcagcaaatattttattgaagattgggaaggagttagataaaaagagggtaacttttcagttcatttcttctgctatcatctttttgttaagctactatgcctatatgtgaaaataattccagttgcattgttcctttttcttctagtattatcaatatttattatacatttctcttaaacttattttgtaacaagtttgctgtttgtttaagcatgtctttattatgtctgctccctttcacttatgaactttaataacactttgtatttcctttatttaatcctttgtctgagcctaccatgtgttagagttgtgggcttctcttatctatatctcaaagtatgagctccttgaagacataatgacttattcatatctgtagccttgtcaacattcagtaaatgttcaaacaaataaagaaacttggggtccaatatgttttccacagaatcacatttataatgtgaacagaagggaaaaacagaatttggcatacagaaagcttacagatcttcctcctaggaaagcatctttcccaaattaggttatgccagtgtttgcacgcttagtatttctggtcactactttgtcataaatagcaatggcatcctactgaatatcgtgagatataccaatggagagatagtttttctccagaaggaacatgagtgccctttaactcagatgaaagaaatattcaagaaagttgtgtgtattcagagggtacatgaaccctgggcatatttcttttctcttttttttttgtttgagacgaagtctcactctgtcacccaggctggagtgcagtggtgctatcttggctcactgcaacctccacctcccgagttcaagtgattctcctgcctcagcctcccgagtagctgggattacaggcatgcaccgccatgcccaactaatttttgtatttttagtagagatggggtttcaccatgttggccaggctggtctcgaactcctgacctcaggtgatctgcccatctcggcctcccaaagtgctgggattacaggcgtgagccactgcgaaccctgggcttatttctaaacctcaagagttttcatgtatacatcccttttgggtatgtgtgaaggggtactatctgtcactaaaggattgtgtgaagctgaaagttaaatgggggtctacttaatacatatttataaaaatcctttaacgttgaaccacatacttaaaattccttttatcttttagaaagtgcagcggttttgaatgactacagtttaaccaaatctcatgaaatggaaaatgtggacagtggagaaggcccagccaatgaagatgaagacataggaggtgagccgtagtgtgcagactaaacactgatgcctgtagatattgcttaggcttagtgtagagaagaaatcagctctccaaggaaaacttgcaattgtaggtttagttaggagtgattctgttttgttaatttcacaaatatttgcatttcatagttgtaggttatcagcaaattttgagaatttaaggtgcttatccagtgttccaattatattaacttcacttaaaacatgatgtttgactattttccattataaaagtaatacatgtttattgtagaaagtttgtctggggtgttttctgacaccaacaaaccaattttctggttttccgacaatgacttggtgtccaacaattcaattcaattattattattatttttttttgagacggagtttcactttgtcgcccaggccagagtgcagtggcgcaatctcggctcactgcaacctccgcctcccatgttttagtgattctcctgcctcagtctcccaaatagccgagattacaggcgcccaccaccatgcccggctaatttttgtattttttttaatagagacggagttttaccatgttggccaggctggccaggaactcctgacctcaagtgattgccaaactcagccttccaaagtcctgggattacaggcatgaaccaccatacccagcccacttcaattcaattctgattgtaattcctgatgtttgcgtagaccgcacaggttacaggctcagtctcacagtactgcacagtactctccctactttagacaacagtctcaagtaccaggtccccaggttacctgcacttttgtctgacttagctacaaaatcggggactccctccacatgtttaataatttgctaggatgactcacaggacttgttacataactcatttattcattcctttactctcagctactcttcctccttcttactgtttatgcccaaactttcccacctttgggaggaatattaggtttgaccactgcactggtctagatcgtaggcagcaatactagtctagcaagcacctctccctcagtcaactcccatacatacaggatagggttacacaggtacggaactagtgggctatttctaccactaggcaatacatctgcattcaatgttaaccccaattttgccagatggggtaaaggcacagcctgcctcatcaggcccttaggagttctgacataaaggtttaaagctacggttacactttcttgctttagaaatcatctctgtttctggcacttgtaattacagtgctggtattgcaaccactgcatctggtaggaaagagaaagctgatgtgacaatgtagggaaggaaaaaaagaatagtcatcacaccaatatcctcctctttggcaagaattgtatagtcatatcagcatcctcccccacctcctcttccctaatccaccagaaaaacagaggaatctacctagtgggaacactcccttagctcatttcaatgtgacctcacacttgtgcaaatgcataaaccaacccttcacacctataccttaccctattttagatatctatcaaactactactctgaggaggatagctctttgcccattgtttgacattatgggctgtaagtagagtgctccttagtctaaagaaatgtggctcagccattcaaattggtgcaatatcttctgttctggttctttcgtggtactgaccatttgtgtatacaaccaggtaagcaaagccccttccagagtctgtgtttatccccgtcaaaaacaatttataggttgggtgcagtggctcacacctgtaatcccagcactttgagaggctgaagcaggaggatctcttgagcccaggaatttgggcccagcctgggcaacatggtgaggcctcatctctataaaaaaaaattataataatacaaataaattagccaggtgtggtggtgtgtgcctgtagtcccagctactcaggaggctaaggctggaggatcacttgagcctgggaggttgaggctgcagtgagctgtgatcctgctactgcactccagcctgggcaacacagtgagatcctgtctcaaaagaacaacaacaggccggccgtggtgactcacacctgtaatcccagcactttgagaggctgaggcaggtagatcatttgaggttgggagttcgagaccagcctgaccaactggttaaaccccatctctactaaaaatacaaaaattagccaggtgtggcggtactcacgtgtaatcccagctactggggaggctgaggcaggagaattgcttggactcgggaggcagaagttgcagtgagccaagattgcaccactgcactccagcctgggtgacacagtaagactccatctcaaaaaaagaacaaaaacaaaaatgatttgtagcccttgggactaccagcattggctcttcaatgcaatccacttgccaactatgtgtggggtcttccccctggggaatcttccccatagtcacctatagtaactgtctctcttattggcagacataatagtttgttgctattttgtgcctcaggaggtccaagggaaatatgtccaaattcagcccatcttctgcagtggctgtagcatcccccatcctgtctactcattttatggacccacgtgctcacctcaaacacgcacactgtgatacctactaattggttctgatcagcttccaaatctggaaggggggtcttttaccgagcattgacatgtcctactttaatgcacccctcaaattcccatagtgatttccacagggctttgtcccatatgagagtccctttaatatgccaagtttccattgcactcttgccttaccacatggccaggctgttggccattgcccatgaatcagaaactgaaacatatgggcatgtatcactgttcagttcttccatcacttctaggaaaacagcagattattcagctcaccaagctgatttgtttttaccttctttaattacagttgtggtgttccaaacaggatgttgtccatttaccttaaaactaccatccacagccaggcatggtggcttatgcctgtaatcctaacactttgggaggccaaggcaggaggattgcttgagctcaggagttcaagaccaacctgggcaatatagtgagacctcgtctctacaaaacatttaaaaattagctaggcatggtggcatatgcctgtggtcccagctacttgggggactgaggtggtaggatcgtttgagcctgggaggttgaggctgtagtgaaccctgatcgtgtcactgctctctaggctggatgatagaatgagaccctgtctcaacaaacaaaaaaactaccgtccacaaatcaagcatctctttgttggtcaaagactactttatagggcactgtctaagtgatgatagaatccagcagctcctcacatagttccaaagtcaattgtaggggaaaagaggatccctgcccctgagtatatcatcctttcattcctaaggtaccatgattctctataaactatttctatgttattatagaactcttctgggcaatgctctccccattagaacacttctctgacatcacccaagacttcattgatattttaggttttaaaattatttttttgtccttcaatcataagagcaatttcaattaatattcaatagcaggctaataatttcccctcaaatggaaattctctggtccaaaatccaattgttgtcattgctggaaagtactcacaggtttttgccataagccattacccaattctcacacaccaagcctatatttcacctaccctaagtcatcccagggccagataccagtcaaccagagaccatctctatgctttagagcccaccagaattattaaaactagccaatcctaaactgtttacccagccctgccttgccttttccacagaaaccccaattaaggctctgacctaaggtttttcctcattcctcttttctgcctcctgaccaacactggtgctttctcctgtgatcttgcatagcacataataaccacctctctgggacctgtgaatgtgataaacttctttctgggccttgttctaattttctttgtgtccacactgactttaccatatcatatctgacatgtacattcttaagacaccacttaaccgtggcatttaccatgacctggtgtattagtctgttctcatgctgctatgaagaaatacccaagattgggcaatttataaagaaaagaggtttaattgactcacacttccaaatggatggggaagcctcagaaaacttacaatcatggcagaaggcagcttttcacagggtggcaggagagaacgagtgccagcagggaaatgccagacacttatgaaaccatcagatcttggccaggtgcggtggctcacacccgtaatcccagctctttgggaggccgaggcgggaggatcacgaggtcaggagatcgagatcatcctggctaacatggtgaaaacctgtctctactgaaaatacaaaaaattagccaggtgtggtggtgggcacctgtagtcccagctacttgggaggctgaggcaggagaattgcgtgaacctgggaggcagagcttgcagtgagccaagatcacgccactgcactccagcctgggtgacaaagcgagactccgtctcaaaaggaaaaaaaaaaaaaagccatcagatcttatgagaactcactcactatcacaagaccaacatgggggaaaccacctccataattcaattaccccattattcaatcccaccgggtccttctcacaacacgtggggataatgggggttacaattcaagatgagatttgggtagggacgcagctaaaccatatcattctgccctggcccccattcaaatcgcatgtcctcatatttcaaaacacaatcatgcctccctaacagtcccccaaagtcttaactcattccaacatcaacccaaaagtccaagtccaaagtctcatctgagacaaggcaagccccttctgcctataagtctgtaaaatcaaaagcaagttagttacttcccagatacaatggaggtacaggcactgggtaaatatacccattccaaatgggagatattggccaaaacaaagggactacaagccccatgcaagtccggaatccaatagggcagtcattaaaccttaaagttccaaaatgatctcctttgactccatgtctcacatccacgtcacgctgatgcaagaggtgggctcccatggctttgggcagctccgcccctgtggctttgcagggtacagtccccttcccagctgctttcacgggctggcgttgagtgtcttgcagcttttccaggtgcacgacacaagctgtcaatggatctacccttctggggtctggaggatggtggccctcttctaacagctccactacacggtgttccagtggggactctgcatggggggttttaccctacatatcccttctgcactgccctagcagaggttctccatgagggctccacccctgtagcgaacttctgtctggacatccgatgttttcatacatcctctgaaatctaagcagaggttcccaaacctcaattcttgacttctatgcacccataggctcaacatcacatggaagctgccaaggcttggggcttgtactctctgaagcaacagcctgagctgtacctttgccccttttagatgcagctggagcagctgggacacagagcaccatgtcctgagcctgcacagaacagggtgaccctggacccagcccaggaaaccatttttgcctcctagacctttgggcctgtgatgggaggggccgctgtgaaggtctctgatatgccctggagccattttccccattgtctttgtaattaacattaggcacctcattacttatgcaaatttatgcagctggtttgaatttctcctcaaaatgggtttttcttttctatcacattgtcaggctgcaaattttccaaacttttatgccctgcttcctcttgaacgctttgctgcttagaaatttcttccaccagataccttaaatcatctctctcaagttcaaagttccatagatctccagggcaggggcaaaatactgccagtctctttgctgaagcatagcaaaagttacctttgctccagttcccaagcagttcctcatctccatctgagaccacctcagcctggacttcattgtccatatcactgtcagcattttggtcgaaaccattcaacaagtctctaggaagttccaagctttcccacatcttcctgtcttctgaaccctccaagtctctaggaagttccaaactttcccacatttttctgtcttcttctgagccctccaaactgttccaacctctgtcttttacccagttccaaagttgcttccacatttttgggtatctttatagcagcaccccactctctgtggtgccaatatactgaattagtccactctcacactgctatgaagaaatacccagctgggcacggtggctcatgcctataatcccagcactttgggaggctgaggcaggcagatcatgaggtcaggagatcgagaccatcttggctaacatggtgaaaccctgtctctactaaaaatacaaaaaattagctgggcgtggtggtgggcacctgtagttccagctactcaggaggctgaggcaggagaatggtgtgaatccaggaggcggagcttgcagtgagccaagatcgcgccactgcactccaggctgggcaacagagcaagactccatctcaaaaaaaaaaaaaaaaaagaaagaaatacccaagactgggtaatttataaagaagaaaagaagtttaattgactcacagttctgcatggctggggaggcctcaggaaacttacaatcatggcagaaagtacctcttcacagggtggcagaagagagagtgagtgccagaggggaaatatcggatactcattaaaccatcagatcttgtgagaactcactcactgtcacgagaacagcatgggggaaaccacctccatgattcatttacctcccactgggtccctcctatgacatgggattatggggcttacaattcaagatgagatttgggtggggacacagccaaaccatatcacctgggtaatgggcatattcaatgtgtgaatcttgattatcacaaagccagttccacatggcttgcatatgaagcatatcagctgcttcatctggggtattccagttggcattgaaaggggaagtcagatagttccctttctcagggtaaatagaccttataatggctcttatctggtccaccaggtcagctgttcccttaggaatgacctgctctgtgtctggatcatgtgtagccatctgtgattgttccatagtgagctgtggatcctatataaacccaaacatgctcttccactctgaagcatttaaaagccaagatactgcccctaaattatttattcttacaattcattttagtcaaaattctttaggaagctgatggtactgatctacaaaataaagtaactctttcacactataccccctggtttcagtagtttcttggttttgccctcccctacctggactctctttttggtgaccagagatcttagaggtattttctgtttttcccacatattttttccattagaggcagctttgggtctagcatccgaagttcaggcccaccagaatctgagcgtggttcagcatcaaggtccaacccaacactctttttaactttcattttagctgttgcagataacaataaccattggattgtgtatttcacttttttcttattagtttgcatttccttaagcattcagtgaaccagctccccaggagttgggttcatctttaaatttcactggtaacttttacctttagtaactgatcacagcccctttgctgctccttaggtgactatatggccactcaggaatcaaaatttcctcatcccctacccttttattttatccttccaaaccatatgtttctgtgagcctgggctgatctagcaaatcccactccaattctggggtgttttccatccacaaccaaatctctaggccattccgttgttgggtgtccaacaattcaattcaattctgatactaactctgagaattagtacagaccacacaggttaagggctcagtcccacagaccgcccctacttcagacaccagtctcaagtaccaggccctcaggtgacccacacttcttccaacttgggcaaatttgagtgttcccacatccttcctcaggtttagtaattttctggaatgacccacagagctcaaaaagtttctttacttatcattaccagtttattataaaagatacaactcaggaacagccaaatggaagggaggcatagagcaaggaaggggtgacgtggagcttccatactttctctgggcatgccacacccccagctcctgaagctctctgaatcttgttgttcaagaacgtttataggactcaatctccagctccctttcctctctcttcttccctgaggtcactgggtggggctgaaaggtccaacgctctaattaccaggtccttctggtgaacagctccatcctgaggctgtctagtggccccagcctcagctacctcgttagcataatctaaggtgctattgaaaggggctcgttatgaatacaaaagacactcctgcccctgctacttagaagctgaggcaggaggatctagtgagaaaaacaaaacaaaacaaaacaaagcaaaacaatactcctatcacttaggaaattccaagggcttagaagttctgtgcttgatcctgggagcaggaacaaagaccaaatatgtttttgtattataccacagtttggaaagttcattgaaatagaaagaaaaaagaaaaccccacctctatcctaccacccaaagatagtctctaatagcattacagagtacttacttccaggcttttttgtgagttttgagcattatattcacattaatattgctcacattttatagtgatatttatgttgataaatctaatcacttttgctttatgaatgttactctgttactcagatctcatcttaaatgtcatttcttcagaaaagcttttcctgacaattcagtcactattttaacacagccctattttaattcatcgcatgacactgaacacagataactttggagttttgtttagtgtctactctccttccagccttcttgggctatttttttccttgctagatatttacagtacctagaacagtacctggccctactgtggtaggtgtgcaataaatatttgttgagtaagtgactaaatgaaagccctaggtcagttatatgtgtgtatacatgagtttcttaaaggaagaaaagaaaataggctgggtgcagtggcttggctcacgcctgtaatcccaatactttgagaggccaaggtgggcggatttttctggaggtcaggagttcgagaccagcctgggcaacatggtaaaaccccatctctacaaaaaaaaaatttttttttaattagctttgtgtgtgcctgtagtcccagctacttgggaggctgaggtgggaggatcacttgagcccaggaggcagaggttgcagtgagccaagattgcaccactgcactccagcctggacaatagagtgagactccttttcaagaaaagaaaatcatttctcagagtctttttcttttgtcttaaatttcttaagagaccaagaaattgagttatttgtctaaaacttctgagattcaaatcacagcttcaactaacattccagctgtactgagctatacattaatttgtaccagtttttaaccacagagacagaaaaatgctgcctggcacaggatgtggtcatttgtgctgaggaaaggcatatgatgttgtatcagcttcgtgcaacttcttgaaggtgacatccatggagtctcactcagaatgaggcaaatgatagctgtgcctgtggcttgttttttttctgagttacagtttctgagttctggtaggtaataccattaaatttgtagttgaaatagtgatccctatgccactgttggtttgggaatttataatttatgttataaatttactttgggttcaggggtagcctatgagttttatattttcagatagtttgtggtaaaaaaaacagattaaatactcaaacataaacaagaaaccaataatttccattcaacaataggaatttaaaataaatattgtaaaaacccaagtggtgaagcaccttgttaggaacccatacaatagtatcgccttacctccaactacatgtcaatgggttaataggatgtttgtgtaaataaattatttttctcagttgctaggggtctaggagtgtcatgcagttcttgatagagaagatatgatcaatcactctaaataatttgggaaagagaaaagaaacagttatttactttaagcttcattcagaaagaaatgaatacgctaattttgttgttgttttgtttttgttgttgctctgttgcccaggctggagtgcggtggtgcgagctcagctcactgcaaactccgcctcctaatttcaagtgattctcgtgcctcagcctcctgagtagctgggactacaggcatgtgccatcatgcctggctaatttttatatttttaggagagacggggttttaccatctctactagatggccagactggtctcaaactcctgacctcaagtgatctgcccacctcagcctcccgaagtgctaggattacaccactcctggcctgagtaggctaattttaacgttgaaagatcattccattattttgtgattaatctgcaaacagattatagtagtcccccttctctgcggtttcactttctgcagtttcagttccatggtcaaccatgatcccaaaataggtgagttcagtacaataaaatattttgagagagagtcaacaattatgtaccttttattatagtatagtgttgtaattgttctattttattgttattgttactaatttcttactatgccagatttataaattaaaactttatcataggtatgtatgtataggaaaaaacgtagtattcagtcatataccacataatgtttgggtcaatgatgaactgcaaaaacagtggtggtctcataagttaagacctatttttactgtatcttttctaagtttagatatacaaatacttaccattgtgttacagttgcctacagtattcagtacagtaacatgctgtacccataacatgctgtacagtctaagagcaataggctgtaccatatacccgaggtttgtagtaggccatactgtctaggtttgtataaatacagtgtgctctataatgtttgcataatgatgaaatcacctgatgatccactgcttagaatgcatcccatcattaaggagcatgtgactgtatatagggtttggtaccatctgcaatttcagacatccgctggaggtcttggaaagtatcctctgtgaataaggggggactactctactgtactattaacactggcacttaatctgggtcatatatgtttggaaaaggtggttaccaggaccctgcttttataaaatatataatatgatcagtatgtataaattatacatgctaaattataaaagtaatagaatgtaaaaacagcattgcccgatagaagttatacctactgcataataaggtaccactgccatatgcagcacaggaaaacatttaagactagagttaggcccggtactgtgacacaagactgtagtcccagctactcaagaggctgaggcaggaggatcacttgagcccaggcgtttgaagctgttgtgcatcatgattacacctatgaatagccagtgcactccagcctgggcaatatagcaagactccatctataaaaaaagaagactagaattagaattatacttttaaaggtaattaggggaatttagctacaatgtaataattattttaaaatgttagagaattctattctgtttaagtttaatggcagcatttattttttaatgtcatttgaaagattttaggaaccaaagacttgtctggagtgtttaaaattcagaataattgcaatcatgtttaatgtatatgttaaaaaatgaaatatcgtgtgcatctttataagcttccagttcttagaaaattgttttatagaaaatttcacaccctgatggaaacactcactttattttttctcttgcggaaagacagactaatttctaggggaaaaggctttacccaactagagtaagtttggaaaacaaaacaaaaatacttggaaaaaactttaaaaaactattaatattggccaggcatggtggctcaggcctgtaatcccagcactttgggaggcccaggcaggcagatcgcctgaggttaggagttcaaggccagcctggccaacatggtgaaaccccgtctctactaaaaatacaaaaattagctgggcgtggtggcgcatgcctgtaatcccagctactcgggaggctgaggtgggagaatcttctgagcctgggaggcagaggttccagcaatgagctgagatcgtgctcaagcctgggcgacggagtgagactctgtctcaaaaaaacaaaaacaaaacaaacaaaagtattaactttgaacataaatacgcttgcttgtgatcccacagacattgtggtaattttttacagtatattcccaggagcctagtgcaggtattggcaaactttttctgtaaaggaccagatagtaaatatcttaggctttgtgggctatacaatctctgttgcatcttctcaactctgccattgcaaggtaagacaactgtagaagatacataaatgaatgtgagtggctttgtaccaataaaactttatttacaaaaataggcagtgggttggatttgacctgcaggccataattcccttactcctaacctagtgtatacatttattgtatgatgagttaagaaaagatttggcacttgaaaggaacagtgtttgtgtaaccatttcaaaagggcatcagtgaggattctaatactattattttaaaaatcagaaaaatatatatcactaacagctttttatcacatgcatgtatagttgatatagctctatttacataaattaattagacataaataaaaccatatgtagactaaatgttgtgttaccatttagttggttttctcctttattcctgaaaatttaaatctaacaagcactggcaaatatttacatcaactcaagtttatttcctccaggaggcctttttatactatcccaccttccacagtgtggtctcagagctgaatttttaagagtatgtttagttagtacttatttaaacacgtaattatattctgttcgaaattgtttgtgcatgacaaggtttcaccccattatatcataaactttttgaaaaaagaagccctaacctatatttacatctttctaagaatacttacctatgaagtgatataatccaaccagtttggaaagcagaagaaatgaagaaattcagagttctttttctagcctgctcattcactcttatgaacaattattatttctcttcctcttagtgaccaactgtaactatcttcagactgatcttgagccataggaaataacccagagatccccaagtctttatttttgtttagcatccaatgagtgctgggaatatcacagccactttactgaatacaaaagatttgggaccttctacttggatctaaaatgtcagcaagatactgtgatgtcaaaagcaagagttaaaacaattttataaaatatcatgagaaagaatattattgttgcttatatcttggcctatgatcacagagcaactaaaaaataaaaacctctgagtatcaaggctagagggaagatgtgtttcatgctagtgtactgagggatattaactaggtagagataagactcgagatggtggaatgtcatcccagcaaggcaattgtcatgcacaaacaatttcagagagaatgtaattaggtgcttaaattagtggaaaagacatggccttaaggcctgaacgactgaaatagaactcttgcgactttttgtttcagtccttcttcctctgaaattggattcccgtctttgccatttcccacttagaaaatagaaggaaaggttctgtcatgagcatgtatatgttatgagggtatgatgcatttgccgatagtattttttcctctttgaatagctgaggaataaaagttgggctactgaccccctgtatttaacactctactggccccctatttttcagcagcccccatcatccactatctctatttacacaagccatttgttctggagctgctgtaggggtaaaaagtacacacgatacctcgatacccatcaacactagctgtttaccctgcctgagttgcacatttaccctctgtcttagttttccagggcttccataataaattaccacaaactgggtgacaaaacaccagtttgtcacaaagcaacagaaattttttactattctggagggtagaagttcaaaattaagatgtcagcaggaccatgggaagggcctagggaagagttcttttttgcctctttctggcttctggtgacttccagcaatgcctggtgttccttggtcatggcagcataactctaatctctgcctccattgtcacatgggcttcatctctgtgggcatctcctgtttctgtcctcctctagggagactagtcattggatttagggcctaccctaatccagtgtgacctcatcttaactaattacatctactatgacgatatttccaaataaagtcacattctgaggttccaggaggacatgaatttaggagggacactattcaacacagtacacccttcatctcctggctctgtaactaaatatcaaatagacccaatacccatcatgaaatagatttcttttttaattaattgtgcagtggtgatcaatcggtgtatgtatttaattacttccattctgtacaagctatgggtcttgcctgattccaagagaaaagttgaatttgatcacttttgaaaggccttatattttctccattgtgacatcttgtgcagtgtagatgcttagatcaaagataagaactttaattagaaagcttgctgaaaaaaataattcttcttccccttaggagaaataactcccatcttcagtagcttcccatggcatagtctcagtcccttttgaggtgtacaactctttggtgcttagaagaagtacaaactactttgatgcttctgaaaggggaaaaaaaattaagccacatgtgtggtttatggatgctaattaccgccacatttagatgtgtgaagaagggtggctggagcgagctgggagagaccgcgtcagcctcgcttaggcactcgctgaggctcccgcggtactgcttagtacacgcaaatatatgcttcaaaaggaagtgccgttttttatcaaaatattacatctctcaagcccagatcaagacctgtcactcatgggatgcaggggttatcttacaaaatcagcagtgctgtgctgcagaagttcactcacaggggatttctgtaagtgcttaccatgggcagagctttacagcttgtactgtgtcaaacgggtaagttctgttgatgataaaaccaagacatctctccctgaatctttttttttttttaatcacgctgtcacccaggctggagtgcagtggcacgatctcggctcactgcagccccaacctcccaggctcaagtgatcctcccacccgagactccagagtagctgtgactacagttgcatgccaccatgcatggctaatttttttttttctgtagatacggggtctcgctatgttgcccaggctagtctcaaacttttggactcaatcaatcctcctgccttggcttcccaaagtgctgggattacaggtgtgagccactgtgcctggcccttgaaactttttaacagaaaacatctctggattttcttttcttcttttttttttttttcataactaagctgcgtagcacagcaaactaaaaggaatgtgtaggaagatatttgacatctgccaaagagccacagacagttgcaatggttaacagaaaaatggggctgcccactgtccttagtggatcctctggagagttttctcccttctttttgcattctttttatttatttatttatttatttatttattttttgagatggagtcttgccctgtcgcccaggctggagtgcagtggtgcgaactgggctccctgcaagctccacctcccgggttcacgccattcttccacctcagcctctaaagtagctgggactacaggcgcccgccaccacacccggctaattttatttttgtatttttagtagacacggggtttcaccgtgttagccaagatggtcttgatctcctgacctcgtgatttgcccacctcggcctcccaaagttctgggattacaggcgtgagccacttcgccctgcctctttttgcattctttgtctgttaagcagtagtgttggtgcctccttccagctggattaagagaacgcatgaaacacccttatgtgcctgctaactttcatagcagcttttcttgccaagtgagttctgcttctcaaataaactttggcaccaggcacggtgacccgagccattgtgtaccttggtgccatttgatagctagaggaaggtaccctgctgagggataaatgaggagtcccagtggtgtgccagaatcagctcatagctgcttgttaaattttcaacaattttgtatgctggctgactccatgatggtagcttgaaattggccatggtggagtatttataccactgaaatcagcaaatgccacaaataagcccttccccgatcctgagctggttgttaagcaattaccagaacaccactggactgaagactgaacaaaatcctgtcctggctcatcagaactatcaaattttttgtaatttgtcagcccaaagggattttgggttttgggtgttctgttttgtttttgtttttgtgttgtagtttgcatgaaagagaatagtgtcggagacaagaagagtacatgagctctctccacaacatagtagatgggatcccgaaattttatcttgtaaaatatgggggtcatattattgcaagtaaatgaaatatagtaggtggttttgtgttttgttttgtttttaatatactgttacaaaaagcacaaagcaatgacagtgaagtttaaactggacacaattgtaaaccttaaaagacccaaatgatcttgaagcaattacttcctatccattcccataagaactttagcttgctcttgtctgagaagtgggcaagggtagacaactggaggcaatcagcaatccttttacatccaaatttgtacacattgtattgtggcagggtgttattgtacttgattgtgtcccaaagacatggcaagaacagtcttttatagttgtgttcttttgtgccaaagttctgggaatatagtaaatgctcagtgtttatccatttttctttctgcctttccatccaaccatccattcatccatttatcccctgcagtgttcacaagtgctcactaaataattattggttcattaactaaagtgaagaacagcatgtgagtacattttggcattggggtcttttattttagtagtgttcttgaaatgctgggaaaactttccaaggattgcatgggataattttaagagaatcaatttccaggtccgcaacttcagtatattctctgcccttcttcctaaaactgatctgcctagaagactgctgccattgagcttgcttgctttttcttttctttcttcctttctttctttcttccttccttcctttccttccttccttttcttccttcctttcttccttccgtcctttcttccttccttccttccttctttctttccctttctgtctttctttccctttctttctttctttctttctttccttctctctttctctttctctttttttatttcctccctttctccctctttttctttctctccctctctttctttctttctttctttctttctttcagacagggtcttgctctgctgtccaggctggagtgcagtggtgtaatcacagttcactgtagccttgacctcgtgggctcaagcaatacttccacctcaacctcctgagtaactaggtctacaggcacccaccaccatgccctgctaattttttaactttttgtagaggggtctcactgtgttgcccaggctggtcttgaactcctagactcaagtgatcttctcgccttggtctcccaaattgctgagattacaggcataagccaccatgcccagccttccttctccactttataaaagaaaagaacatttctcacccacctctaaggtgtaagtacttccaagatgccaaacaaaggatcaattagataatttcttttatcaaattttcataacttatttcctctctatccttctcattaggagatacagtcccaataaattttactttttgtatttggtaattattgatcaaattataatatacctatattgttttactcaattgtatgttaataattgtaatgctaattcaatccagaagaaaacacattttgacacatagcacttcatgttaacaaaagtaactatattttattgggtttttttttttttttttgctgcagatacatataatgggatgaacaatagatgactcaagcatacaagagtactacattaggataaaattccatgggggtagtgaaatggaaatagaagttcaaagagaaatttcctgactttcttgaaaagcttacttatgtatttttaaattcatgatggagtaaattaaatcacaaatatgtatatattcctaagtagatacatttgaaagggtgtggtaatggtttaaactatcattatttacaatacacaaactgtattcttttgtttaaaaatagttaaactcatgatgaaaaattatagatgtcaacttagtatgtacttaatgtccactatgtataagagagatatataatttttcaaaattcttttgaggatgcttgagcaaaaaatttgaaaaatgccaaccactattatatgaagtttacaaaatataacacagaggtgtctttaagcctgagcctatttaaaggcctgaggcagagattctcaacctgagatctcagggtttgagaaatcaatcaatagtatgtgaaatttcgtgtttatgggcatgtgtacctttttctgggcaaagagtacagttctcaaagatgttcacaacctaaaaaagattaaaaagatctgaccaaagcatgtaaagtcttaagaaacttgactttgctgttttcataatagtttcatatgcactggcatgtggaattgcttccaacataaacaattttggttcagttgtttgtatataaaataatactaattatgaaaaataatgaaagattcaatctccctttcttcatcatcatcctgaaatctatgtcaatcttttaattttattccttgcttattcagaggccttttcttttcttaattttgatggagaaaattacaggtgcttcatccatagaaaaatgctgaatggaaatgtggaaaacagtttttaaaagaatagacatcatctgcccctgacagttgtgtcttgcggtttcttccaggatctaatcagcagtctagcaataggttgacatagtattcaggcttagaattaggaaaattacatttggaagtgactaataacacagtactttcaaagctttggattttaaagcgtcacacacacagcaggtgaatgaagatgtcagagccaggcctaaaggagcaccctggtaatccagcccttggtgtataaccttcaaacaccaataaacaagattatctgggtttaacatgtgacctttctcattttgactggtaggtccagatgttttctcgtttagctgcctggttgaaatctgctttaactgactgcatttggatctagatttgaggttgcaggaatgacagtcttgaaaactacattctgcactgggtgatactgtctaaacagtaacatatggagacctatggtttaataactaaaaataatttgtgaccttacccttaatagatttgctaattatgtcaactgaataagtaaaaatgggatcacgatagatatttcactatattcatcagtctggtggcattaaagacattgacaagatgtgttagaaccagccttttctgcacctgcgtctacagaagcaaaaatctcagccagggcctttgttatcctttcttactccttaagtaatttcatagcagcccttgagaaaataggaaaggctctttgttaacttctgttaagtcagcctaggctgtggtcatacctcccatccaccgacatttgaacaaacactacttaatggtccattattactcttttcattacttggagcccagaactctctcttgcatttttatatgacctattccttacttaccatcagcttgattttccggttctagtccttcaggttgtactagttctctctctctctcagactgtaaagaaaagataattctttattttcttattttgtcttacgagagaactcacattcctgaatgaaccctcagtgaacttccccaggtgcatttatatcactgctgctttgcagtccagagatagtgctcattaactaattaataaccacagcctagtaaaacacactaaattattaacagaacagaaagtgagacagtatggtccataaaagcacaaaatataacaaagaagtaatatatccttatgtatctggatccttatgaattttagcccaatttagaaagagcaaaaatcagtagttaggtatttgtctgaaatcgataataaaataactaagtatgggaaatgtccaatcaggccaactcttttatacttgattttttaaccttcctttcctactgtcaagtagcgggtgcccttgtgtttttcaacaagctaattcttgttaattttgttgaaagggaatgaaatcagttgtacaggaacaaaaggagttaaaaatagtcttctgagcatttgtcatatggaagtaatcatagctcagaaactatacttaccatgatgcttcttgtaatcattggtgaatgggtagctaaacattcccattttgagacagagtcagtatcagagtcagtatcagagctatcaattttattttgttttgtttatctgtatagatttctttttaaaacagctttaatgtggttataatttacatactttaaatgttcaattcaatgacttttctagtaaatttacagagctgtacaactaccaccatgttttagaacatttccatcaccctaaaaaaccctttgtacttgtttgtagttgatccccattcttgcctgcagcctcaggcaaccactaattatttctgtctctaaagatttactgtttctgggtatttcatataaatggaataataccatatgtaatattttgtttctggcttcttttacttagcataatgtttttgaagttcatctatgttgctgcatgtatcagtagtttgtttcttttatttcttttttcttaaaatttttgagatgggatctcactgtgttgcctaggctggtctcaaactcctgggctcaagtgatcctcccacctcagccgcccgagtagctggaaacatatagaggccccgtctctacaaaaaaaaaaaaaaaaaaaaaaaaaaatttaaatagtcccagctactcaggagactgaggtgggaggattgcttgagcctaggaggtcgaggctgcctagtgagccatgatcatgccgctgcactccagcctgggtgacagtgagactctgtcaaaaaaaaaaaaaaaaagaatatcattgtatttatatagtacattttgattatcaattcactgtttggtggacattcaattgtttgcattttttagcttctatgaacatttatgtacaagtctttatgtggacataggttatcactgcttttgagcagatacctagaattgttggcttgtatggtaaatttatgtttaattttataagaaactacccctatattagttattgattgctgtgtgacaaatgaccccaaaccctagcaacttaaaacatattatctcaggaatacaggcacagcatatctgggtcctctgcttcagtctctcccaaggctgctaacaagatactgacctgaactgtggtctcatctaaagacttgactagggaaggatcagtttccaagctcactcatgtggttgttgtcaggattcagttcctgaaggctgttagactgaaggcctcgtttcttcactggaggttggccagacactgccttcagctccttgctctccagcttacttcatctgagaagcttgcaagaaacaccacagagagaaagagagagagagatggaagtcacagtcttttataacctaaacacagaagagacaccttccatcacttttccatgtttttttcattagaagcaatcacctaggtccagcccacactggaggggaatattacacaagggtgtgaatgctaggagccgttttagaaggctgcccaccatactgccaaactgttttccaaaatgactgtatcattttacactcccaccagcaacggatgagggttccattttcttcacatccttgccagcgctctttattgtgtcttttttatagtagccattctagcaggtgtgaagtggaatctcattatggttttaattcacacttctctaatgactgaggatgatgagcatcttttcattggtctgttgtccattcatataatttcctggtgaaatgttaattcacatcttttgtgcgttttaaaaattttatttattaccttagaaaagctaaagactactttcgtgcattttaaaattggattatttgtcttactgagttgcaggatattttcatttatgaatcatgttttcagtgctgtatctaagaaatctttgcctgtctcaaggtcatgaacatattatgtgccagctactatgctacgcctatatatacattattttgcttaatttcattactgtaacagccctattaggtatagatattatcattactgcaacacaaatgagaaaattcacggaagtcaaattacttgctgaggtcacacagctagttagtacaacttgaacctgggttctgtcttactccaaagcccatgctcttttatcagaaacttaaaaaaaaagaagtcattcaactctattttcagtggaaaaaaataagttaaataccatattgttccttccctgtaattaccaatacccatccaatattacttgaatattgttagtagaaacctctctgtgatcattagaagctgctgtttgaaatagaaaggacatagattgcagtttgttggccagattctattctagttttattctgccagacaatattccctctgcagtttccagtagagctaggatgcatctttgcttgcagccttgaagtatgttactgggcagctgttaagcagttgttacactttatccccagggatgaacatgttccagtgacaagatagctcattcccttgtgtgcttttaatgttgtacattcacccaggagaagtcagtgctgagtttcttctattatttctcagtgctctaattccattatttgagaaccagggaagaaggaagggaagaaccagagatgggtaaaagtctaaataatatgttacagatggtaaatgttaatttttattttgtattttaatgtaatgctaaaaagaacaagagtcttctaattcttaatccttatactcatttccttctcatccaagaatcctttatacgctttgggtctgattgttataccttgagttagaaataacaatttattttttccctctgtcttcggctaatatgctagctttaggcaaaattgcaatctgtacaatttttaaaaacactgtcaaccctaattttgtacttgaagcaaataatagtatagttgttcacgctttcctttcctccttcttatcttctttccttccttacttccttgtttgtttggtaagtagtcactgagctctgtatcagtgctaaatgttgatagaagcagcataatatacagacgttgacatcaaacagccactatgtagagaggacaacggggaatattataggaaaagcggagaagaaatgggagagataaggagcttgtttgcaacttgttgagtgtgagataagtgttggaaattcaggaagtgattgtacatgtcaggaagtatatgtctatggctttccaggtctaccggaaataaaaatttgagagtcaacagcaataaaaacttggatcaggagacagagtatgtaaagtgaaaaggcaaaagtttcaagaaataggccctaggaaataattcacatctaggagatagagaaagaggaataaacagaggatataagtaaataagtgaggtaggagtaggaccagcaaagaataagccaaggaaagagatttaaaaagcagggactggccagtggcatcctattgcaaaatggtggagcaggaagggcagaagccagaccacaatgggcaaagaagtcaactagatgactggctatcactgtgggccatggaccttattctgatgcattaagagaaactacatactgcatgacagcatcagaatcttgtagacaagttaggggtctattgtgatctactacttcttctctgcctggcctagttatcatcactaaattggttcaggctgcccaagaagttcattcattcattcattcaatttcttttttttttttttttgagacagagtctcgctctcacccaggctggagtgcagtggagctatcttggctcactgcaacctctgcctcctgggttcaagcgattctcttgcctcagcctcctgagtagctgggattacaggcgcgtgccactatgcccagctaatgttttgtatttttagtagagacagggattcaccatgtcagccaggctggtctcgaactgctggcctcaaataatctgcccgccttggcctcccaaagtgctggagtgttgggattacaggcatgagccaccacacccggcccattcattcaatttctaaagtaacgaggcccttgttaggttctggggacacaaatattatttaaacctggtccccaccttgaaaatactcctagtctatatgggagataaatacactaattgtgatataacacaaaacatgctatatacaccaagaactacttatgctctggatatagaagactttttcattccttcctttacctgtgaccctgagtttggtattgtgacagtcagaatgttttttagccaattgtatttggatgacagtttttgaattttactaagaattgtattttaacatgctttaaactttttcattcctgtttttaaaaaagatagagtggctgggcgcggtggctcacgcctgtaatcctagcactttgggaggccaaggtgggcggatcatctgaggtccagagttcgagaccagcctgaccaacatggagaaaccctgcctctactaaaaatgcaaaattagcagggcatggtggtacatgcctgtaatcccagctactccggaggctgaggcaggagaatggcttgaacccgggaggtggaggttgctgtgagccgagatcgcgccattgcactccagcctgggcaacaagagcgaaactctgtctcaaaaaaaaaaaaaaaagatagagtgaatattctatgcaagggaattttgaatgaaaaaggaagttttttttctttcggatttacaaatgaagtttctaccaggtaactactttagtctatgcttgtttaggcaacatctaaaacttcagcctctttaaatgtatttcatccattgttttttgatgggtagcagttatttctcaaaaatataaatacaaaagagtttaatacatagatgaaaataatcaatagaaaaagtaattgttataatgggcagaaatgaaacaatatacttgtagactctttatagtttagaaagacctttcatacatcatggccttcagtcctcacaattctagataaagaattatacctggccccatgacatttgaagagcttagcccagctgagcagctggaaccttacctactgctgatgtatagtgtatttctgttgtaaaagtagtaaatctcctcttcttctaatggggaagcaaagaattgcactgaaattattaagcaaaattatttttattattatgcccatgaatgagctatttgatagtcagataaggcaaaaattaatgttattagtaaaattgagggtagttcctttgcaaatgaaactttttacatgctaatgctcttgtgtttgaagtgatgtgatttactgatggccagtttagattcttttttttttttttttttgagacaggtctcattctgttgcccaggctggctggagtacagtggcatgatcacagctcactgcagcctggacctctccaggctcaggtgatcctcccttctcagcctcttgagtagttgggactacaggcatgctgtattcccagctattcccaggtattctaccatacctggctattttctcatgactttaattttttttcttttttttttttttgagacagggtctcgctctgtctcccaggctagagtgcaatggcatgaacacagctcactgcagccttgacctcctgagttcaagggaatctcctgccttagcctcctatgtagctgggacaacaggcacacactaccacatccggctaattttttgattttttgtagagacagggtcttactttgttgcctaggctggtctcaaacttctgggcccaagcgatcctcccacctctgcctcctgaagtgctggagttacagatgtaagctattgcacctggccaaaaatgtatttcaatgagaacttaaatctatagaattttatccaaacctgtattgagatatcagtatttcatctctcttttttttttttttttttttttttgagatggagtctcactctgtcacccaggctggagtgcagtggtgcgatcttggctcactgcaagctccgcctcccgggttcacagcattctcctgcctcagcctcccgagtagctgggactacaggtgcccgtcaccatgcccggctaattttttatatttttagtagagacagggtttcaccatgtcttgatggtcttgatctcctgatctcgtgatccgcctgcctcagcctcccaaagtgctgggattacaggcgtgaaccactgcgccctgccagtatttcatctcttgttagcctgatttaccttttccagttttttcctaatttaaaaataggcattttcaaaattaacagacgtccattattttaaattttaaaagagaaaaaaagaaaacataatagattttataaatcaatgaccaaaagtttagtttgcattgaagctttataattttactggttagcaaatattaaaactttccttactctttagttctaaaaatatcatcggtttctctctctcattactttacatgcaaaaatgtaaattagaaaatgaaaatgacccatcgtttcagtgttcttcttcctaatacaaagaggtcattgtgggagagaagtatagacattaattttataaggaaaactgttctagttcatctgtttgtgctagattgggcgacagtaacaaactttgtagactgaatacctacaatacatatatttcccattttgctctttagtgcttcaagcttctaaatcctattaacagctgtcaaaacctggtaaactatttagatgctttcacaatttgtttaattggatagttagaaaatggcgtgctagaaaagcccccccccaccccctttcttttagcctggctgaacatctgtagcattagggcctcattatctctgaattggcatagcaaatcagtggcatcattaaaatgccacattaagatgattaagcttctttgttatccagttgacttttgcatttgctgaagatttcatggttatgacccccgatccttgtaaaacacttaaataacatcacccttttgtgccttccctaacagcctctatcttgttttgtcccttctcacaatatctccggcagacctgaggatattacttccaactttgtccttcgtagagttggattctgagatctcatagtttaaggtggaaattcagaatctcttttttccactgggaaattcctagtatcaacatgctctccaagatacccaagttgtctattctgtttgccatctttgataggttcttctctccaactgagcattttatgtgcctgtaaaaacaaactgaggcatagttggctgagactgctattgcccctgaaggatttagatgttggatcctttccaggacccattgtttttgcagtgtctcaggtgaaaccaaaaatgtctgctctggagtacaagcctttcatgtgataaccatcaccccaggaaatgaaaccatgtgcatcagccccagtgagccaaacctttgttctcttcagcctacaaaattctctctggggtgtgtgtgtgtgttcgtgtgtgtcatcttcctaagaggcctgaaaacatagacaaagatgggagcaattgtaccctagagtagctcctttagaaagtttagtttaatctaatttcctatgggttagattcaatttagacatcttttccctgcctctgggaatgtatagcaattacctttatcagcaatttgtggtttggtatattcttttctccacaagttcagttataaaaaaggtattcaggaagcctttaactttttttattataaaatagatcatatgtacaaaaaggcaagtataattacatgtatagattaaagaataataagaaaacatccatacacccaccacctgacttaagaaataaactttcaccagtgtctatgaggcttcttgatagtcttctaagtgtcaacttaagatgtatgtctaagaaacctgatatatattataagaagattagaatttacaaaaccaaaacatgagattattcatactataaaaggtttattcactttacaaaagacttcaggatactatcaggcagttccccaaatatattcaagtatttgttgccaggtctttaagattttctgcctttattaaatgaacgggtgttgccagtcactgacaactgaaatcagggcaaaataaacatttctgaatgtagaatgttaatcagcgggacagtgttattggttttgcatgaaacattttatgaacacatcaactacataaaagcggatctgtagcaatgtaattatatcatactaaatataaagcagaataagacggatgtatgagaacaaagaaacataattttttttctagttaagggtatcaaggaagacttcatggaagaagtggcatttaaactgcatgtggaagtttgaatacactattgaaatggtagaaggatattttaggtgtgggaaaggctggagaagaggcttgaagaactgtgattagtcatgttgctgctgtgcttctcagactttaatgtgcataagaatccttgaggatcttgttaaaatgcaaattctggtccagtaggtctaggttgaggcctgagcacctgtatttctaacaagctcccaggcggttgcagaactgcttatccaaggacctcactttgcatagtaaagttctagtatagagagaaaggtgattcaagaagactgagaaatgagatgattaagtagtcctggggcaagttctggacaggtgcttgaatacctcattaaggagtttggactttattctataagcaaatgaaatcattgaaagttttaaataagagtttctttgctacagcatgattattctggcaataggatgcagtataacagaggtcacatgtaccgtgggccagttaggaggctaatgcaatgatatattcatacaccaggaatttatgggatgtctactttatgtagggcactgcatctaactcgaggcagtggctctcaaactccattgtgcataaggtttatctggagagcatggttttaaatgaacatttccagtctccacccccagattagtagatctatggtaggagccccaaattttctattttaaaaccacataacctctggtcttacagatacaggttaagcagtgtcatagggaatactgagttaaacacacacacacacacacacacacacgcacacacacacacaatctgtatagcttctgccctcagctagtttacatatttattggggagactaggggaggtgagttcataagtaacccaggaagaaggagcaggctattttccagctgggttgatcagagaaggcatagtagccaggagacagcatattagtttgacctttaaaaatgtgtaggacagtggccaggcgcagtggctcatgcctgtaatcccagcactttgggaggccgaggccggcggatcacgaggtcaggagattgagaccatcctggctaacacagtgaaaccctgtctctactaaaaatacaaaaaattagctgggtatggtggtgggcgcctgtagtcccagctactcaggaggctgagccaagagaatggcatgaacccgggaggcagaagttgcagtgagcagagatcgcaccactgcactccagcctgagagacagagaaagactccgtctcaaaaaaaaaaaaaaaatacgtaggatgtgtaggacttggacctgtggccatattggggaaagatcttttaggcagtagaaataagactacttagaagctctttagttaaagatctaactagtcaaaattaatatgccaaagataggttggggccagatcccgaaaggccttttaaattatttgtttctgagtttggactttattttgttggcagtggaaaatattgaagaattttgacagggctatgacatgaccagaggtagaatttaggaagagcaatcttgtagcaacaaacaagacgggctggaaaggagaaagaagggagccaaagagaacagtgcgggggctacagcaataagtagatcgtgggaaagtcatagggtctgagaattaggtaatgggcatgcaaaatacaggagtggagaaacagattagagattggatacacagatagaaccactgaatgattgaatgtggggcccaatcaggagaaaggaaagatgactctaaggattctagcctgagtaactgggaagatacctaggaagccttcagaaatagaggactaaagaaagggagagaggttacacctggagttatatatatggaaattaatcatataagatgttagtcgaagccttaagaatgaatgaaattgccatacaagaggggtgtagagggaagaaaaaagaaggttaaggacagtatttaggatgcagagggaagaaaaggggcaagaaggaagcaatcagaaaggcaaggaaagaaggtacattttcattgaagaaataggagtgcaggggccgggcacggtggctcatgcctgtaatcccaacactttgggaggccaagacaggtggatcacctgaagtcaggagttcgagaccagcctggccaacatggtaaaaccctgtctctactaaaaatacagaaattagccaggtgtggtggcacgtgcctatagtcccagctactcgggaggctgaggcaggagaatcgcttggacctgggaagcagaggttgcagtgagccgagatcgcaccactgtactctagcctgggcaacagagtgagactctgtctcaaaaaaaaaaaaaaaagaaagaaagaaaagacataggagtgcagaagaacaaggaatggtgagtggtcagtagtgttgaggattacaaagaagttggagagagtggcatacaaaaaggctctgaatcctaggaatcaggagattatggttggtgatattcaagggagcagattaagtgaattgtggaggcggaagccatattacagagaattcctgagtcctttttgaggctgtagaggcagtaagcatagcttacctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaatattagaataaattagaatctggttggacacggtggctcaggcctgtaatcccagcactttgggaggccaaggagggtggatcacttgaggtcaggagttcgagaccagcctggccaacatggcgaaaccccatctttactaaaaacacaaaaatcagccaggcattgtggtgcatgcctgtaatcccagctactcgggaggctgaggcaggagaatcacttgaacctgggaagcagaggtggcagtgagctgatcgtgccactacactccaggctgggcaacagagcaagactatgtctcaaaaaataaaatagaataaaataaaaataagttgctaatccccagtaaccatgcagagaggtcatccaggtcattcatctaaaactggtaagactccaaaggcaaaccagcaactatgtaagcccaaaggacttctctaatgccctgtccctgtgtccttatgtccctgggtctcaaatactgtcttccttgctctatagctgactcctaaaggactaaagctaagatctgctcttgagccaggatggtgtcgtattgaattccaggtcaggccaactaaagccaaaatcctgagggaaaggagcagctctcttatgtcctctgttttcagaaagactcaacacattgatcttactacattttaaagttcagtgaccatggagtggcctgagtctggtcatgttcacattttctaaccaaaatggaaaggatccttttctgctggccttttctatctgctgtttttggttttaagtagctgaaattttccgttgaggttcttttaaacgcctacatgcaaactgaagagcactcaagctttggtgggatattacccacagctggagtgatggaggaagggaggcaagtacaagcctcaggtgcatccttctcttaaaaaaataaaaaataaacacttaagcaaacaaattccacttgaaagcagggaagacctatccagagaaagaagtaaacctctttccaagtaggaaacagatatcatttcttatataatccagatccatagggtgggcaaatttgaaacatgttggacttatcctacagccctacatctttgctagtcaaagagtgaaaagttgtgaaccatgaactgtggtaggaagcagtggaactgtgtggcagccctggctcctctgatggtggttaggccctgtcttgctctattaagcaaacacagttaatatagatgaaaggtaaccttgatagaagtgaaaattgaaacttgggttgaaggtagcaagccaggcacagctgcagttgtacttcctcctatgtagcaagaggagcaacacttactgatgttttttggaagggatgtagttttttaaaatatcttttttcagactgttttgggttttaacatttacaccattgatgggagggtgtgtaatacagttggtaagaacccacttaggccttatatgtctagtgcatgaggtcaaatccaagtaattgatagttcaagcttaagttttgcattctaatcacacctctgccagtaactggatgtgtaaccttcgacaaatgaccaaaaacatctctgctcccagatttcctcatctgagaaacaagagggttggattagatgacctttaaattcccttccagccctacactccattgatttgtgattcctcatggggaggtacaacttttgatttctaaggaccaatggttgaaaaagtaagcatttatatagcatattttatatatgcaaaatcccttacaaatgtttattattcttacatcaggcaaatttttaggttttactagtgtcagtgcaagtacataaatttgccttctttgtttcttatgttcttcatatttttcccacgttcttcatatgttcttatgctcttcatgaagagtattacagctcttcttttaaatttcattcatttacattgcagttcttaagatagtacttggtcagccaactcacttgagccagtccctcctctcctatccagtcctattacacaatccttgagtccttgagtttagttctccctaacttgggacctaatggtccttccccttatttagattgagccccacttacctgtgtcgatgaaagtgactccttaggttatatgaaagaattacttttccttttgtctttctcaacactttttcattagtactgacagcttcctctacagtcaatgttgtgcctttatcagctccaagagagacagagataagatgtgttttagcaattcatatacgtggaaggggaagaggcaatgcatggcttaaaattagaaaaactatgttaactagtcaactcttaatcttaatggcttacactggatgcatctgaaggattcaaacaatattttctccttgaaacctaagagtacatcaccttgcctttttaactgcagccaccaaaaacagtactagatctgagaacccttcctctcccctagtactggagaagagttgctcaatgtttgtttcatggccactttgagcaaacttagctaaaatctattatctgtaattttctggatagcctaaaacactatcgtctatttttatgtgtgtaagtatgtgtgttttcctctgactgtggttctgaatttaaataacgtgcggtcacgctaatggtgctttcttgttttgtagatgtacagtgttttgttagcttcgattggtatttaattgtcagttgtgggtctctgctgtttgagctgctttgatagcttcaagtatagtcgttgttcatttcttgcattttcttccctgcagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtaaatagtctgcttttttcattcttctgaaaactctcctaatgcagccacatgagaaatgaagtggtggaatttggaacttttggttactttcattgatttttgctataatgctgatgtatctctctctctgcattgctgttcactcagtgctttttattcctgcctcaccatgcatttggcaaacatattgcaaatgctatgaataaaaaaagactgtagagagcacagtgttctaggtcagccaaatactttttcttcagtttctaagtaggagttgaattgtgtaatttgcttcttagccatcttttgtatatttttgcataacatttttaataagagcagatcttcttattgtattgggttcaaatttggtaaatgaaaggacatagtttttatttccagcttaaaataatgtatcttcagacaataaacaggtagtctatagaaatgcatacaaacacaaccatcgcacttgagccagtcgattccatcccatatctcatatgaagactttaaaaaggagaatttctagccctcaacaccttgtaaggactttagtttctggctcttttttcaaaggagattatattcaaaaggaatactaaaaaattagccaggcataatggcaaacactggtagtcccagctattctgaaggctgaggtgacaggctcacttgaacccaggaggtcaaggtttcagtgagccatgatgggaccattgcactccagcctgagcaacagagcaagaagaccctgtctaaaaaaaaaaaaaaaaaaaaaagggagtaccaagtaatatagtaatataaaaacttagatctagaaagcacttctagagctgctcttgtttctttgctctgattcaatatgatacctaaaatagccttgctagtgggtgctttttctcttctacagaggagatttcataagtaagtcttaggcttgccttgaaatgcagctcccaactgatcccaatgtgaacagtaattgtctaaaagatgagcttttcccctaggcatctaatctgtgcatatgtttctccacttgcctgtgaccagaaatctccttttttgtcctttttaaaggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctggtaagtgagagaaatgagcattccttgtctaggaagtgcattcctcagagcccagtgtggaaactagaaagagttaagtaggaaggtttcaatctgtcattcttgttctgaagggttacaacagcagagacctctagggctaattacacgaccattaaggcactaattgctctccgtctgcctcagtggagatgatcatctcctcaccatccttgcacccatggagaacaacacagtcagataggaagagcccaccctataaaaaatgtccttttaatttttgtgagaaaattatagccatcagtattttcttctggtaaactttattagaagattattttcccaacacacacactctttccattcaaaagacgagacaagcaaatgatgtacagtttgtaaattatgaaaaactgtgatctggatataaatcattgtttgggggctactttttggccatttgggataaatttattaaatccaactttcctcttgattggcccacttttttttttttttttaaataaacatgaggtctcactatgttgctcaggctggtctcaaacttctgagctcaggcattcctcccactttgacctcccaaagtgctgggattacaggcaggagccaccatgcccagccagcctacttattttaaatctctaaaagattgaacaacggtaaagatttgtaaaagttatgtgctgtcgtgatgtttttactccttattttgaccaagataatacttttttttcaagatttagaatttccgtcctagaaaaataagactgagtttattttcaaatttgggacctcatgttcttgatgttatctggcaaaattttaattggaaaaaaaggcttgtttttatgtcagttcacatctactgctttgattaaaacctagccccaaactcaaaacttgttataattcagccactaggattaaacaagtcagccccaacaaaacccaccatgagagatcataattggcaattgaagggtttctctcttttacagctcatttttcaaagtagtgaattaaggatgagtttggttcgaaaaaaattagaatagttctctactgttgcctttttcaagtaagaaacaatagtaggctttttaaagacagattccagagaacccaatttatgcagaaacgtaacatttttagccctagcaaacctgcatttgttttaatttaggattccataaggatcttttagtgctttaaatcccaaagcctctgttttaaacagagcaagagttagaaaataaaaattttagcccctaaaactgacaaattcattgagtatattctatcaacaatcagaaagaccagccttgcacagatagttgaagttattacttacatatttcaagcaataaagcatttggggagttggcagaataaagtttgcatgaattgtatgggtgaaacctttccttcatcttagacatttagacgaagtcatttttacaattcatttttatttctctttttttttttttttttttgagacggagtcttgctctgttgcctaggctgttgcagtggcgtgatcttggctcactgcaacctccgcctcccaggttcaagcgattctcctgcctcagcctccctagtagctgggattatagatgcctaccacaacgcccagctaattttgtttgtttgtttgtttgtttgagatggtgtctcactctgtcacccaggctggagtacagcggcgccatctcagctcactgcaacctctacctcccaggttcaagcgattctcctgcctcagcctccctagtagctgggattatagatgcctaccacgacgcccggctaattttgtttgtttgtttgagatggagtctcactctgccgcccaggctgggatgcagtggtgcaatctcagcccactgcaacctccacctcccaggttcaagcgattcttctgcctcagcctcctgagtagctgggactaaagggtcacgccatcacgcctggctaatttttgtatttttagtagagatggggtttcaccacattggccaggctggtctcgaactcctcacctcgtgatccgcctgcctcggcctccgaaagtgctgagattacaggcgtgagccactgtgcctggctaatttttgtatttttagtagagatggggttttgccatgttaggcaggctggtctcgaactcctgacctcaggtgatcctcccacttcggcctcccaaagtgctgggattacaggtgtcagccactgcgcccggcctatttttatttctattattcaaaaatatcctggccgggtgcaatggctcacacctgtaagcctctcactttgggaggccaaggtggcctttgggaggcccagacttcacctgagcctatgaaattggggctgtagcgagctgtgatttcaccactgcacccaagcctgggtgatagagtgagaccctgtctcaaaaacaaaaaaacaaaaaaatccgtagttaattagctcagtttttattgttttagcctagactttgctatagccacgtggcaaggatgagctaaatttacccaaatatgtcaatgttctgaaaaggccatcagtttctagccgaatggctaactcccacaaactacagcaatctttacttacagccagatggatgtccaaaataaagaatcctttcctatttcattgcttataccacattaacctccttgaagaataaaagggccctattttctttttcccaaagaaaacaaaatttgacctggagccaaaacagtatgcgaaatggtaatcactaaatccaaattcttccatttgtgataggaggcgatccttttgaagaatactctgacgtaataattaatcatagaccataaccttatttaagcttaccaaatttaaaatatagattcaaaagtatccaaatactctggcttcactcagcagtctcatttctagtgaacagttgtcacagagccccaatacctgacctgtgtggaacccctgagggtcactgagtgccccttatgttctccttctagtggagaaaccctacaaatgtgagttttgtggaaggagttacaagcagagaagttcccttgaggagcacaaggagcgctgccgtacatttcttcagagcactgacccaggggacactggtgagttcacgcaacacacgtttagtgagcatctgctgtcctaggtggtgagatacaatagtaagtaaaaagactcgtggagtttatattttactgggggcagacagattataaagaaagtaaatgagcaaactgtaagttggaaggttagcgggtggtaagtgctattgagaaaaatgaagcagttgctgaggagtgagggtgagaatcagggaaggcttcaacgaggtaacattttaacagacttcttaacagggtgagtaagccctgcagataactagggaacagcaagagcaaaggccctggggcacaaatttgaagaagtgtacgtagttctgtgtgtctggaacacagtgagtaatgggacctgaagccagagaggaaatgggaaaccagatcttctcaggccttgcaggccattgtaaaggctttggcttttactctgagtgaaattaaaaatctttagagggttttgtacaaagaggtgacatcattggtcttctcatttgaaagaatcactctacttgcttttgagaagagattgtatttggggcaaggttggaaattgggggtccagttaggaggccattgcaataattcaagcaagagaaaattatgtcttgttagtggtagaggtggtgagaagtattctaattctctgtatatttaaaggtagagtcaacaagatttcctaacagattgatgaagaatggagttgtcgtttacaaaaaatggcaaaaattcagggtagaggaggttggggagtggctagggaagagtcaattaaaactacaaggattttctttgcacagggcccaatttatatccttgtctactcatatgatttattgtgatgcttctatttggctttggggattccttgttttattcagtgatttgaattagatgcctactggcaattggttgaaacactagatgttcttctatatctcaattgtggttttatttccttttaattctttgttggaacagcctgaaacttttttgtgtcacatctcttcagctgtcctttgtcccattgagttggctgtcagcctggttctgcagcttgggttgtctgacatttttatttggtaacttgaaccaattgcttatttagaataggtacaaaccctcatgggatttagtgtttgacagcaattgttgcagttgagtagtttgaataggctaaaacagaaaagttacaaaaagatgacagaaataatgtgaaactcaggaaaaatggagtagaaatgactacctaaactgccctcattttgagtgagaggaaacttattttagataaaacctattgcatgatgttaggagctggccaactgaattctgatggcttgcagtgcttctgctttttatcctaatggcatctttggttttatcaaggagttggatttctaatttgataaaggaaatccaacttatttggataaagcttatccaaataaaaagaaatgtttacccccttataaaaaacaaacaggtcatacacagtggtacacacctgtagtcctagctgctgaggaggctgaggcaagaggattgcttgagcccaggagctcaagcccaacctgggcaacaaagcaagacaccatctctaaaacaataataataaaataaaaagaaaaacctaatatttgggttttgacatcttctctttgttttgcttttatctgagtctgcttgctaggaaagattttgacatcttaagtggcatgcttcatggcagtcaggcagtactcgctcaaggacggaatgtaggcatctctacttgcagttctgtatttcagacaataggcaaagctctcactgtaagagattcccaagctatgaaatctatcatattccaagtagaatcactaatatttaaagctagaatgaaagagagcatctgaccctacttcttcattttagaggtgacaagactgagactcgcccaaaattcagtgacctacttaaaattcaccagaactttagttgtttttgtgattagtcatattttttaattttcaaaaacttgagatataactcacatgctataaaatttacctttttaaagtgcacatttcaataattttagtatattcacaaagttgtacaaccatcaccactatcttatttcagaacattatcaccatccgcaaaagcagtgctgtgctcattagcagtcactccctattcccccttcctctagctcctggcagccaccaatctactttctgtctctatggatttgcctgttctggacatttcacataaatggaatcatacaatatgtggccttttgtgtcggctccttttacttagcataatgtttctgaggcatttatgtatgctgaagcatttatcaggacttcattcctttttgtggctgaataatattccattgtttggatatggcactttccatttatccattcatcagctaatggacatttgagtcttttacaccttttccactttttggcttgattagctatatttcttaaaggttatatattatctggtttgcaaaagaaatatagtaacacacatactaatagacacacatgtatatacatatatgtgtgtcctgattctcctggaaggagggggaaaaatcagaaaactacactctataaacagtaagttcaaaattattgattttgaagtaaggtcaccaccttacttcccattctcacaaccttttttaggaatttcaaataaggaaaagtatcaaaagtaatattttagctattctcagtgatattaggtgattcaggaaatgctgaaatacagaggttgagttaatttgcatttcatagggtggtttggtggatgcgtgcaccatactttaagtctcagcaaaaaaagataaagggttaactaagtcagcaagttttgatttttttttcaaacaaatatgttgtaatggtggtttcaggttataaatgtgtaaattcacagcttaatcaagttactgcatctcagttcacacattactcttttatatttcaaatagttcctataatttttcctgaggccaaaatttacagaatatttaacccaacataagccaatcctttaactattttgcacccttccatgtgtggtttccatttctgtttccttcttagaattgggagtccattgtggacatggggttctattctgagcctgagcagtatagtacatcttatgcctcatccgtcacttgtaaagagatgatgctccattgctgttgtgcctgcagcactcattcttcaagtgcttattgtaagttgaagtgcagcgtagtgtgagagccaagcctgtggacaaacctgcctgcaaggggaagcaggactttctagaagcaagcagatggataaaaaggccttggagtgaagaccagcctgcaaaaaaatgcaggtattgggcaacaggacttctggccttgctaatcatttcttttatccagatagcatttgttgagttctctatgtgccaggctctgtatcaaagctgtttgtaaagatgagttaaggttaagcccctacactttaaggatttacaatcctggccgggcgcggtgggtcgcgcctgtaatcctgacactttgggaggccgaggcgggcggatcacaaggtcaagagatggagaccatcttggccaacatgttgaaaccccgtctctactaaaaatacaaaaattagctaggtgtggtggtgctcacctgtagtcccagctactcaggaggctgaggcaggagaattgcttgaatccaggaggtggaggttgcagtgagcctgagatcatgccgctgtactctagcctggcaacagagcaagactccatctcaaaaaaaaaaaaaagacactagtgatattgctactttagtccaagtttctacatcaggcatcacaagtgacaccatcagaaaattccaattctgtcttaatggagtatatatgaaaagaaggaaaaatacagaagaacatggactgcattttcccattagcttgattcttatttcagaaagagactaacagccggtatagagattcatttagcctcattcacacagattatgaatacttggagcaggaaatattttatgtaacaatgagttctagcaataataatatttttaagtaattgaataatcacatctatttatgaatctaagactccaaacttttcatcttcaatagttcttcaagctaatacaagcatgagggcttcagaataaacttacatttttaccaacttagcagaccaaagaaaatgtttaaaaatttttaagtttgttttcccaacctatttttttttgttttgttttttgttttttgttttgagaacagagtctcactctgtcacccaggctggagtgcagtggcacgatctcagctcaccgcaacctccgccttctgggttcaagcaattctcctgcctcagcctactgagtagctgggcattacaggtgcctgccaccatgcccagctaatttttgtgtttttagtagagacggggtttcaccatgttggccaggcatctcaaactcctgatctcaggtaatctgcccaccttggcctcccaaattattgtgattatgggcgtaagccaccacacttggccccaacctattctttttaaaaatcaatactggccgggcgcggtggctcacgcctgtaatcccaacactttaggatgctgaggtgggcggatcgcgaggtcaggagttccagaacagcctggccaacatagtgaaaccccatctctactaaaaatacaaaaattagccaggcacgatagcatgcactgatagtcccagctactcaggaggctgaggcaggagaattgcttgaacccgggaggcagaggttgtggtgagccaagatcatgccactgcactccagcctaggcaacagagcgagactccatctcaaaaaataaaaaatgctatctcacaggtagtattcattttacttgttcaaaaaggcaacagttttatgaaacttttttgttagaacctgcctctgtctttgataccaatctcttgttagacaatttctattgcataataacaccactttgttccactctccattagttactgactgactacaccatagaagagacaggaagcaatacctcttatttaagctccacttaacacttcaagatctaatgaaggattttgaacaaaaacaaaagcacaacacaattacatagttaaacctccaatgactttgaggtagaaattgtatcatggaaatagttaactaaaaccaaatattaagacttatacagggaataaaggtagtagtaacctaatctgtaaatgtgactttgtactacattttattattttttcagcacgtctttaaaataacttttctaatgaaaattagtatgtctactatttagtaggcaagcaatgtgaagggaaattgatccacaatgacagttctactcattctgttctcactcatgagctgaatgtgcaaattgttccttgccaccatcccatattccccacacccaccacttgcagcattacaccgccaaacaccacccaggaacggatttcctatttcgtcatttaaacccattatcttgttcccttactatcttgccaaactggtttccctccacttacatttctgagatatgaagtggcaagataacaagtctagactgttcgtataaatagacagttgggtcctaaagttggagaaaaggaccaaaagccaatagtcctcttttttttcttttcagtgcactgcctaaaccactcagtaatcccaaagagcttgtccagttacaaagcatttctttgtgtatgtgtgatatgtgtgtgtgtgtgtgtgttgttgttgttgttgttgtttagagacagggctcactgtgttcctcacactggagtacagtggcaagatcatagctccctgggctcaagcaatcctcccacctcagcctcccaaagtgctggattacaggcgcaaaccatggaacctggctctttgtgtttcaaagggcactcatttcatggtattgtgcatcagctatccaacaagtgtgaggcaaaagactagcagtttaggaaagaaaatgagtgccatcttcaattgaaaactagcctttgcctaacttatcaactagaaaacaaggttaattcagtgaagatcaactgaatcagtaggagtgtgttcacatgtacaatgagagtggagctcttgtagttaatattttgagtgaatgacccagaaagagggtgtgggtgaacaggagtcctctagattcgtttcagaggatttctttcaatctaatcggagttgtggaaatgggaaagtctccacccatgcctcaaaatatgtccatccatgaacactgcagaattttatgtttttaaatgtcaggcatttggtcactgatttacagaataatgtttatctggaaatgactctaaagaccagtttggtgggtaacaaggaataaaaggtgatgttatctcaaaagtttgccatttagtgacctgccctaattacagttatttaggtcaatgtgtccacacttcagcatcctcccaaatgtagaggatgttgattacgtgtcctcagaaagctgcttgttttaattgacattgacttcagtaaaatgtagacagcgactgctgagaaacaaatgggaaaactagatgggtagcaccgtgcttggggtaattcctgggtaatgatttggcagtgagaggagggaccacaatagactaataagaacaatggtaaaatgggcataaaaggtaaacattcccagaatactgtttttcattctttttttccctataaatctttttgttgataactacagggttgaggggaggcttacttggatttaatcttctcaaaattgctggaaccaggatgaatgttcctagtcaaagtgcaaacttagctacctctcccctgattctaagaaaaaagtctcctaacagccccaggaacttactgcaaattccaagctttgtctttcatctctctgctcttggggctttgggtagtgccacatctggtggtggttttgtgtgaaaggaaataatatatataaataatttcctgtttggtcatttaaacctatccctgtgctggacagaatttgaccctcttcactcaatagcagtgtcttgtggctgaagtgcccgttatttacaactgctggtcagccagagtcagtcgagtacttttgcactagcccaaaagccactcaggccccctattctgacccttactgttttcatttacacaaatagttgttaatagcttcactgaaggctatgatttattcctttagagcctagaattatttttgacaagaaactcactgtctagtaaatattgtcattattatcacattattatcatcctcttctttttcatttttggagctggatttctttttctttttaagagatgggatctcactgtgttgcccaagctgaacttgaactcctaggctcaagccatcctctcacctcagcctcctgagtagctgggactatgggctagtgccaccacacctggcagagccagattttatgttattccaggaaaaaaaaaaaagctgagctttggctgagtgcagtggctcatgcctgtaatcccaacactttgggaggctgaagtgggaggactgcctgaggccaagagttggagaccagactgagcaatatattgagactaataatttttttttttaattagccaggcatggtggctttagactgtagtcccagcaactttggaacctgaggtagaaggattacttgagcccaggaggttgagcctgcagtgagctgtgatcatgccactgcactccaccctgggtaacagagttgagaccctgtttcaaaaataagtaaataaattaactaaataatgaaaactgagctttataatgtattgtgtaatgactaacatacagttttttaaggccactaataaaattagaaatatttaatactttggggcttttttttttttttttagacagagtctcactctgtcacgcaggctggagtgcactggcactaataggttggtgcaaaagtaattgtggtctttgcagttaccttaatagttcaccgtaacctcaaacccctgggctcaaggaaccctcccacctcagtctcccaagtagctaggactacaggcgcatgccaacatgcccagctaattttttaaaattactttttgtaggaacaggatcttgctatattgcccaggttggtctcaactcctggcctcaagcaatcttcctgcctcagtctcccaaagcactgggattacaggggtgagccactgtgccagccactacttgctttttactctaatcccttaaactaatttcaatttattcttccttagacataatagaaatgtatggatagttcattttagtttggatctcccgaagtgtttatgagaaaacagagaaaaatgtttacagcatcacaatatgtttgcccagggcaggtgagggcaaactgtggcgctctaggcaagtgcagccagtggcctgtttgtgtacagggatttttacgtttttaaaaggccgtggaacagaaaaaaaaaaaaaaaaaaacaaagaatataacatagagactatatgtgtctggcaaatttttaaaatttactgtctggccctttacagacaaaagtttgctgatccctggttcaggctagcatcatgtgttaaaatgtcaagccttgtatttagagaagctggtatctctttgaaatttatttaattaatttatttattttttggagatggagttttgctcttattgcccaggctggagtgcaatggctcaatctcggctcaccacaacctctgcctcctgggttcaagcgattctccggcctcagcctcccgagagctaagattacaggcattcgccaccacacccagctaattatttatatttttagtagagatggggtttctccatgttggtcaggctggtcttgaactcccgacctcaggtgatctgcccgcctcggccttgcaaagtgctgggattatagacgtgagccaccgtgcctggccttctttgaactttagacataaatttgggcactgcctgctgaattgaggtaaattatattcattacagtttactattttagttgattagatattgccactatttatatactcttctagtagttctcaattctggctgcattttaaaatcatctggggagctttgaaaatattcttgcctaggcccctataccagaaatcctgatttaattgatctgaaggggggcctgggcataggtatttcttacctgctattcaggtgagtctaatgtgcagccaggtctgagaaccacaggcctacaccactcacaggtctatttgtggatgggcccacattcataggcaggtttttttgtgttttgtttgtttctttgttttttgagacggaattttgcccttgttgcccaggcaggagtgcaatggcgccatctcggctcactgcaacctctgcctcccaggttcaagtgattctcctgcctcagcctcccgagtagctgggattacaggcatgcaccatcacaccaggctaattttgtatttttagtagagacagggtttctccaagttggtcaggctggtctcgaactccgacctcaggtgatctgcccacctccacctcccaaagtgctgggattacaggcatgagccaccgcacccagcccataggcagtttttattcacatttttattagaaattcaatacagatgcattatacaaattgttctttaatttcaaggcagaagtgttgcttagggaaattttaattgagactattttgaaatgtgaagagcatatgaaacagataatacagagcacagagaaacagaatatgaaagataggaactgagaggagcgtgctgaaaaaaaaaaagaaaaagaaaaagaaagaaaccactcagaatttcaatacacaaatcactgagtagatgtcttgctatctgtgtgagtgtacctattttcaaaagtgctgttaacataaacagagcagtaaatctggggcaccatgcttttttttcaaagttgttaagaattatatcagtctgcaggtgtcacacgcagttactcagaatcagaaagaaggctgatcgggggttagatctccatctatctatctttttgcaaccaaccacgtccaggctgtttatttaatacttcctcttgctaatgaaggtactggttggggatgggtcgagctttcccatctcggcataagactgcaagatttgaatgtgccctggtgtcggcttcactgaccacagcaggtaccccaggcaagaatctgagcagttataacaggtaacaacaatagagtgtgcatccaacttcggacacttctccttccagtttatttccttttctccccatgtaccaatgtgttcttttctctcttctttttacatttttccaaactagcaagtgcggaggcaagacacatcaaagcagagatgggaagtgaaagagctctcgtactggacagattagcaagcaatgtggcaaaacgaaaaagctcaatgcctcagaaattcattggtaagaatacaaacctttttcctgctgttgttagcagatagtttgaatgaaataacataggatgcttgctacacaaggcctttcctagcttaacctctgttaaaataattagtttttcattgtgtacttttattcttcatggttcattctgatagctctggaaaatagaataaaagatattaactaaagcatcatcatgacaggagatgggagtagttgatatccaatttcctaaatggatgtgatgtttaaaatcctgttccttcctctttactctgaatgacatatgttgcatgagagagtttatgcaatttataccagtaagatgttcaagatagcatttttgtaatcttttgtaattatattttacaagttggttcgttagcatgctcaaacttttttcatgctctaaaacatattgccatattttcttgaatttgagaattggctttaagggaaagtggttgggcaaacatagatttaaataacaaggtttgatttaatcatttgtcttactggagttcatttttatgccattggttttcacattgtcaaaaaatacagcagaatgagatgggtatgaaataattatgttcattgaagtgttaggacttccaaatggcagagacattttgctgaactctcccagatgtttacataaatgtgaccatgatatttgaaatagatttgtatttgtgaagtagacagctgaaattgaatgtatcagttttgctataaattgaaagttggtgatattgaacaaaaatagttatcacatgaaaatagacctccctcaacatcagtaatattttagaaacctgtctcagcctctttttccaaagctgcttgccgctgttgattttttatttcagtccttttgtatttattcttctcaatagctcttacagataataagttgcctgcctggtttttaaatctgactaaatttgattctggtatagataatgttttgacaagcaaacagtctatgtgaattatagaggtatattgaaagaacccatatatttcaaaattacctaatttggtatttctgcctacttattttattttgactagctgaaaggtttttgtgcacttttagtcactttaagaacaaattgtgtcagagaaaagttggtatatttcagtttagggagatcccctcctccttgctgtcctccctccccttggtgagacatgtcaggggagcatgtagtgacttccatttagagtttaggcacagtaaacaaatggtgagtttaagacattgtctacaaatattcccatatatcttttgggctttacttatgtgaagaggttctgactggagtacaaaagaaagcttgccttattattctgagtgtattttagtttggagaaagttatgggttttgtttgttggtttgttttgagacggggtctcactgtactgcctaggctggcgtgctgtggtgcaatcacagcctcaaacacctgggctcaagaaatcctcctaccccagcctcccaagtagctggaactatgggcacgcaccaccaggctcagctaatttttaaactttttgtagagatagagtctcctcatgttgcccaggctggtctggagaaagctttgactctagaaatggctgaagccgacaagaggagggacatcatagggagagctgggcaagaaaaaaatgtaaagcgacttcatttctttctttctttcttttttttttttttttgagacagagtttcactcttgtcgcccaggctggggtgcaatggcgcgatctcggctcaccgcaacctctgcctcctgggttcaagcgattttcctgcctcagcctcctgagtagctgggattacaggcatgcaccaccatgcctggctaattttgtatttttagtagagacagggtttctccatgttggtcaggctggtcttgaactcccgacctcaggtgatccacccgccttggcctcccaaagtgctgggattacaggcgtgagccactgcgcccagctgtgacttaatttcaatccagttgtggtcaatgcattttggtgtaagacaactaaaatttgagagacagtccctagtattttcggttgccctaaacctatagttgaactaaagccctacttaatataataaaagttgctttggtatttcatgggttcaaaaatatagcatgtttcatatgtgcaaattcatgccattttgcctgttgcctcggggatctatttcgtttgtttgctacaattgcaaccagaggattttcacttcactacttccagacttgtgagagatgctgatcttgtaggtgttgatttctctcatcttctgaaccatcacattctctctgtgctggaatcagaaacctagtagagttagctcttgattgaggtagcaacttcagggcttcagggcccagaataactgggggaattttttttttttttcgtaagttgtgttgtagtgcaataagaagagtactggattagaagctaaaagacccaggttctgatcctagctctgtcatttcttaactgtgtgtttagaccaatcacagaacctttctgggcctctctttactcatctgtgaaatgaggagactgaataggtgatgaagtgaccaggaagtctcctcccatgtacaagtctgtgagattaattagaaaagaaataaaaggcagcaattattgataccactgtgtgtttagaaagcccatgtgcgtaacttcagatagcctttttctcaaggctatacagatgtggtgtttatgctataaaccatatcctaggtttttagagtcttttttgttttaggaagatggtataaatctgagaatctaaaacacagtcgcattagcccgacattcatgtgttttacttagggcagtactacttgttcactcacttttttgtccattcattcatcatacagaaggttaagagttcctgtcatatatatggtattcttgttttgggcactgttctaatcttcttgcattaacttatatcctaaacttttgtttgaaaggtttttaaaaattaaaaataaaagaaaccccttaaattatttaattgaatcaacctttgtgatagaaaatagtaatgtcaacggagggagaaaggaacattatttgtgacactgtgcagtgtatgagatgaagtgatgtaaaacatggggctactgttttctctccatctcccctcgccttgcctcgcctcacctcacctctcctctcttgtcctcttgttccctcccctcctcttccctcctctcctcccttctcttctcctcttctctcctttctcctatatttcctctccaaggcactgttttttgaagattcagctgccagggtaatggcaatgggtaaggtgtgaaggaagagtgagtcattccctttaatccttgctgacagttgcacagcactcagaccagccttgacttccctgacctcttgaactgtgagggtaaaggtgaaaatagaccatcaggtcagcccgctgctatctcaggcgggctggcgataattaccagtagggagcattttgcatccattagagatgaactggggaagagggacagattggatcaagtctaaatgtattttgagacacaaacatgctctcaagttggagaaaaatatttttttttctaattctccaagaaattttgtatgtctttgtttcaaatgggaaaaaaaaaatggacacacgtccatcaggaatcaccatctttacattgtcagaataattctgtttaagttgttcttttcaaaggacaagaagaccttcctttgcacatactgtcctttaggggatttcctttctctgaatcttgttctcctgttataaacttgtttgactacacttcaaactaggccatcctcaaatacttggctcaaaatggatttctctcttggatgcagaagaaaaatgactacatttctgcatatttctcctgatttttattctttcccaaaaaaacagatgttattcagaccaaagtggttaccatagcatctccttattttaaaagttttatgtattactttattaaaggaagttttcataacgaaaagaacatgaaaaaaagatctcactcacctgtggtaaacatgttaatgaggttttgacacttcaacaaaccatcggatctccctgtgaagtaactaatgagaaattgcctgctttggttaacagcaacaggaagcagttttaatacctgtttctaagagaaaaaaaagtatttttccaaccccttcccaaaggcctgatgtccataatcctgtaagcattacaatgtcatagtatttttgggctattaggaaccaccagtgaggctcttttaccatggaaggaaggaggatcagagaggtggagtgacacagctggcaggtgacagagcagcgccagacctcggcctataaggcactgcagtccaggcccttccttccccaggaggtgaccaagagcagtgcatgtcatgcgcggggctttggacagcaaggagtctggtcattgaaagttggtgggagaggccaggtgcagtggctcacacctgtaattccccactttgggagtcctaagcaggtggatcacttgaggtcaggagttcaagaccagccgggccaatatggtgaaaccctatctctactaaaaatacaaaaattagccaggtgtggtggtgggtgcctgtaatcccaactatttgggaggctgaggcacaagaatcacttgaacccaggaagcagaagttgcagtaagccgagatcgcaccagcttgggcaacagagcaagactctgtttcaaaaacaaaaaagaaaattgataggaggaaaaaaacccttgaagaagggcaattgttctccctcaagggtgattctctttagaaaagaacagtcttccctggtgactccatgagaacagatgacatccacacagcacttcccagtgtctcacagaggacaaagacttctgcagcaaccaaatgtggtctccagctcagctttccccagtgccacccccacagctctctctgttctttcctccttcctgtttcttcttgttctctggctcccctctgttttccacctcctgcaagaagtgttagtttcacttaggttgagatcagagccatgatgatggttggatattctattttcctgccttttttgttcatttgcttttggatgtgtgctgatagtaagagtgagggataacacttgtgggaaattatatgacgcagcagcaaacacatttaagtgacttgaagaactttaagacttaagacctgaatatttcaccttaccccatcatggtgactctaaatattggatttctgttatttttctaaaggttcgatcattttgcccccctcttcaaaaaaacctttcaatggctcccagtggaatcaaatctaaaccattcagtcaggccttctgagccctccacaatctgtcttcaacttacctcttctaattttatcatttcagccaaccagtcctttacttcagccacaatgaactcctcctccctcttctgtgtaatatctcactcttgtctgaatggcctccctcacatctgcccttaaaatacacattgtaggccaggcacagtgcctcatgcctgtaatcccagcactttaggagaccaaggtgggaggatcacttgagctcaggaatttgagaccggcccaagcaacatagtgaaactctgtctctgaaaaaaaaaaaaaaatcaaaaacttagccaggtgtggtggcatgggcctgtggtcccagctacttagggggctgaggtgggagtatcacttgagcccaggaggttgaggctgcagtgagctgtgatcacgccactgcaatcccacctgagcaacagagtgagaccttgtctcaaaaataaaaaataaaaagaagcacacattgtccacattcccacacccctgtgttctctctctgctccatcctccctctgcactccaggcgagtttactagtctgcttcttattatagatatgactgtctccaccaccgtcactaccaccacctctgatttcaaggagactttaaagaatagatgaatctttgccccatattaagtgtggcatatttgagaagtaattcagttttctctttccactctcttggctactctatgttttgttctaccatgtagcattaaggatactgatttgtcatgaaatgatgtacatgctgcatctcctctagtggattgcaattttgttgtattcctcaaatcacctaaccatggtgctaagcaaataatgggaatagagtgcttacacatgcctggcactgctaagcactttatagatatcataacaactctgcacagcatatacttcttgagtgcatgtgctggtccatgtggaaaaagcagttgctgccactaagccccctttccctctgctatgggaaccatcacagcagaaaacctgaagtcactgctggtggtggggctgtgcagccatgggcaaggtagcagccaggaaacatcagttaacactcaaacatatactgggatatgtgggctcttggattacatcctggttctctgttcaccaactgggcaatcttggaaagtgaatcaaactgtttgtgctttaggttcttcatctaagagatgataattcataccttaaaaggtatcatacaaaaattagccaggcatagtggcacgtgcctgtagtcccagacacttgggaggctgaggcaagagaatcacttgaacccaggagacggaggttgcagtgagtcgagatcgtaccattgcactccatcctgggtgacagagcaagactctgtctcaaaaaaaaaaaaaaagtatcaacccctaatgggctggtaaaatgagacagtatgcaaagtatctaggatggcacggtggatacagcaggggctcaataaatagtacttatcattattgggattattgtatataaggcacagtgcaaggtactgtgaaatataaagaccagaagtaaacatattagggtggtgggtcttccccctcaaccctgcagacagagttctgaatccacttgctcagttaagggcccttttagctctagcctgtgattctgtacttccaagttggcacttagaagccaacaaccatatgtcctcaccacattgcatcagttcaggtcaggtggtttcttagtttagagttaacaaagccaagatataagacattgacacctttaaaaagaaccacaggtagggaatggcccaaccaggcagccttagtttctaaacttaggacttgctgttgccgtgtgtatttttgttggaagaagacctctaattcagcctgaagctggtatcatgaatcattcaaaggcgtggtgtgattttgactagaagctggaccagatgctccgtgcaggtttggaagcagttacacttttgtggtttgactaaccttttttatgagtgtgttactaaagaaacgtgagctgttggcttttcaattactgtagtttaccctttctgggtttcatacacattgagtcatcgtgtctacaggtgactgataatcatctgcactgctcaagttaccgtaactcagagacgaggggatctgatgattgcaagttgcatgcacgtgaacatctgaggctgccccatctccttaacaatgaacaatggtctgtgttaactacagaattcagtcacatatttccactcatccaggggtttatcttcctcttaatgttttgccttttacaattttagcactcagctgttttctgacatatgctgcaggtggtatagattgtgaaattgtaggccttgttaagtaaagcaaactcttaggagaaaggataaaatcagagtttgtgatgtgcctaccccacccagaaaccttctggagcctctctgttgggtgaaaagagaaaaagtttctcaaggacccctggtatttagggagatgaatagaggtggccacagtggaaaataaccaataaccttaaaaaggccaagaaaccgaagttcatcatttctgtgtcacattctagggaatgaatgtctgtgaccttagctggctctcatgttctcagtcttccagatggccttgaccaaagatatatccaatctggaaactgaaaataaaaaacattgattactttggccaaggtctactctgctgttgcttctcattgagtttccaagacagggtattttcgtttgcatattttttttctctctcaggtatttctctggaaactatcaggttggccttaaggtcagctgcttgtggggatgcaaagacaaattcatctcatgggaatagatcttttagctggttcttctggctccaatttctcactgttctggtctgccttacacattgctgttacgttaaccacaaacctgtctttctcaagggcaggtagccttggctcttggttcggattcacaccctacagtgggccattcggaatgcccaccattcggtcctaccatgcattatcttttttcagtgtttccccaaatgtaggatgcaaattgccagcaagcacatggagcatttaaaaacctgggtccacacagcaggataattattttctttccagttctctttcagtctcctggatcatactaaggagaaaaatttagacttaatttgatgccagttgtctttaacactaatctcacacttggtaatctctgtttttaacaaagggggaagggatcttagtctccaagtactcacagtagtatccgatcaaaatttaatgaaatgctctgtttcattgtctttatttttcatagttaccttctacttgtggaaagtgattctggttttccgtttatgttagtgatataaagtttccttaaaaaccacatttattttagaaaaagaaaaaaagaaagaaaatgtgaaccaaatcaaacagaggaaaaaaacccaagcatttaccaagtgttttccatgtggcaggccctgttctaagtgctttccagtgaccctgtgaggtacatacaattatcttcactttacatgaggacacggaacataggttaagtgacttgcccaaggtcacaaaactggtgaccaatggagccagcatcaaacccagcccatctgacaccagagtttattctctcaaccaccacactgccctggtgtgtggatattgcagaatgtgaaggaagagtgaagcctgagaaatactgtatttcatacttcttgatcgcgtttcagccagactcgctttctgcacacgtcccgtgtagtcccacctctctgccttcattcctgcactccccctcaactaggatgtcctctcccgcttctctgaaaatctaaattcttccagttcaagacccttctcaaaatttagattttccaagaatgctttcccttccccaagtacttctgaagtttctgcattcccttaatgcctaaatatacaatttataccaaattgtctcaccgatgcctgtatgttaccttattattctttttaaagaacacgttacttccctgcctaaatgcctcaaatgtgggcatttagaataaaagcaaagacctccatagagcaaagcagtccttttacaacttttttttttgagacaaggtcttactctgccacccaggctggagtgcagtggtgccatctcagctcactacaatctctgcctcccaggctcaggtgatcctcccacctcagcctcctgagtagctgggactacagatgcctggctaatttttgtatttttttgtagagacaaggttcctccatgttgcccgggctggtctcgaactcctgggctcaagtgatcctccctcctcagcctcccaaagtgctaggattacaggcctgagccaccgcgcccggccaacttttaacttatactttttctcgagttctatatatatataggtcttatttctcatccactaggttggagacacctcaagaacaggaactggttcttccaatccttttgttttctcatggcattttttcttcttcttctttattttcattgctgaaccctttactgtagggcagtgacaaattttggaatctcaacatgactaggaaacattatagaaggatatggtttagcaaatccctccaggatccaagctgacagaatggagaggctcaacagtgacctcagcctcacctccagcactcggctccacttcctcgctttctctcccctctccccaccactcaccactgagcacatctgccctcactgcagtccccatccctgccttccctgtgaccagagagcctctgttttctaacacacaacacccacacactctgaaggtggctaaactctgttttcaaaacttctcagcagtttgacatgagaagtaggagagggtgaccacaagtatattttttcagttaagtgtgagataggccctaatgatcacatgtgtatcagagatacacttgccaagcaaaggaagagaaacacacgttaggaaagggacaaagaccatgatctcttctcaagaaaacttttctcaaactttctacatttgaagctctttcacttcagtctcagtcagccaggacgggtgagtttggggagtagccagttggagtctggggggctattttctctatctctgtagctatttaaaaagctgccgaggtgaggcaccgagtgtccccactctttgcagcacttctgtccccctggctacctaatattgcaagcagaaaataacaagcaaaagcaaaataagagttgggagccgactgtgtcttaagagatcatgaactatagcagaagtcccaggctcctgtgggctggtggctcccttgtccctctagccccatcctagtgtcctgcttctttccctcctttcttgagggctctcctctaacatgcacagtgggcataccttaccatgtggcctcaactgaaccacatctctgcccctctcttctgcctgctggctttattttaaccatccaaacacgttgctgccgaccagtgtcccctgagacagcaccatgggaaaccattctgccaggcttggtcttcttgagcagcaggcaacttaactctcctccctttttgaggtctctagaaaatatttacaaactctctgccttggcagtgttccctttgtaaccctttctgtcacttgttccaggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactctgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagagaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaacaagcaaaaaacagctacctaaaacttcttgaaagagttcatggagaattggtgatacagacccaaagcaaatttgccaatgatattttccacaaaaaaagtccaaaaagtatggctcagcctccccctccccacaggagaggaattggagatagatggcatgtgtgtttagatcggagttgagctccggaatggggtgaggagggacacctctattgagaggttctccttgatcaggcaggcttcggccctttttttcccatttaaatggaactgctgtattccatgaaaattcctgaaagtctgatcacggttctgcagatgtataagtcatccttgtcactcataatgtgtacatactatcaggaggagtgctgttatcatggtaaaattagcactggaataggaggtcacaaaatgctggctaattagctatgtgactttgagaaatcgtttaacttttttttttttttttttttttgagacaggatctcactctgttgcccaggctggagtgcagtggtgcaatcatggctcagtgcagcctcgacctccccaggctcaggtgatcctcccacctcagcctcttgagtactgggacaacaagtgcacaccaccatgtctggctacattttgttctttttgtagagataggggtctcactatgttgcccatgctggtcttgaactcctgggctcaagcaatcagcccgcctcagcctcctaaagtgctgggattacaggtgtgagccaccacacccagccttatttaactcttaaaactcagtttccggccaggctcggtggctcacacctgtaatcccaacactttgggaagccgaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccctgtctcaaacaaaacaaaacaaaaacaaacaaacaaaaacaaaaaaaactcagtttcctcatccataaaataggaattagatttcaatgttctcttaggtcccttctagctttaattcatatgtgattatgcagtaaccacaaggtattttttaaacctcctaatgtatggatattaagcagaagagtatttatatgaatacatgtttcacattcctttggtatgaaaatggtgtgttaagtttttcctttaaccactgagttgtgaatgtgaagaaggtggtggagaggaacaaaaaacagaaaggtattttgatcttgccacaaagcatacacacaaattggcacatgcagctgtttgccaaagccttctttttttttttactttttaagaaattatgttagggaaaataaattctgcttccagggacaacttcatggagcctatttacaaattaagagtcagcttaatttgtaacatttctaccagagccaagaatcccaaattcctggtagattagtgttttatttctaaggggcttatgcattcggctccaactcaactcgtctatgtgctgccagtaattaaaatgttccacctcagactgcacaaatggcttatccttctttgtggcatggcgtctgtctcaggaaaaaaggttttatgaaattccatggcaacagtcccaacatgtttgagacttcagctaaaggaatggatgtattttggtgtgtagtcttcagtatatcactgtatttccgtaatactagactccaagctatgccagattgcttattccctttgtgaaagaggagttgctcattacgttcttgaaatatcgcacatcctgttggttcttcaagggacaagagaaagagaatttggaagcagggattagtagaagagaaaacgagggaaaggaagcctttccaccagattagtgttcaagtctttgcagaggagaccaactttttttgttttcttttgttttgagacagtctctcgctctgttgcccaggctggagtgcagtggcgcgatctcggctcacggcaacctccgcctcccgggttcaagcaattctcctgcctcagcctcccaagtagctgggattacaggtgctcaccaccaagcccggctaatttttgtatttttagtagagacaaggtttcaccatgttggccaggccagtctcaaactcctgacctcaggtgatctgcccgccttggcctcccacagtgctgggattacaggcatgagctaccgcacccagcctgagaccaccttttgcatctcaagattgtgaaaccaaggcccattccaccagcctggggactctttttatagatatgatcctcctttttcctgtgactaatgaatttgctgcatgatttctattcttctgaggttagttttctgagtaaggtgaccactcacaaaggcactttctttgtggcattctgagcctagattggggcccatcaattccagaaaaaatttatgtgtggaaactctgcatccttaagtcttgaagttgaaccagatatgcagtggttaccatcacacagataaacgctgccttctgtacataccccttatgctgtactaattaacaaaccccttgccagggctggggaggtgagggtgaaggagaatcttagcagaagggcagagtcaggacttgcatctgccactgctgggcactgaagccctggagcagcttcagatagtacctgtactttctcatgcagactccctctgaacaagagccttgtaggcccctctccttcatttcccaccagcctcttatcaggcgggctttccaccatacacccaggaggccacggtctgaggaacaaccaaacccatgcaaagggccgggcgcgatagctcacgcctgtaatgccagcactttgggaggctggggcaggcagatcacctgaggttgggagttcgagacctgcctgaccaacatggagaaacccccatctctactaaaaatacaaaattagccgggcgtgatggcacatgcctgtaatcccagctactcaggaggctgaggcaggagaatcgcttgaacccgggaggcggaggttgcggtgagccgagatggcaccactgcactccagcctcggcaacaagagcgaaactctgtctaaaacaaaaacaaacaaacaaacaaaaaaacccaggcaaagtttccttgcagccaaggtgacagaactgggctgagggtggaaaagaaacagaaccagtgctccaggtgttttttaattttttaatttatttttattttttttgtatatgtatatatatgtatgtatattttagaggaccagggtctcactatgttgcctaggccagactcaaactcctgtgctcaagcaatcctgcctcagcctcccaagtagctgggattacaggcatgcacaaacaatgcccagctctccaaatgttttctgtcactacctgaagtgttgcatcggtacttcctacggagagaaaactaaatagaagtgtctctcccgtgagcccccaccactaccaccagaaaaaaaaaagagagaaaatgaactcatcagtctttagtttcctcaagttattctcccaaaaagacattcgccttggcacagataagccagctaatcttatgctttatgacccactgtgagctgttcctgacacagcttctgactttgtcagtgacaaaatttctcaccttttaaatgcagtgcttaacattttgttaggcccatactcaaaatcggccagatataaaatgacctcagattttgatctcctaggctcaaacaatcctcctacctcagcctcccaagtagctgggactataggcacaccaccatgcacagctaattttttttgtatttttctgcagagatggcgtttcgccatactgcccaggctagtctcaaaatcctgggctcaagcaatctgcccacctcagcctcccaaagtgctggaactacaggcaagagccactgcgcccagccacaacctcagatttctttggcaaacagaaatgtttaaaaacacaaaattttgctcaggtgaaacactgtgttactatcaaatctcacatccacataaagtttttcttttcggctttgtttcgtgaggaacagacagaacaaagtttttccaggtagcatctgtatcactattattctcctatttcctgtaccacccccacctccccaagccctactgaatgtgaggtttagaatgttttaaggagggtcaggtgcggtggctcacgcctgtaatcccagcactttgggaggccaaggcgggcggatcacctgagtttgggagttcgagaccagcctgaccaacatggagaaaccctgtctctactaaaaatacaaaattagccaggcgtggtggcacatgcctgtaatcccagctacttaggaggctgaggcaggagaatcgcttgaacccaggaggaggaggttgtggtgagccgagatcgtgccattgcactccagcctgggtgacagagtgagactccatctcgaaaaaaaaaatacaaaaattagctgggtgtggtggtgcacacctgtaatcccagctactcgggaggctgacgcaggagaattgcttgaacctgggaggtggaggttgcagtgagccgagatcgcgccattgcaatccagcctggacaacagagtgagactccatctcaaaaaaaaaaaaaaaaagaatgttttaaggaaaaaaatagtactgttacatataatcccaggtgataagaccacaatggaaatgtttaagtcctcactttaaagagtaccccactgagaagaggtatgttggactctagcagagatttggaaactctgggacactcaagatgtgaaagagcctggctatctgaggactcaaagagtcagcatcgggacttgtgagctcaagaagagaaaagggagtggtgaaactttgtcctaaaagttagcaccaggaacagaagaaaaaaacccgatatatagtgatacctcatcttttagagaatgggaagctatttttgtgttcacacagaaagtatagttcaaaaaacctctatatccagagttcagacaaggagaatgatttgagatataagtgccgatgaaggaggtcaattttgatctgaaaccagcagctggacctgggccacctcaggaaaaggactctgttctccaaggcagcacgactgaatggttctgagaataagccagggttcaggactcctgaccctttaggaccatggactcagaagagcctgaaggacaattgtgggctttaaacttctgagagcttgtaaagtaacacaagactgtgcctctcccttgccccagctgtagatagtctttgccccaccattgttatgaagatacacagggttttgcagtttgaataaattggatacaagtttcctctttttttttttctttttgagacaaagtctcgctctgtttccccaggctgagtgcagtggcacaatcaaggcttacttgccgcctcaacctcctgggctcaagcaacgagccatcctcccgtcttagcctcccaactagctgagactacaggcgtgggtcaccacacccagctaatttttgtactttttgtagagacagggtctcaccatgttgcccaggctggtcctgaactcctgggctcaagtaatctgcccacctcagcctcccaaagtgttggggttacaggcgtgaggcaccgcggctggcctgagtttcttcttaatactgtatcacaattgtgggctgtcttatgtgttgatatcgattgagctatttgaaataggaatgttaatgggtgtattaaatttttgtaaggatataacaatatctaccttccaaggatgttgtgaggttttccatgattttgtatatgagctaatgttacctttgaggggtggtgtgcattatgttggatgattgtaaattttcagtggaaaatgtaccgtgtcctaaatttaaagacatgaaaaatatcccaagatcatactagatcataatagcaattcctttacaaatgaattatggaggtaactgatctctaacagtttccttcatgttgttttaatgcacaagggcagaggatctgctgacccttggaaccagcgtgagctaaccacgtgctatagacacttcatggtgtcgcacccagggaagtcaaagcgctttgctccctcactgtctgtgagtcctcagccattagtaccccaccccccgctgctccaaaacttgagttatttcaaatgtttctcactgttcatctctccactgaccccactccagaaagcctggagagagtcccaagatgccacccaccttccccaatccctcgccacagatctgtgtctatctcacactctgtaagtgccgctttgcttcttcctctcttgaaaagactgagaacacacattttaacatgttaggaaaatggggcagcctaaaaaatgactgatcccaccgccagtgactcatgtatactccaggctagcagacaaggccctttttggtgggcctgcttctgtgggttcacagaaaccaaattactgtgggttgcaaagaattagcaggtcatttacaaagcagacatcccttcacccagactgtggttttgcatgctcaggttctcagtctatgagctttggtgcaggatcattttggctactggaaaaaccatagcttattttaaatttctggttgccaaagccaccacacgtgtggtctgtggatgaccattgtctgcagaatgacgaggaaggaacagaatgtggtttggggctcagggtggccttcccactgggagggaaggcgggagggagcccttgccctgggttttgacacagcctgtgctcacagcctctcctctcatctgcatttctcagaaatgccctccctgcccagtggtgactttccctcgtcactcctatggagttctacctggagcccagccatgtgtggaactgtgaagtttactcctctgtaaagatggtttaaagaaagtcagcttctgaaatgtaacaatgctaacccttgctggaaccctgtaagaaatagccctgctgatagttttctaggtttatcatgtttgatttttacactgaaaaataaaaaaatcctggtatgtttgaaattagtccttgtgcatccttatcacttatgatttgtgtctgctggtgtcaggatgtagaagggtttcatcccgccccaaggaatactttcttaattttgcccctctatttcttaaagtccagttatcaagaaaaatgaattatcactgaaataaaggttctcacctgacgccttgctgagcctaccactgtgatcctgctgctggcccctgtaacccacaagatagggttcctggttccactggtccttagttcactaaggaaactggaggaggttgaggacctggacttagcatgatcagcacattcagcatggtgcacccctattccaagtcactgctctgccttcctccctcaacagagattcttcttaaaatacagtcaagttctgactttttcatgtgtgggggctcacagacatccacattgggaaacttgagttgcagtccttaaactcgaccatatttaaatacagtttttagatacttggagacccaaaccgaaggtgttagggggaaaagtcctaggagaatggcatagggatgaggctgctttctttccatcatcattgtgttctctcttagaaaacgttagagaaagtagagagagagtctggccttctgctcagcctcatctaaagcaccctccattttccgtcttctgtggaagaggcatgagaaagattgtctgaagttttaagactaacaaatgtggggctaggctggcaccagcgtcctctggctccatgatcagcatcatctccctcccatcagcactccaaaatgttcaaactggctgagggtctcctacaggtttcccagtcttgctcaagctgaggaggagaaaggaatggcatggcaccctgcctttgcattttagcactgaatacattcaaaaacggcccctcagtagctggttttcagccctggagagaagattatatggccttccccatccccaaatccctccccaaagcagaagcagctcaggcagaagagagggagacagggagatcctgaccccctttgccagtgagcaggaccggaggtccacactggcgttggggttgaatggactcccagcctgagaagagttttccttcctgatcttgggagctaattcaatgccctagagggtggtgggcctggcagtggaggccaccccacacctgcaccctccttcttcccctcccccatcactcaaaaccccggaccattcacttaggttgctgtgcccaaaccctccacctgcaggcaactgccacccgagggcaggcagggggaaaggacctagcttcctgccctcatctcctgtccctcagaatccagggtctgaggaagagtggaggtcacaactccaggaagaccagaaacactggcccaagggatggtggaggggcacattcggcccaggccacagttcgggctgtggagcattccgggatcagacagttgtttgcataaaagccaaaagccactgcacctggggtggggaggccctctggggaggtgctccctggcttaggggagaggggggaaggaaggtgtcatggaaagtccctgaaggacacggggtgttgaatttgctgtggttttgtttttaactctgtcttgacctgtgaagtaggcagctgcctcccttctccgcaaataacagatcttcccccagaataacacacatacccaaggaaagggctgcagtggaaaggcctgcgggtgatggcagctaccccccttccccaggagtgagggggcaggaagccccagaacagcctttcccatcacctcgcctctccaccccagtaccctggccccctggcccagaagagctgcctaggcaaataaaccacagcactgggggtggtggtggatgggaactaggggggcgatgccacctcctcccccgggcttgtccttccaccgcccaatccccatcccacccccactggaattgcattctcagtgtctcactgagaatgtctcactcacagacctcagctgccccgctagactcctggggagctgtgtgtctctttgcgtgtgcgtgtctgtctccatgtgtgcctgtctctctccttgcatgtctgtctgtgtgtgtctgtgtatctgtgtgtgtgcgcgcgtgcacgtgtctcgtgtgtgtgtgtttgtgtgtgttgagggaaagcaggctgagtcagtgaatccagcaaagctctgaagtcccaagcaaaagacagtcgcagactcccgcaactatttggagtcctggttccaatcccagccctctccctctcgggatgagcccagacacttgacttccccttctgggcgttgattttccccagagtcagggatctctgaagggccttccagctggtactcctaagacaggcctcaacctcactgcaccagccgggctccaggtcttccctctctctcctctcctcactggacgctggagctagagtaatagtggccgggccctgactctctcaagatgtcattttcctaactgttctatcaaat

SEQ ID NO: 1109 - DNA, 2098 bp, Homo sapiens
gcaggagcacgtggagaggccgggtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactctgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagagaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacag

SEQ ID NO: 1110 - protein, 509 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 1111 - DNA, 33454 bp, Mus musculus
  misc_feature (1)...(33454): n = A,T,C or G
taaatctgtctccatggctcacggtgaatgaaagtagagagaacacaggatgaagaacattgcaacagccttagtggcaactgcactgaatggttattaaagagactaaaaagctttgagaacactgccacttagtgcaacaatgatgataaagctggcactcagaggggggagacggggggggggactcttttttagcttttagagtttgaaatatctctaggacatataagcgaaactacatttttcttctttctggttttttagacagggtttctctgtgtagccctggctgttctagaattcgctctgtaagccaggctggcctctaactcagagaactgcctgcttctacctcctgagtgctgggatcaaaggcagtgtgccaccactgcccagtgatactcaatttttaaaaaaattagaaacctcactattatcttaaactctagaccctcctgtgtcgaccccctgagaagctgaacattacaaacagcaccactgcctctagcttttgaccatgtcaacaaatacatatactgctatataattgtcactatcattatgcttgtggacgtctggactggagagaggtttgggtgccatatagtaaccatgaatgtagatgaaatcaagagaacaggaaggaaaccgagaacttttggcagccagaactcgctgatagcaggttgctggagaaacttcttcacttagcctggaaagggactctagccagcctgagtttggcaaacatggctctgtcaggccttgcccttctctccactccctctgtcttgctaaaaacgttagattgagttcctaaagctagctaccgagatccgttcccttattcacctcatcctaacacaggatttccccttttacctttataaactgccactctcctatgggccatgcctgtctcctctctattcaaagacagtcctttgtcccctcttcgagagaaatacctgccccccccgtcccccccctcccctcttctctttccccttctccatctcctgtcttgtctcttattcctatacttcgtccctctagggcaaataaagctcctttgtcctgaaaacttggtcttggggtgtcctgagccgataccagtcccttcaaggctgcagtttgagttgcgaatgggaagagccaggcctgcagggggcgcagcgcctcgtctccgcacctcacacagcacggagccgctctagccacactgggactcggtggcggccggagttgcacgtcctggcacctcctccctgagcaggtgagttcgccggtggaggagggggtgcaagggtccacgggacggacggacgggcgggcgggcactgctctctatatgcgcggcgtgtgcctcggccctgacgggtggggcttcggaaagatccgtggggacggaggccgtggttgtggtgagcgcttcctcctgacctcacagtgccagccgccggcccccttttaactcacggggatccttatcctgggcctgctggcagcttccgggaaacacctggggggcggggccgtgtgggcggggttctgtgattgacatctctttcggcagattgaacgggctgcctccggacccctcccctatcgccaacgctgagccgaaaccatggtgagaaccctgagctcagcccctttcccctgcatgcccatgccctcatcccacgtggctatctcggccgggcttctgcaagactgcccttgcgaggcaaccggcgttcatattatcctatcctcatatccctggtagcatgggcgcctgaaggtgaagacgtccgaagagcaggcagaggccaaaaggctagagcgggaacagaagctaaagctctaccagtcagccactcaagctgtcttccagaaggtggggccctcggaggtagtccccaataatacaaagaccaaaagcttgaccctagagtcaaactgtagggatccaaattttgattctgtctgttgttgctgtattgccttgttcgagtcactggaactgccttcatctgtaaaatggagctgatgattgcacaacctgtgtacgagtattgcaaagattaagtgagaaaatacctgttaggccatgtaaggttttgcacagtacctgttgcatagtgccactattgactggttcagagtttataatgtttaacctagagctggggaaaggctgtggtccctgaccctataacctgtcttcacagcgggaggcaggcgagctggatgaatccgtcctagaactgacaagccagattctgggagccaaccctgattttgccaccctctggaactgtcgcagagaagtgctccagcagctagaaacccagaagtatgtagtagttcaggtctctgccctggccctcgcctgggtgcagaactggaggaggattggggtagccgggcatagagataggatagtagggggaccagatacaagaagggagggacaagttggggttggatgttggaaggctctaacccccctttctcttggggtccaggtcccctgaggagttggctgctcttgtgaaggcagaactaggcttccttgagagctgtctgcgtgtgaaccctaagtcctatggcacttggcaccaccgctgctggctgctgagtcgcctgcctgagcccaactgggcccgggagctggagctgtgcgctcgcttcctcgaggccgatgagcggaactgtacgtgtccacagtcctgtccctacaaacctcatgggccccgcatcctggtactgggtcctcagagcggggagggatacacaggatctagcaccagcatcctggtagtgctgaaagggatggcggaaccagatgtatgtataggagcagtctatgtagtttgcatggaggaattgctagggctctctgaggaattctgggggccgtcagtacagtagctcctctttgtcctgcgtctgagataggctccctccctcaacctctctagttcattgctgggactatcggcgatttgtagctgcacaggctgctgtcgcgcctgcagaggaactagccttcactgacagcctcatcacccggaacttctccaactattcttcctggcattatcgctcctgcctcttgccccagctgcacccccagccagactctggcccccagggacggctccctgaaaatgtactgctgagaggtgagtgggcctagaccagcagttctcaacctgtggcttgcgacccctttgggagttgaccaacccttttcattgggatcgcctaagaccatcaggaatatcaggtatttacatcatgattcatcgcagtaacaaaattacagtcagcaaggagcaaagaaaatcattttatggttgggggggtcaccacaacatgaggaactgtgttaaaggattgcagcattaggaaggttaaggaccagtggcctagaggatcctggcaaggattttgcaggagcacccagtcctgatggctgcctagccccgctctgcaccaccttatttagctcctcctcctcactgacacacgcagttcctgtgtgacgcttgggctggagagagttgggatcctaccatgctgacgcaaccttcctggcccccacagagctggagttggtgcagaatgccttctttactgaccccaatgatcagagtgcctggttctatcaccgctggctcctggggcggggtaagcagtgggggaagggcaggatgtttgagacttagaaagaaacaaagatgacatttaaggtaaaccgaggctgtttctctccctagcggagccccacgatgttctgtgctgcctgcatgtgagccgggaagaggcctgtctgtcagtctgcttttctcgtcccctgatagtgagtcgagctgtttttttaagcgcatcgtggtgagaccctgtgtctgaggccatgagggctaaggagactttctttgttccccgtggcaggtgggctcccaagatggggaccttgctactcacggttgacgaggcacctttgagtgtggaatggaggactccagatggcaggaaccggcccagccatgtctgggtatcccgggattggtggggcaggattagggtgggacagtcagaaaagcagtgaggtagcatgtttccttgaccagtgctctagctctgtgacctgcctgctgcctctctcaatgaccacttgccccagcacacgtttcgtgtcatctggacaggaagcgatacccagaaggagtgtgtgcttttaaaaggtgatgctgtctaaagctccccttgcctcgccagccccccagccttctctctcctctccccacagtgtcccatccaactacttaacctttcccctaggtcaccaggagtgctggtgccgagactcagccactgatgaacagttgttcaggtgacaagaaacccatggacaaacagagggtctagacactaggcagttgggggcaggagacataggccccggggaaggaggatggcttagaactctgggctgtaggcaacatgccttccctaaccttcccgctctcaggtgtgagctgtccgtggagaagtccacagtgctacagtccgagcttgagtcctgtaaggagctgcaggaactggagcctgagaataaatgtgagagcctaagccagctcccaaaaaccacacggagagaaagcctttccagggaacttccccgagcagagggtctcaagagactgtacacctttctcccccttctccctagggtgcctgctgaccatcatcctcctgatgagggcactggaccccctcctctacgagaaagaaacactggagtacttcagtaccctcaaagcaagttgggccttggggaagacaggccaggggaggcccagtgggccattaggaggcagtgacatcccccccaccccataactgcctgcttccccaccaggctgtggacccgatgagagcagcctacttggacgacctgcgcagcaagttcttggtggaaaacagtgttctcaagatggagtatgctgacgtgcgtgtgctgcacctggctcacaaggtatgggctcagcatgggccccttcctcctgctgtctttcccaccaggttgaccataccgtctttcttctagcctgctccttggttaggtcttgcttcctgccagtcagttcttcatcctgcttgtttcctggttttaagtcctgacccatcaaagctggactaggaatgtgtagctcattggtaaggccctgggttcaattcccagtgttgccttttaccatccatctgtgcattcctatgcctttcacactgaatggggccccagaacctaaatcccaaatcgtttctgaagatttctaaaagctgtccaggttctgctttttgtgtttctagtcatctttttttttttggtttttcgagacagggtttctctgtgtagccctggctgtcctggaactcactctgtagaccaggctggcctcgaaatcagaaatctgcctgcctctgcctcccaagtgctgggattaaaggcgtatgccaccatgcccggtgtttctagtcatcttaacaaatctgttgtacctcgtcactgcagaccagcacaggcccactcctagctttctgtttgctgtaggacatgccactctcctctgtcccacacttgaggtttcctctccccatctcctctcactaaccacccttccataaccatctgtctcctgtccctgacatagcacatactcctatacaccgggctgtttgtttcttgcacacggttagcctccaacaggggtcttgtaagatccgtgtggaacacagaacaggtggttgaagatgtcctagcacctgctgagtgttttgcccctctcctcccaacaccccccaggatctcacagtgctctgccatttggaacaactgctcttggtcactcatcttgacctgtcccataatcgtctccgagccttgcccccagccctggctgctctgcgctgtctcgaggtaaagtatcgattccctcccattctgtctggagtgtcccttttccactcagaagtttgcctgtgttatagcaggaccttctgacctctgactactgcaggtaaccgctttgccacccccctgactacccaggctggccctgtgagctttttcacacacctaagctggtcattccgggctgtccatggcttgtactagttccaggctgtgtgtttgaccttatgctccctcaacttcctgctcctcaggtgttgcaggccagtgataatgtcctggagaacttggacggcgtggctaaccttccccggctgcgggagctgttactatgtaataaccgtatccttccttcagtctactgtgcagacagtttctagggcaaggagcaggctgcaggggggcaaaccgcagaggcagagagcagacagctcatagggcaaggagcagcctgcagggggacaaaccacacacagagacagggtcatctcaaggcaggacaggaaacagggcttgggcagggtgagctgaagggagatgattgcctgaggctgtctgtgactatgattaacttcgactctggagttctgtagcgtgtgacttcacaagccagagttcacaggcaggcagcctgtggagatccttaggaaccacagagtagtctaaagatcaggaaggtccatattttaaagaattctttgatccctcttgaaatcggagggttagagcatctttgacccacatttccacatatccacttataaatactaagagccactttgagagccctctccacctctatgcccgcacaaggtcctgcttcccacagtcccctcttcagctaggcattctacagtctgtaagaaaccatcagacttgcttccaagcagcagcttccagctctggagtgtccagtagcagacagtgggtggggtagaactattgagctttccttgactccaccgcccaaggcctccagcagtctgctgcacttcagactcttgcctcctgccccaggctagtcttcctcaacctgcagggcaactcgctgtgccaagaagagggcatccgggagcgtttggctgagatgctaccgtccgtcagcagcatcctcacctaggaggccccatctcaccctcaccctttaacttattgggactgaataaagactggagaggcccctctaggctgccaagctaccattactgctgccctgacaacacttcctccattaccaccactgtgcattttggaaaaaggaagggaggggctctctggggtatggggccactgtcctgtgattctgtctaccaagaccctcagtgtttatggctggtcaggaccagggctgggtctgagttcaccatcagttttgggctatcgtggtgcctgagcttgaagctgggataggaattaggatcaggttgtggtttggactgctcatcagaagagctgtctcggggctggagagatggctcagcggttaagagcgctgactgttcttctgaaagtcctgagttcaaatcccagcaaccacatggtggctcataaccatctgtaataagatctgacaccctcttctggtgtctgaagacagctacagtgtacttacatataataataaataaatctttaagaaaagaaaagctttctcaccgggcagtggtgtcacaggcctttaatcctagcacttgggaggcaaaggcaggcagatttctgagttagaggccagcctggtctacagagtgagttacaggacagccagggctatacagaaaaaccctgtcttgaaagaacaaaaacaaaaagccagaagagctgtctctagctggaaaagactgtgaacctttctcctgtgagcctgccaccttcagcctttctgccctggcccccgttttactcacaactgagtaggctcaggacctctcagtgtttgaggaagaatgtgtcacagcatcttgccccacccggttcaaatgacaatattggtctctgtggattacattctgtggttgaaaagcccttgggaactctggtcccatttgatcctcatacactcagggatgagatgattaaaacatttgaactgacaaactgttctgacctgcccagggttgctgagctctgcatgctgaagccacatactaaactctttgctttagtgatttagcgcttttcctgtttctatattaatatagaatgattaaacagaggcctggcctcaacttgccaaggtatttagatgggagtctactcctgaggtgcaccccactacactgttgtggctttgaaagccgcagggaacaagggctcgagggagtggctcaggggttagggcaatgagtcaaccttagcatagtgggaaaagagggtgactggttaaaagaagaagagtgtagcaaaaccaggcactttcctgcttcactggaatctgccgggcacacgtgtgctcacatgccccgccccttgaagccactcctcttcttgtatcctaagtgatacacaaacagtccccaagtgaagccctttggctgacccgccacacacctgccttgaattttggtcttcattgctatgtgttagaagtctgctaggttccaaggcttgccagctgaacagggaaaaactcacaccatgcttactgtcagccttcttctgtaatcccagcacttgggaggttaaagcaggagagttactgtgagctcaaagtctgcctgggctatatgtgagatcatttcaaaacaaacaaaaaacaaaaacaaacaaaaaaaccaaacaaccaatcagtgtatatgtagatcctggagctgttcctacttccctggatacctttgtacaggatacatttccaaacagattgctgcctaggatgctgctttgtgtctgtctttcttttcttttcttttcttttcttttcttttcttttctttttctttctttttttttttttttttttgccaatgctattttcactatctttgatggtggcccatggagcggagtgaagaggtcctagttgtcggtgcggtgcctcggacagggccagagagagcctccctaaagctgtctggctcctctctgccttggggcagttttaatgacatctctgacggttcacccagagccagggcaggagctggaaaggacagagagtgtgttcctggagccggttggtctggattctcaagaagaattccaggctgcaaatgaggggaaatgcttacctccagctgatgagacactctcagtgaaagaagggaataccaggtagcctggggaggaggctcctgtccacccagacctgaaagcaagccaagacctaagccttcccgagactttcaagctgggaggatctcgaacttagaagaaacagagatagcccactcattctgggggctgtggaacagctgaaagagagacagaagggtgcagtatgctgaggggcatgagaagacctggtagagctggctggtcagggactgacaggtggagccagtttgagggcctggccgctgatgtcatctgtctgcagcctgaggtactgggaccttcctaggcaaaagaagttccagtcccagggaccagtttcacagggccaagcccggtgggtgctacaagagagcttagcagcagggccctctgagagcaaaaggaggcatctccagctagggaacagatctgccctgcaggcctgagtggaagagcccttctctttgctctctgaacacctagtgtggtaagaatcaagttggtgtgggatccgtcaccaaacgcctttccttttcacttcagcctcaggtctgacagaactttgatccggaccccctccttagcatgacctcagttcctagaaaggagaaagtgggtggagccagtctttcccgcccctaccagaggacagcccccagagactggcctcttgacaggagggatgaagcaaccctcttccccttttcccagaaactcggccccgcctcccctcccctcataaactgcttacccggcccgccctacaccttccactcgcgtggctacgtccagcctgttggtcccgtcccaaacgccctgacctgctccacccgggcccgggacccggtggtgccatcaccaacaccgctgccaggtgagaggctccagcttacaccttacctcagtgctgagccacagcgggccttcgctgtcaagggacacacagcccaagcccagaaaggaccgatctccagtgcgtacctgctgtgggctgagacccaattttcctggggccaaactctgcttacgcctgctgtgccatctccgcagccctgcctgaagtttgtccagacgtgaggcatgtcgggggactctgacccctatgcctcctacctgctgttaaatagtcctagaggctggacctctaaactgagaagccagcgggtggagagaccgatatatacagggtttggaggtgttctcttaggcaactgtgcatttcctcagatggatcttcaatggtttctccactggacatctgttttttagtatgatttgagagtgtctatagcaaggtggagaggaggtttttctctgcaatataaggtgcttcttctgggtgactgaatagggtctttggggcatctcagggtgagaatgtgattatcccagtcacctagctggtactgaaccaatttctctggatagagtttctgggtgggtgggatggacatcccaggcacaggagatctgagtgaatgagcaccctctgtctcttctacacaggcacaatggaaggtcctcgctcagacgtgggccgctggggcaggagcccctggcagccccctacaacaccgtcaccggagccagagccggtgccggagccagacagacgctcgcgctcccgccgaggaggaggccgctccttctgggctcgttgttgtggctgctgctcatgtgggaacagaggggacgatgactggggacctgaaccttctggctccagaagcagagggaccagctcccggggtagggactctcggggtggccgaagacccgagtctcggggcagtggtgtaaatgcagctggagatggcaccatccgaggtgagattacacaccttaacctagagctgagcctttatggaacctaaggtttatcctggcatctctaagggggcttctgagacttctgaggagggactgggctcttcgtgaactcttcactgacccatggatgtggtttcacagagggaatgctggttgtgactggtgtggatctgctgtgctcacgatcagaccagaaccgccgagagcaccacacggatgagtttgaatatgatgagctgattgtgcgccgtgggcagcccttccacatgatccttttcttgaaccgggaatatgagtcctctgatcgcattgcccttgagctcctcattggtgagtgggacctggaatgggaagggtaaagcccctagacttgaagggctggtgttaggttagagaggtctttaggctcctccccggcactcctcacctctgccaaaagaggctggtgccggattcatagtgctcccctagtggtgctctcagaaaagatgtggtcctgcagtttcctcaagctggctttccacaagcctccagaggcaactgtctttctcacagtgctggcccctgtgtctccttcagcacggttgactccatgtctccatgtgcccctctttctgggtcttgctgggtcatccccctagcccccatctatcaatctctctgcctttttatcacaaggcccaaggcaggtgcctccctcaccatgttgcctggtgaccgttgactgctcaggctggtgattatacagctactgggggcgggcgggtgactcttctaaccctttgattacagcccagccatgcacaccccagtctctaatttcccaggtacccctaccacctccagaaatgctctgggctctagaagcagtgaccccagagagccactctgccctttagtatctggagtattctttcctatggggcaaatggattggattcaattctctccttttagtcctgtaggacagtagtgacaatggccccagtgtcccctccccacttgagttcattgtcggggaaacaggtttgggatgttggactggggttctgccctgacatgcgggagagcacggggcggccaccaagctgccctaaggaagattgtcacaggctggtgtggtaactacttagggacacataaattggctcatagacactgggtggggttgaatgaattcctagtctctccccacttccagagcgactcgctcactgcctagttgctggtcttgttactctaggaagcaatccggaggtgggcaagggcacccacgtgatcatcccagtgggtaagggaggcagtggtggctggaaggcccaagtgactaagaacaacggacacaacctaaacctacgcgtccacacctcccccaatgccatcattggcaagtttcagttcactgtccgcacccgctctgaagctggagagttccagttgccctttgacccccgcaatgagatctacatcctcttcaatccctggtgcccaggtaagccagctggggtcaagagcagagggcaggtgggtcaggacttcctttcctgagatccaggtgggtgtctggacatctggtcataggaaaagacaccctcccattgtccaggagaggagactgaggcccagtatagaaaagagtcccacctcacttctgataaagggtcctggccacagccaatctttctcaccatccttccttagagcagtccgattaggctagaagcacccccaatcccacccccacccccaccccatagggatgagtcctgcagacccggcagaggggaaggcagggcccttgaagaaaatagataggatttgcaatttattttctggggatacagaggacatagtgtatgtggaccatgaggactggcggcaagaatatgtgcttaatgagtctggaagaatctactatggaacagaagcacagattggcgaacgaacctggaactatggtcaggtatggctgggctcgcatccctttctttctttctttctttctttctttctttctttctttctttctttctttctttctctctctctctctctctctctctctctctctcttactttccttctttttttcttcctttctctctcttttgttttgtttttttgtttgtttgtttgttttgggttttttttttttgagacaggatttctctgtgtagtgttggctgtcctggaactcactctgtggaccagactggccttgaacttacagagatctacccacctttggctcctgagcactggggttaaaggcacatgccaccactggtcttgcacactcattaaagggagatagaagtgagggacatggtgggccgacactagcctttggtttgagcatcacttgaggagctgtcatgacctctgccctcctgccttctagtttgaccatggggtgctggatgcctgcctgtacatcctggatcggagggggatgccatatggaggtcgtggggacccagtcagtgtctctcgggttgtctctgccatggtgagcacctctgtatctctaagccctatctgtgccttcctgccctgccctttatggattttccatccctgtccctgaagagatttttcaccccttctccctcccctccccaaccccctctatcccacctcacctttcattgtttctgtcctggctcctttggaatgtaaggcgccaaaccccaaacttggcacacccagtgttcacattccagtgttacagcagatgggttgggggagggatgggcaggtttaagttgacctctcaagaggttgcagtgttaggggttggggaatccagaaggtcctaagcacctccccaaatccagccgcaccctatcttttcctgggcaggtgaactccctggatgacaatggagttctgattgggaactggaccggtgactactctcgaggcaccaacccctcagcgtgggtgggcagtgtggagatcctgctcagctacctacgcaccggctattccgtcccctacggccaatgctgggtctttgccggtgtgaccaccacaggtagtacagggaatgggccaggaatagcctgggctctatgaggagggaagggttctatttctgcccagcccaactatggctacaggatagggtgccactaagggtggatgatagcatgaccttaattatcattaattagtgtctgcaactgagaggcctaagggagagaaagaagaggcaatagtccgggtctgtgtcaagcaggtggctttgtaacccacactgctttgcagcccaaaggacacctgggtcttctgacccctaactgtgatggtccctccaagcttggcaagttcagcacccttttcttcctgcggatgccgcacacacagccaacctctgccccagcccttacccctggctcttccacagtgctccgatgtctgggcttcgctacccgtaccgtcaccaacttcaactctgcacacgacacagacacctccctcactatggacatctactttgatgagaacatgaagccacttgaacatctgaaccatgattctgtttggtgagcacagggtgaggggtggcctgtcatgtgccctgaagatgacctgaggcttgagtatggatcggggctgggaggacctgaatgggaacctcaggcccagagccccctccttgcccctctaggaacttccacgtgtggaacgactgctggatgaagaggccagatctgccctcaggctttgatgggtggcaggttgtggatgccacaccccaggagaccagcagtggtaaggcaggccttgcccagaccctatccagaacatctccagctcctgtatgttagccccggtcttggctagacagccaaatctatagttctttgtatggatttatcaactgaaccaccaccaagccattagtttattttcctctctttagctacttgacttaattttattttataatttataatggttaatatactgagatggttcaaaagtcaaaagagattcaagaatattcagtaagaggtttccctttcctgataagctcattattcttacttgcttttttttgtttgtttgctttgcttcgcttttttcgagacagggtttctctgtgtagccctggctgtcctggaactctctctatagactaggctggcctctaattcagagtactgggattaaaggtcacaccacactgcccagttcttacttgctttttaatttatatatcccagatacaattaattaaaagacacgcatacagagagaaaagttatgagtaataaatgtgtgaatggaaggacaaaacggtattgaattgaataagataaaatataacagtttcttattttcccttagatgtctttaaagtaaatttctatgggggggagtcccaggagtcccacccaaaatcttttcatcagtcttggtccatcagatttccagcaataggatctagtagtatgtatctatttcttcccagtcctggttttgaacctggggctttgagcatgctcagcatccatttttcattctctatttcaaaagttcctggtaattcttatggacacccatgtttggaacaaacctccatgccaatggaacacatggtaaatgcggctctgggaggcagaatggctttgtctgggtctccagcagaatgaggcctagtttcccttctttttgttcccctgttcactgcattcatgtgcagtatagagaaatcagggctcaggcagaaaacagctctgtaactgtcagatctgacctgggcgacacgacctgtcagtcgcttatctcttctctgcatccgcaaatgctgtctccatagcagtagccctgttcttggctctgccctcgtgacctcctctccctctggctgcaatgctccctccaggttactcagcctgtcccaccagctacttccttctctcctccaccttcctagagtcagacagccttggcctgacttacattcttctgcccatttcccagaaccctccctgtcaatcatctatgtaaaaaggtgtcctgggttgcataacctagcaatgctcaccgtggacttggagacttgatctctggtccagctctaagaagtaatggggtaggtgtcaggcaggggccctcacaggatggccagggcttcggtctaccacgattacttcttagatgagtgatattggcaaggaagtaccttacacctttgtgttttgtattctgtgtgtgtgtgtgtgtgtgtgtgtactagagaccatatggtgtggttgggaggattaaatggacaccatgtagcatgtagcatgctgacaacattacagctgctaagtcggtagaagctttcccagctgtcttataaggtcttggcatccgtcacactggctaggcctgtttccccatctgccgaaggaggccagagcattaggtgttaaggttctttcctattggatagccctcacctcctgttttcactttctgtcccagcctgcccatttcagccagctcgccatggtcctcggtagggaaccctcctgagtataaggacagtcccttcttgcccaccacccttctcatttcccaatcaggaaatcagagagtgctgcaaagctgaggtgtttctgaaggggtgctcgatggtgctaccactgctctcagccaaccagaaccattataggtcctggattgattgtgatgaaagactgggggagggtgtcctgcactctgagattcatggacagtgcagcctgccagctcagagaatgtgctaacaacctggttatcaagttgggctgtccgcaggcccctcccactcccaccctgctgttggagcctcgtgtggcctctagaccagaccacaagaggaccccttggccttcttagacccatcgcctgcttcatttcctaggcatcttctgctgtggcccctgttctgtggagtccgtcaagaatggcttagtctacatgaagtatgacacacctttcatttttgctgaggtgagggctgggctctaggtgcctcctctagcaaacagtctgaagtgaccagagccttggcttcagtcctgaacactctggtcttgacttccccgctgactgactagctgtgtaacctcgggcaagtcactcattctagagtcatggtttcctcaactgtaaaaaggagataataatggctgcctcgcttcctgtcctcaggatcaaaagagataatggatatggggctgcttcattagttataaagcaagcgaatacgcacaaggaattactgttattaatgccaaaatgggctacaaggagcctcctaggcaagcttcttcccctgctttcagagcatggcaggttggccctgcctgcagtccctagagttgagggaaggtaccggggtctcgctcgcctgtcttcctggcccttcagtcctgctgacctttgctcaccacaggtaaatagcgataaggtatactggcagcggcaggatgatggcagctttaagatagtgtacgtggaagagaaagccattggcacactcattgtcacaaaggcgatccactccaacaatcgagaggacatcacccacatctataagcacccagaaggtaacatgctcccagcccagcccgctcctggctgagggtccccgcagagcctgtgcctaccccagccagagctcaaacgcacctttgacctcaacccccaggctcagaagcagagcggagggctgtggagaaggcggcagcccatggcagcaaacctaatgtgtatgccacccgggactccgctgaggatgtggcaatgcaggtggaggcgcaggacgctgtgatggggcaggatctggctgtctctgtggtgctgaccaatcgtggtagtagccgacgcactgtgaagttgcacctctacctttgtgtcacctactacactggtgtctctgggcctaccttcaaggaggccaaaaaggaagtgacattagccccaggagcctgtaagtggtccttcctcaatcctgtccctagatggtattccctctacctagatggtgctcccttcccagccctgcccctagatggtgctccctcccagccctgcccctaaatggtgctcccaccccagccctgcccctaaatggtgctcccaccccagcactgtccctagatggtgctcccaccccagccctgcccctagatggtgctcctatcccagccctgcccctagatggtgctcccaccccagcactgtccctagatggtgcttccaccccagctctgcccctagatggtgctcccaccccagccctgcccctagatggtactcccttcccagctctgcccctagatggtactccctctcctgccctgcctctgggtatccaagtactatggctttcacatggaggccctacagcaacaggcagcagttctggggaaactttctggggaagaaggcctgtgattaccatgcattttcttcccagcggactctgtgaccatgcctgtggcctacaaggaatacaagccccaccttgtggaccagggggcaatgttgctcaatgtctcaggccatgtcaaggagagtgggcaggtactagccaagcaacacaccttccgtttgcgcaccccagacctttctcttacggtgagtgcagctttctgggactcatgggggtaaatagagacccagagcttgaggctaaggaaaactgtgggcaaggggagcacgctaagcctgagacaagttaccctgatgagccttttcggagaaggttaaagtccagatctggccttagtttcctcatcaataaaatgggttctcaggtccaattctgtttcatattcagattgcagaatgaatatgagttgcctcctcaatttttgaggtagcttctctgaaggactgaaatgtggaacttggcgagattttgaaccaaacacatttctcccttgggtacaaactgtgggctggccagggtctctgatgaggggtggatttctctctcactcagttactgggagcagcagttgttggtcaggaatgtggagtacagatcgtgttcaagaaccccctgcctgtcaccctcaccaacgtcgtcttccggctcgaaggttctggattacagagacccaaggtcctcaatgtcgggtgagtcacccaggctgccctgagcctcggttttgcttctctattttggtcaggaccccacagagcagcttggggggcagctggcagtctctggcacctcggaccaattcagcccaaccagtgttcaagacttgctgagtacctcaagttgcgctgtgtccctgccctgcctcacctgttaattagggagctgaaactcacatggaaatcattagcagcccatccctaacacttgccaaatatagaagtgttgaccgtgcactctctcgggaggattatctcatttggagatcatgcaggccctttaaagggcattagagaccatcatataataaaaaggggagctttggaacttgaaagacttaggttcaagaccctgctccactgctcctgactaggtctctttggccaggtaggtgctttcttttcttctaagcctgtgtgggctcacttgtccagggaagatagccaaagcctctggttacttagtccagcctttggtatagctagtctccgctgtatgagtgggaaggccagtggtctcagcccacagctcagaagggcaagctttccccttcagtgacacaaactacccggggtctctgcttgctgcgtggtctgtgcagtgagaactgagccctaatcctcaggccctcagctagcttggatctgatctccactgggtgaggctccggacccaatgagggcactcggcacttatgtttctgtgcctattgctgtcacctggcacagacatgtatcactcactcttctcaggaagagcgtggagggaagagaaggcagaggaaggcagttttctcctgacaggagtggtctcctgttctaagagaggggctgtgagaaggtgtagagtaaaggcccctcacctacctttcccttcataccttacactggtagccactacttttgttatgaggccaaagatgagtttattgtcttgttctttggcctagcctgggactcaggggttgtcacatcacaaagtagcacaaaatgaaccctatgagggcctctagcagttcagatgacagggtgtaagatgtgccctgggacattcccaccacagtggaaaggcgttttaggctccctagatgcacacacccttgccaggctcagcagcccctgcggctcttgggctgcttctcccccaaccctccaccagaagtacaggaccactgtgcttggtgcaaggagaggtggcctctttcttctgtggacggcttgcatggtatctaccgtaccctcatcctctcctctgagggctccggattccaagatgggtgttactatgcctctcatttacacatcaaaggctgtggtatggagctcaattataccaccaggtgtgacaccccagcctggtgactggccactaaataaacattccaggactcactcctccagttgactgtgtcaccggagaggctggaagttcttgggaatttcccccagaagcagaatcacactctctcaaaatctttaatggcctaaatcccttctcgaaaggtgggcttgactttggagacaaggccaaagccatttaaagattaattaccaaggaaaacaagcaaggagatattaatgtctgtatcatttagaaattacgcataacacaaaggagacatgggtgcctgtacctgcctgtgagggatggagagggaggaggagccagagagctggagtatcagttgccaaggacagtttcatcgccagcagttaaggatcagcccagctttagctgctgacttgctctcagcttaaactcaaaagcaggggtggaagccaggcctggtggcacacgctcttagtaccaccccttcagaggaagaggaagacagatctttgtgagctggaggccagcctggtctagaaagtgagttcaggacagcaaaggctctgttacacaaagaaatcctgtctcggaaaaaaaacaaaaaccaaccaccaacaacaagaagcgatgcggcaagggtctcatctgagctatcagaatgagtctggggaagattttgacattcctactttgaaagtagacagcagttttttttgggaggggggggtgagggcagaaataatattagtggttgtaatataaagatcagcttctgaaatacaacaactcatttatagtagacgtttgaaggctcctgtaaggctaagcaacctttaactgtccatctatagagaaatgggggaaaactaaggacacaaaggtgtggccagtcaaagcataacctgttaaattataggcttaattttgcttcctgtcggaacacttcagaaaccatctgaccacctcatctcactttgatgcatgtctgtgttatgaaccagcaagcgagggccaaagaagtagcttgtctaaagccacacagttaactagtggactactagtcaggtccagggactcctcagaagcagccgccaagctgagtgttttgccccaaggaatgctcatcttcaaaattagaggtgccagcttgttccctaggcagcccacttcatggggtctagggccaaaaaggaaccctaaggcaagcgtgggttgaattggcaataggaagtgcaggtttaggaagaattgggagattttctaaaagccatgaatagactccatataaatgcaaccatgttcatacttaaaatgcagagtgtcaggtgggatggtaaatgcctgcaactgtagtacttgagagggtggaaagttcaaggctagcctcagccacgtagggaatttgagactagtctaagcttcttgagatcccctctaaaaaaacccaataggtcaaagaataaagtacgtaggttgaaggaaatgcccagaaaaagaaaagattgattctcttggggacaggaggtgctggggtggggtgtgagctaggacctggagaataaggatggaagtggcagagctaggagctcagggcagggcaggcacggccggccaaccatgcagaacgaggtggaggtgagtttgtgtgaggagaagatactcggtggggcaggtccacgggaagaatggtgggggtgatgcagctgcgccagggtgggggctgagtcagagtgagcctgtacgtcaggttagggagttgacttctctttcagtgagcgccaaggatgcccagcccttgagggatttagctcccttcccagtgattagcagcagcaggctagggaaaagccgagaggagtctggagaacccgtgactgccacgggtgttcgggtatatattttcagagctccctgaggaaaaggcaaaggtgttggtgtcacactttggtgtcacacacatgcacacacagagatatgagaacgcatgtcattttagaaatgccaaatgtcctttttcctggctaacaaacagccttcagtacataaagttgttccttctttgtgaggacaactgggcagatttctggcaaaactgaaagcatttgggatccctgttgggcctccaggtcttgctctaaagtgcccttggccttgacaccctggtgaggtggggtgcttgagatagggcagcagtggagagaagagcagtccaggctactgtggagagcatcagcagtctccatccaggtgggagagggagggaggaggtgaggtgccggggaggctttagtgcaagtagctgggtgtgtaggtgccatcaagctgtgtggaggtggccaagggtggaggcggccccccggggcggaggctctgtccgggttgtgggtgtagattccaggggaacccagaaatacctgtgtgttaagctccacctcttgctttttccttcctggccacactgggtcagtccttgcttgactctacccgtagccaaggttcatgacactgtctctgtctacagggacatcgggggtaatgagacagtcacactgcgccagacgtttgttcccgtgcgaccaggcccccgccagctcattgccagcctggacagtccacagctttcccaagtgcacggtgttattcaagtggatgtggccccagcctctggaggcagcggtttctcagatgctggaggtgacagtcgctctggggagaacatacctatggcatatcgaggtggagcttaaccctgggccaggagcaatgggactggaatcagatgaacaaggacattgccccaagatggggccccaccacagagtagctccccaggctcagacaggaagactggggcacctggggaggcagtcgctcttcatttgtgctgataataaactggttttttttttttaataaagatgctgtttagtagtcctgtctgtctaggccaagaagtatggagtcacattgtgctggagggttgtttttttttttttttttggttttttttttttttgtttttttgtttttcgagatagggtttctctgtatagccctggctgtcctggaactcactttgtagaccaggatggcctcaaactcagaaatccacctgcctctgcctcccgagtgctgggattaaaggcgtgagccaccaccgcccagctaggttgacttttcttgaggctctaattctgaggattgtggctggaaggtgccatctcagtcaccctggagataaagcatgcttaaattgatggccaccacacctagcccaaactgtattttcaaatattcttgtctaaatgaggcgtgatagcacaggcctgtgatcccagttacttgggaattaggaggatctaaagtttaatacctgcctgagttacagagtgagttcagtggcagcttgagtaacttagggaaactgtgtcccaaaatcaggagtgaaaagagctctgagattatagtacaggaatagaagaccaggcacagagtctgcctggtgcacttaaggacctggatttgaagccattgcactagaatgaaaaaaatttgcagaactttaatagaagtaattatgttcagtgttggaagtatgcagatataacaggggacaacaaggtggctttatagggaaagatgctgctaccaagactgacaacctaagttcaatctccaggactcaatggtaggagggagccggttctgagtctcacaagttgtcctctgacctccacatacacagcatggcagcattcagaaggctaaggcaggagaatcatgaatttgaggccagcctgcgctacacagcaagaccctacctcaaagccagcaagcagttggacatgatgccgcacacttttaatcctagcactcacagggcggaggtaggtagatttctgggtttgaggtagcaagtttcagagcagctagagacacatagtgaatctctgtctcaacaaacaaacaagcaaacgaaagagagagagaagataagacgatagttttgcttctgggccactttcagattctcctgaacctctgtggcttcagccatctctgttcagtcaatgggcgctgggtaagtaactcgggggttccctgaagtacttccttatccagctagaccttctacacaatattagccatccttgtggttttaaggaccaccagctctcaagcttgcttatttaccaccttcctgtacctctactagatatctgatggacactccagatacaatatgactaaaaattaaattcctgtctctccatcatattctcctgcagccacccccatctctgtaagtaacggctctgctgtccccaaatccttgcactggaaatcttgaagttacattcttctgcatgctaccatcagtctgggctaatctggtggctctttctttacgcaaccatgccctgaagctgactgtgcccactgcatctgcagccagcagcggccaactattcttccatcctttccccagatcactgtgttgagcttcctggttattctccccacttgccctctctttgttcatcactcagccaccatcagaatacagtgaatggtcacatccaccctctgctcaaagcctagcgtgcttcaaagcccggctcttctgacttgttcctctgacccgcaccttcctgtcctgcagtctcagtcctggtctgggctttgccctttggctttcttgtctgtgcttctgtttcagggactctgtgtgacttcctcctctactggaacaagtccttcccccagacatctcaatgtcttgctccttcacccctgtttactctttgtggtccaggttgatgggaccctccttaccactccatttaaaaacacctacataaactccttttccctgtctgttccttttctctgtagctcacggcatatatccaattctttgtatggtagacttgttagcagattctctttttccaatctgcctatcacagtccatgcttcaaccttgcactcctcctgccccagttccccaagtgccatttaaaagctcacatatctggctcaaatatatttttttccttttcaatttattttatgtatgtatgtgtgcatatcatgtgtgttctggtacctgtggagattaggagagactgtccggtgccctggaactggagttgaagcaggctgtgaactaccatgtgctactgggaactgaacactggttctctattaaagcaacaagtgctttcaaccactgagccatctctccagcccccatgcatttttcatggaatgttgtgtgtagagggatttttaatctagccacatggctactctggctggaatacagacatgcccttagtgcatacttataatcccaaacaatgaaggtaaacttagtttgcacaaggaagcaccaagtttggaagtgatgtctgagtggcagaaaaagtgacgaatcagagaaagatttgacagaacagggtatacccaagtctggtgagaacagataggaaagggaagtgagttaagaggaagcagcacaggggagagagggcagttttactgggacagtcgtacagacacaggctgcagagagagaataagccagacgcatgtgaagaaggagtgagccagagaatgtgaagccagaagattagaacaaattgccaaaggtagtgggaagccaagcagcacaacttagtcggaagctgaaagaagccagtctgagtcagtcagcatggagaggagtccgagcagctgagctgaccagccagccagagttcagaaagagctaggaaggggagattattcagcaataggtctcagaggctgcgaacattctaggcctagattagatagtacagagtctagaagctgccaggactagacccaggttagcagacaacgcagtcagcttccaagatgacaattacatcaggggaataaaagttactcttccagttacgtattcatggcctcaggtgtttcatagtgtcaattcggaagtgaataaaaaaagaaattaaaaaaaaaaaaaaagagggcatgagtgatcctaggtatggtgggggagacgatatgaggaagatctgagggagagcatagccagaggcagacacatccgggaagagtccagagcaaacatgaccctgagaagagaggtcagaggaaggcaggagactgaaagaccacgaggccaggaaagtaaagggtacaaagggccagtgtagccaaaatggctgaattctatagagaacagctgcagggggaagggcagcccagcccctgggctggagaagtcagggtaaggaatggagtatgccagccataccctgcaaaggatagggactgagggacactaggaaaacctagaggccgggtttactttgataggctaaataggtaccccagttagctgtttgttttggatttgagaattaacagtaagctgactctaaattagcagttttcacatgactttaaaagtaagtgatgggggctggcgagatggctcagtggttaagagcgccgactgctcttctgaaggtcccgagttcaaatcccagcaaccacatggtggctcacaaccatccataacgaaatctgatgccctcttctggagtgtctgaagacagctacagtgtacttacatataataaataaataaatctaaaaaaaaaaaaaaaaaaaaaaagtaagtgatgtagctggatgtggtgggcattcctttaaagccagccctccagaaacagaaacgggaggccaattcagccaaggctacatagtgatatatgggttttgtttttgtttttgctttttgtttttaaagcaactaactttttaaaaaaggaacagacttattttctgatgattttttaatgctaagtaatattaaaatgttttaaaatatctaaaaggcactctcgctctctccctctctctctttcttctcatcttcctccttttcctcttcttccttgccctcttctttctgtgtgcttttccctttttcccttcttcctctatcccctcccacttccccatggcaacttctctgatcttggtccttggagccaatgaactcatccacccaagagcagcttcccaactatacacacacacacatacacacacacacacacacacacacacacacacacacacacacacacacagaagggtcagcaagatggctcagtgggttaggcacttgctgtcaagcctgacgagtactgagtttgatccccagatcctcccatggtggaaggagagaactaatagttgcaagttgcctctaacctcctatagtatgcatatgaccctcacacatactcacaagtatctataaaggagccagaagatcggatggtgggatggcagtcataccatttggcaggcagaggcaggaaggtttcaaatctgaggccagcctgggatacatggcaagttccagctcagtctgcactcaaaacccttatcttaaaaatagataatataaataaaaaagatatgggatgatgagcggttatgtgcacatgctgagattattttatgtgtatgaatgttttgcctacgtgtatgtatttgtaccatgtgtgcacatgcctggtgcccttagagatcagaagacggcattgggtcccctggaactggagttacagatgattgtgagccaccatctgggtactgggaaccaaagctgggtcctctgcatactctgtatgattgattggcttgttagcaaagtctctcttcacaatctgtgcatcatagtccaagctttaagtgcccttaatcactgagccatctaccgaacccccaactactaagaggcttttatataaggggctagagtagcgaaggatgacttaaccttagatgtgtgtggctctgtcccaaacgtcttcattctgaagaccactcaccagtgtcatgaaaagagctctgcatgacgagaactgatctggccatggtggtgaaaagacgcccaggatgctaaggggcctagagagtgcctaaccttccttgtttgagcaagagggctacatggaggcagttatcagaacaagccaggggtatactaaaatggttagcattcttgcatggcataggtgatgccctaggttgattatcctcatgtgtaaagaaacatgaagacatgtacactgggaagatgcggtgtgccgaaggctggcgtgtaggcaagcacagaggcaagggataaataagcctgaagacagcctggccaggtcagtcaaagttctttctgcagactgttttgaggatctctgtggcagagtacttgccaaacatgcatcatgaggccctgggtccaatctccagcactgcaaaaaattctcttgccatctttttggggatttgggccttagtgtgtgtggtgtgtgtgtgtgtgtgtgtgtgtgtgtgtgtgtgtagagagagagagagagagagagagagagagagagagagagaatctcatgtcacacttggttggcctgaaagacaaagtgctgctggaattacagacagactaccatggttgtgtgagaccctgacttagagtgtttctccctggaaggtaaagcccctggacgttccccaagcttgttttccctgatctctaaaaatacagccagaaagaagctctttgttctctatagccagcaaaaagcctttttgtttctgagccttacagccagagatgcgataaatgtaattttaccaaggacatacggaagagaagaacactcctcccaactcctcccaattcctcagctagctgttaaaagccccctactattactgcttggggtcaaactcccctgccctgcacagctgaaggagttcgtcctcagctagctgataataaaacctcttgcagtttgcatcaggtgtggttttctctagcgtcattggggtgctggccagctcatcccgggacttgagaggaggcccagcttcgggggtcttacagctggactttcttccaatgcaaaggggacctttaagttaaggatgtatggtcagtttttcagtccaccaggttttaatgaaaccaatatgacaaaaaaaaaaaaaggaataaaaaaaaatcaaagcatctttgggctggatatagagtgtagtccccttaggatgaaagacagcaaacctgaaatagaagaaatagtagacaagaagggtggccttggttgtagaagcagaactgattggtgatcagttagatttcagaggaggaaggacagaggtaagggctctggcttggatgtctaaactcatcgtgcagtgaagacagatgatatgcacaccatatggtgcccagaaagagtagccgatcttaacagggaagaggacttggttttccgttcataatagaagcaacttagaagttactgtggggagcagataagtcctgagtgaatgtatatggtttgacatgaacacagccatgataaggaccccaatgtctcagactcatggaaatggcaaagccttccccaggtcaggctcaaggaactgacaagagacttcccttgggcgcggtgcgtgaatgctaagtatgcgcagaaagtactagtccccatggcctctgggacaactgcagtaggagactgcttccgtgtagagactcctacagagatttgctacgcatgcctttttgttcagctgtatataattagtccgcctccgcgatccataaagaaacacactgggtttcagggttgctgttactgttggtgcgtccatcagagcacaccgcccaccagattccagcctttctgtacttgtgtctgcgtttctgtcctttcttcgttccctcagtgcccccttcaagtccatccctgtgtcgtagagcgcagcaggctctcagtagcatcaccacaagaaagaaaagcacagaaggctggagacaggttagcaggggaagtgtctgccaagcaggacagaggagctgagtttcatccctagagcctgcagaagcaaggaaagaaccaattcctaaaagttgtcatttgacctccacacagactctgtggcttgttcacacatgtacccaacacacacaaacacacacacacagagaatgataaaattaataaaaatggaatgaacttcaggtcaacaacactatgtagattatcagaattatgagcacaagtcaggtgtggtggctcacatccgtaattcaagtactgagaaaactgaggcaggaggatgaccataaattcaaggccagcccaggctacaaaggaagttccaggctaaattgagttatagagtgagactcttgtctaaaaaagagaggaagaaaaacgtgtgagtgcaaggcaaactgctctccccaaactggagaggaggaggaagattcggaattacaacagcaggagagcagggattccgtgggaaccagtaacacatgaaatacaagggacaaatagctggatgctccacataaataacatgagttctagtctccaggggctgggtccattcttaggcgcctccacgttcacagctttgcttctggaagctttcccagctactcagtgaaaactataggaaagtcccctaggcttcccacttttcttcttcttcttcttcttcttcttcttcttcttcttcttcttcttcttcttcttctccttctccttctccttctccttctccttctccttctccttctccttctccttctcnnnnnnnnnnnnnnnnnnnntcctcttcctcttcctcttcttcttcctcctcctcctcttcctcctcttcctcctcctcctcttcctccttcttttagatatggtttcactatatagtcgtgactggcctgaaactccctgtgtaaaccaggctggccttgaactccaaggtctgcctgtctctgcctccccagtactgggactaaggtgtgaactatgaactgtggctttaggcttcattccactttttcccccagttatttatttatttattcactttacatactgatcacagtcccccagtccaactccatccccctcaacttctcctctgagaagggggagcccccgcccaggtatcaacccaccctggcacatcaagtcactgaaggactaggcacatcctctctcactgaggccagacaaggcggcccagttaagagaacaggatccacaggcagctccctgctccagttgttgaggacccatatgaagaccaagctgcacatctactacatatgtgctagggcctaggtccagcccatgtatgccctttgggtggtgtggttcagtctctgggagcccccaaaggtctaggttagttgactttttggttttcttgtagagtccctatcccctcatagtccctcaattcttccctcaccttttccatgagactctccaattctatctaatgtttggctgtgggtctctgcatctgttttagtcagctactgggtggagcctctcagaggacagttatgttgggttcctgttatagccctcattaatagtgtcagagattggtgcttgccccgtgggatgtgtctcaagttgagctagtcattggttggcagttccctcagcctctgttccatctttgtccccatacttcttgttgacaggacaaaatttgggtcaaagattttgtgtgtgggtcggtgcccttatccctccactgggagtcctgcctggctacaggaggtagcctcttcaggctcctgtacaataaaagaacttctggagctattattccacccggaacaaagcctgccctcaaagaaactaaccctggggctggagagactcttcagtggttgagagcactgggtgcatttctagaggactggggttcagttcccagcaccaacatggaggttcagccatttgtaactccagttccaggagatcacacaccctctacagacagcaggctcacttggtgcacttacacatataaataaatctttaaaaagaaggaccaaagaaagaagagatagagaaagaaaagaaaggggggaaggggaggaaggaatggagggagggagggagggaggggaggagggagagagaaaggaagttaggaagttaggaagttaggaaggaaggaaggaaggaagtaaggaaggaaggaaggaaggaagggaattcaccagctcaagtcactaaaagtccagttattctggaaaaggagatgttttcaactttagctcctcccaccctttacaagggaaactcaactccagcctactctggctttcatgtttacctctaaggagacaagaggaatatatgagcctaagaaacacttgtgagagtcgcagctctcagcacaaattctaaaagacacctacacaagtgtaggacaagagaatgctctcaacccctcccagactcctctccaccccctaatcacaagagctcttatagggctggcgaagatgaccctgcaggcagagccactggctatgaattgatccctcgaacccatgtaaaggtgggtggaaagaactgacttcacagattggtcctcagacctccatatgttcatcgtagcatacgtgtacccaataatttttaaaggacaaaacagaactcttggaaagtaacaggaatataagagaaaacctgaacatgttggatgttcagaagtttctagaagttgggcgtggtgctagacatccacaacctcagaactttggagatagaactaggatggaaagttcaaggctatcctcagaacatagccggttccaggctagcctgaactacatgagactctgtctcaaagaggagctggggggagatggctcagcagttagcagttaagagtgtttgctgctcttgcagaggaccagggtttcttttccagcatccacatgactgtagctggtctttggctactttgtggattctttttttcttccacccttctccaccccctttctacttttcaacccc

SEQ ID NO: 1112 - DNA, 2723 bp, Mus musculus
ggctacgtccagcctgttggtcccgtcccaaacgccctgacctgctccacccgggcccgggacccggtggtgccatcaccaacaccgctgccaggcacaatggaaggtcctcgctcagacgtgggccgctggggcaggagcccctggcagccccctacaacaccgtcaccggagccagagccggtgccggagccagacagacgctcgcgctcccgccgaggaggaggccgctccttctgggctcgttgttgtggctgctgctcatgtgggaacagaggggacgatgactggggacctgaaccttctggctccagaagcagagggaccagctcccggggtagggactctcggggtggccgaagacccgagtctcggggcagtggtgtaaatgcagctggagatggcaccatccgagagggaatgctggttgtgactggtgtggatctgctgtgctcacgatcagaccagaaccgccgagagcaccacacggatgagtttgaatatgatgagctgattgtgcgccgtgggcagcccttccacatgatccttttcttgaaccgggaatatgagtcctctgatcgcattgcccttgagctcctcattggaagcaatccggaggtgggcaagggcacccacgtgatcatcccagtgggtaagggaggcagtggtggctggaaggcccaagtgactaagaacaacggacacaacctaaacctacgcgtccacacctcccccaatgccatcattggcaagtttcagttcactgtccgcacccgctctgaagctggagagttccagttgccctttgacccccgcaatgagatctacatcctcttcaatccctggtgcccagaggacatagtgtatgtggaccatgaggactggcggcaagaatatgtgcttaatgagtctggaagaatctactatggaacagaagcacagattggcgaacgaacctggaactatggtcagtttgaccatggggtgctggatgcctgcctgtacatcctggatcggagggggatgccatatggaggtcgtggggacccagtcagtgtctctcgggttgtctctgccatggtgaactccctggatgacaatggagttctgattgggaactggaccggtgactactctcgaggcaccaacccctcagcgtgggtgggcagtgtggagatcctgctcagctacctacgcaccggctattccgtcccctacggccaatgctgggtctttgccggtgtgaccaccacagtgctccgatgtctgggcttcgctacccgtaccgtcaccaacttcaactctgcacacgacacagacacctccctcactatggacatctactttgatgagaacatgaagccacttgaacatctgaaccatgattctgtttggaacttccacgtgtggaacgactgctggatgaagaggccagatctgccctcaggctttgatgggtggcaggttgtggatgccacaccccaggagaccagcagtggcatcttctgctgtggcccctgttctgtggagtccgtcaagaatggcttagtctacatgaagtatgacacacctttcatttttgctgaggtaaatagcgataaggtatactggcagcggcaggatgatggcagctttaagatagtgtacgtggaagagaaagccattggcacactcattgtcacaaaggcgatccactccaacaatcgagaggacatcacccacatctataagcacccagaaggctcagaagcagagcggagggctgtggagaaggcggcagcccatggcagcaaacctaatgtgtatgccacccgggactccgctgaggatgtggcaatgcaggtggaggcgcaggacgctgtgatggggcaggatctggctgtctctgtggtgctgaccaatcgtggtagtagccgacgcactgtgaagttgcacctctacctttgtgtcacctactacactggtgtctctgggcctaccttcaaggaggccaaaaaggaagtgacattagccccaggagcctcggactctgtgaccatgcctgtggcctacaaggaatacaagccccaccttgtggaccagggggcaatgttgctcaatgtctcaggccatgtcaaggagagtgggcaggtactagccaagcaacacaccttccgtttgcgcaccccagacctttctcttacgttactgggagcagcagttgttggtcaggaatgtggagtacagatcgtgttcaagaaccccctgcctgtcaccctcaccaacgtcgtcttccggctcgaaggttctggattacagagacccaaggtcctcaatgtcggggacatcgggggtaatgagacagtcacactgcgccagacgtttgttcccgtgcgaccaggcccccgccagctcattgccagcctggacagtccacagctttcccaagtgcacggtgttattcaagtggatgtggccccagcctctggaggcagcggtttctcagatgctggaggtgacagtcgctctggggagaacatacctatggcatatcgaggtggagcttaaccctgggccaggagcaatgggactggaatcagatgaacaaggacattgccccaagatggggccccaccacagagtagctccccaggctcagacaggaagactggggcacctggggaggcagtcgctcttcatttgtgctgataataaactggttttttttttttaataaagatgct

SEQ ID NO: 1113 - protein, 848 aa, Mus musculus
GYVQPVGPVPNALTCSTRARDPVVPSPTPLPGTMEGPRSDVGRWGRSPWQPPTTPSPEPEPVPEPDRRSRSRRGGGRSFWARCCGCCSCGNRGDDDWGPEPSGSRSRGTSSRGRDSRGGRRPESRGSGVNAAGDGTIREGMLVVTGVDLLCSRSDQNRREHHTDEFEYDELIVRRGQPFHMILFLNREYESSDRIALELLIGSNPEVGKGTHVIIPVGKGGSGGWKAQVTKNNGHNLNLRVHTSPNAIIGKFQFTVRTRSEAGEFQLPFDPRNEIYILFNPWCPEDIVYVDHEDWRQEYVLNESGRIYYGTEAQIGERTWNYGQFDHGVLDACLYILDRRGMPYGGRGDPVSVSRVVSAMVNSLDDNGVLIGNWTGDYSRGTNPSAWVGSVEILLSYLRTGYSVPYGQCWVFAGVTTTVLRCLGFATRTVTNFNSAHDTDTSLTMDIYFDENMKPLEHLNHDSVWNFHVWNDCWMKRPDLPSGFDGWQVVDATPQETSSGIFCCGPCSVESVKNGLVYMKYDTPFIFAEVNSDKVYWQRQDDGSFKIVYVEEKAIGTLIVTKAIHSNNREDITHIYKHPEGSEAERRAVEKAAAHGSKPNVYATRDSAEDVAMQVEAQDAVMGQDLAVSVVLTNRGSSRRTVKLHLYLCVTYYTGVSGPTFKEAKKEVTLAPGASDSVTMPVAYKEYKPHLVDQGAMLLNVSGHVKESGQVLAKQHTFRLRTPDLSLTLLGAAVVGQECGVQIVFKNPLPVTLTNVVFRLEGSGLQRPKVLNVGDIGGNETVTLRQTFVPVRPGPRQLIASLDSPQLSQVHGVIQVDVAPASGGSGFSDAGGDSRSGENIPMAYRGGA

SEQ ID NO: 1114 - DNA, 33037 bp, Homo sapiens
agtttgaggtgtctctgggacaccaggtgatatccaacaggtgtttgaatatgtatgtgcatgtatattatttattgttatttaagcttgcaagacatctgggctggagatataaatttgggtgtcatcaatttacaggtagtaattaaaacaatgagtgtggatgaactcacccagagaaagtgtaatgccagatttgtgggccaaaacagctctgaggagctccaactcgaagcagttgaaggcttacatttaaacattctcccaggaacagtgggtgaagtgaaaaaggggtgaggaaagggccctggagatcaccaacatttaggggtggaggtgaacagatgagaagagagaggcagaggtgcaggaggagaagccagaatgggggtgtcaagtataaagaaatgggtagcgtcaaatgcttcagaggttagagaaaatgacaggaaactccccctgttagatttgacatctagaaggctgtcggtgtggccagggtgaggtcagtggagtagtgaaggtgcgggtttccggctgttggagaaacctcttccactaactacattgcactctgagttaccaactggcatggtcctccccccatttcacacgcacgctacagtcgcccgtgcgcactcgtacacaccaggtggctaacaggtacgaggcgtttccggacagcgagcgcagagcccccgcgcacgcgcctccgagccggcctcttccgccgcaagtccctccccaagcctgcagagtgcgctgcgtttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatggtgagaaccctgagcccagcccttcacctccgcaggcccgcgccctcacccccagtggcagtgccatggttgccccgtatgaacctagggctccacagtgtggggtttttgcaggtcagcttctgcaaggcaacctgcactcttccaacccgttcatccttgtagcacggacgcctgaaggtgaagacgtcagaagagcaggcggaggccaaaaggctagagcgagagcagaagctgaagctataccagtcagccacccaggccgtattccagaaggtggggccctcagaggtagccccgaccccaagtagctcccttagtatagtgcagaggccaagagctggtccctagagtcagactgcctagatccaattctgggttatctcacttataactgtatgactttgggcaagttgctgaatctctttgggcctcagtttgctcatctgtaaaatggggctaataattgcacctactgcataaggctgttgtgaagattaaatgagagaatacctgtaaggccataaagcatggttcatagtacctgttgtataatgtgggattcacagaatattggatggttttaagtttacgttatttagtcctgtagtgggaaaattatatgatctctaaccctgccacctatcttcttagcgccaggctggtgagctggatgagtccgtgctggaactgacaagccagattctgggagccaaccctgattttgccaccctctggaactgccgacgagaggtgctccagcagctggagactcagaagtgcgtagggattcaggatctcagaagactgccctggccctgcgcctgcactgcctgggtctaggggtggaggagaaatggggcagccagtggcatagatggaggatagtagggggctgggtgcagaaagtgaggggtgagctgaggttgactgtaggagagccctgaccccccccttcccttctgggtacaggtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactgtacgtggctgcagattctgtccccacagccctcacctgcccacattctggtactggggcctcagtaaggcccagaatggggagggatatccaggatgggtcccctgagctggtgctgaaagggatgttggagccaaatgcatcctccgtggagtgcactgaggtgtttctaggggttcctgaggggactctaggggtcccagccaggtagctcctcttgccctgcctctaagatatgctgtcacctctcccctccagttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaaggtaaccagggtcagggatgctcaggaggactctgcagtgccacccttccagcccccatgcctgaccctgttcctgaacctgtcactcaggtttattgagcacctacttcatgcgtggctccaggggtgcttaagaatcagtccctggctgaaggaagcttaagtgtctgatggggaagataaaactgacatacgtagcccctgtgcaaggacagcatataagtgagactgggggctggaagtactccaaggagagggtagggtgttggagtggccaggagctcaccagtgtcctgaccacagccccatgcctcctggaaccccacagagctggagctggtgcagaatgccttcttcactgaccccaatgaccagagtgcctggttttatcaccgttggctcctaggccgaggtgagcaatgaggaaaggggctgggtgtttagcgcttaataggaatgggagagggtttaaagaaatctgacactgtctccccgcagctgacccccaggatgcactgcgctgcctgcatgtgagccgggacgaggcctgtctgactgtctccttctctcggcccctcttagtgagtcctgcagcttttgtcaagagcactgtgggactgtgggcctggtgctgatggggctgaagtctttgtcctttgtgccaggtgggctccaggatggagatcttgctgctcatggttgatgattctcccctgattgtggagtggaggaccccagatggcaggaaccggcccagccatgtctgggtatcccaggattggtggggcagaagttggggtctggggcagggctgggtgggacagtcaaaaaagtggttaggctggggcatttccttgacccagtactcccagctctgtgacctgcctgctgcctccctcaacgaccagttgccccaacatacatttcgcgtcatttggacagcaggcgatgtccagaaagaatgcgtgcttttaaaaggtgatggaacctgcagcctccaccccttgcagcagcccccatcactcttttcctctcaagggtgcaccctccaaccacctactctttccccaggccgccaggagggctggtgccgggactccacgacagacgagcagctattcaggtggtgatagggaagcacaaaacaaggagaggggctctggactctgggcatcaggcagccagggcaggaggctggggcctcaaggagctgtttcagtctagatactgggaatgttgaccagtgcttcagggctgtgggcctcaactcctccccaccctgcccaccctcaggtgtgagctgtcagtggagaagtccacagtgctgcagtctgagctggaatcctgtaaggagctgcaggagctggagcctgagaataaatgtgaggccccattccgtgagagtctgctcccagagcccgctgaggaaacctctttccagtgtggccctgagaggacagcaggaaggcctcaggaggatgggagcagaggaggttccaagagaaaccctccttttccctgccctctcctcagggtgcctgcttaccatcatcctgctgatgcgggcactggaccccctgctgtatgagaaggagaccctgcagtacttccagaccctcaaggcaagttctgtctgcagaacagaccagggggaggcccagcaggcaggaggcaggcagctgacatgcataccctgcccacctcatccactccaggccgtggaccccatgcgggcaacgtatctggatgacctgcgcagcaagttcttgctggagaatagcgtgctcaagatggagtatgccgaggtgcgtgtgctgcacctggctcacaaggtatgggctgccatgcatgccttcccctggccctcatcccgctggcctccccacgtccctgactttgcccccagtctcaggtgcctttgtggacttccaatcaagatagagttcatccctgcctcccagcttgctcctcttccaggcctttctgtcactcagcccattcttcttcttgccactcactttcaaatcccgagtcaccaggacctccttgtgctgtttcttccccaggctggtcacagcttcatcttccttcagagtgaccgctagcccactcctcccacacattccagcacatctcaccctggagcaacctccaatacctgaaggccaaatactttccagagattcctgagaagttgtccaggctccactttcctagtccttcccaacacattagttttatcacatcaccacagcccacctccattcctgccaaactcatctctgcctcatcaggaccagtccccatgggggaccagtctttgtttacccagcaccctccactggcccctgtacctccgaactccaggcctcctcctcctcacccaccccactggttaccccactcgcagcactgtctgtcccacgtcatgtactgctgtgggctgtaaggtcagcttcccacatgctcccatcctcttcttggctggggtccccaagggcctgtggggcacagagggcatgtgcctaataaatgctggccgaggaccctctcccaggtctcctgggaagcccatcacctccttcctcccttcaccccccaggatctgacagtgctctgccatctggaacagctgctcttggtcacccatcttgacttgtcacacaatcgcctccgaaccctgccacctgcactggctgccctgcgctgccttgaggtaaagtacccatgtctccgtccctgtcacgggtggttcttttcctcttcctctccctcagaagtctgcccatcctacaaggagatgtgcaggaccctccaccccgaacaggtaactgcgtgccttccacctccatcacgcagcctgaccctgtgagcccctctgtgctctgtggacccgtcaccctgagctcctcagttgctgaaccatccctggctgacagcgcctgtcctgcctccctgccctccctgcccccaggtgctgcaggccagtgataatgccatagagtccctggacggcgtcaccaacctaccccggctgcaggagctgctactgtgcaacaaccgtatccttccttctgggtgcctttcagacagtgggtaaagtgaggtgccaccctgggaagggacagacagcaggcagggtatgtgccaccctcttgcagggcaggagagagggggctctgtagtgtgagttgaagggggagagcctggggctgtcgggctatcactgacctgcactggtggagttgtgcggagtggacttcctcaagtcagagttcacaaatgggcagcccgcagctgttcttcaggtctatgtagttttttgaaaatcaggaactttcatactttaaaaaacatctagagttctaattcctctcttaaaaattggaagttagagcaaccttacactggtattttcactcagcagcccttggtcattgctgaatagtaaatgtctctttggaccaggctagatttccaccttatcataccctgcaccactcccctgatactacaccagcttgcgtggggtgttgcggctcattctttcctggctgaccctgtgggtaggcatttgcagtccctgcctagagcctgactccctccagggagcatatgagatgcccatcaaacagacttccaggcagcagtccccagctcttgagggtacacaggagcaaataaattgggaggaacctgccaagctttccttgactctcctgaacaaggcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaagctgttgtcgctgctatcactacaccaccaccttcatcacttttattttttgaaaagaaagggaagagacatggggtgttgccagctccttctttctgcgccatcctattgtttcctctcagagagagccaaggcttcagtgtttggggcagaattcagggtgaaggctgagcttttgtttaccttctggtttggggtgggggctgggactgggtctagattccaagcaggaatagggcttgggctcaggttctggctctggtaagctacagagcagctgtgagtttctccagctggaagcatcatacaattttttcccatgacccctgcaccttccacatgttccccctgccctggcccccattcaccatagctggggaggctcaagggctccacgttcccaggaatgggccagggtgtccttgctccgtcctgcctgaacaacactatcggtccccatgagtagcattctacggttgaagtacctttgagaatacttgataccatttgatcctcacagagtctcagggatgagatttttaggcccagtgtactgatgaggaaactgctgttgagacttgcccaaggttcttggccggagcgcttcagcactgaaaccaaagttgtctctacccttggtctaggattctagactcatgttcttgcttctgtattgctaaggaatggttgggcagcggcctggcctcagctccttgaggtcctgagctgagtgtctgctcccatggtgtccccccacacataccatgtacacaccttgtcctgacctagagagtcctgagtggtggtggggggaggggactggctcaggggttagggcactgactcaaacctggctgggtggggagagaaagattgattaaagctagggagagagtgtgacaaaggcatcctactggttctctgggatctgcctgggcccacatgtgctcacacacgtccggacagccagggccctgccccttcccgtatctgcagtgatgcacaaatccgcagcccctgcacaaagccctctggctgacctgcctggaagtttatatccactggtgtgtctactgagggtgttggaggtggggcacctgcccccacccccgggcaggttctggtgcttggagctggacaagaaaaggcagtgtgggtgtggagggctccctgccagttcctggggcctctctgtccccactccccacggcacctccctgcctgatgcatcaccaaacagcccctcctggattctgtttccttgtgtcttcttgtcagcctgtttttactgtcttctgctaggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggttggagaaaagggaatcctctagtccaactgagcagagactcctctcagtgagagaaaggtactctgtacccctggaagggggactcagttcccacccaagcctgagtggaaaggcctaaacatcccctaacccccgaggctacagcgggggtgggggacgtgaaatgagattgctcctactctgatctccctaatcccaaacttgagggcagctcactcatgcctggggctgtagagcagctgagaaagaagggacagacttgggggtggagggagtcagaatatctggtagagccagcaggtcaggggttagctggtggagccagtctgagggcctggctgctgatgtcaccagtctgcaacctgggatcccaggacctccctgggcaggatgagttccaggaccaggcccctgggccaatttcatagggctgagcctggcttgggctgcacagaactcggcagcaggagcctgtgagagcagaggtaggcagcctaagcttgggaccagaaggtcggccagacagggctgtgggtggaagggcctgcctgccccactgcccttgcagcttcttcatccgggagaaggggctcctcacatgcccagtctggtaggaatcagcctggtgccaggggccatcacagcggtggctcccaccaaagcccagcctaagcccccagacctcacccctgctccctccctagcatcttctccccatttcccgcccagaggcctggcctcttctctccgccccctacagcagtttggcccctccctcccacataagtcacttaccaggtctgtccctgcggcatccagtctgtgggtcctgtcccatccatcctgacctgttccatctcagccccaggactcagtactgcggttgccaacactgctgccaggtgaggggctcccacgggtactgtggtgccgagtccaggcggcccacactatcagaggccgtgcctggatccagcaaggtggggtgtgggccagctgtgtacctgtcagccccagctaggctgttcccaacaccaagactctgctttccctgtgcacaggctccgggcacctgccatgccctacccctcctggcagccccaagtggggtcttccctgacttgggaatgccaaggaccacaggccccggggtcacttgtctgtcttgtgaggaaccttgagttgggggatttctgctaagaaatgagttctagaagctgtcagtgttgtgcacctctagactgcagagctagcaggtggacggaccaggcccagggatgctggagcactctgatgtgtgtgcagctgggtcttgaggctgggacaagtgtccatgcagggaactatgtggatttcctgggatggatcgttgagtgggtttcttcattgggcagtttttcggatgttgtttggtgggggtgaggggaaggcttttctctgcagcatgagaagcttctctgggtgagtctgaatggtcttcgcggaaggtctctggatgtgtctggagaatctctgggccaaggtgggattgtttcggtcatcgggtgggactgaatcagctgtctggatggagggtttctgggtcaactggctgggactacctgggttaaggagccaccctgcctcttcctaacaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgaggtgaggccggtctgtcctcctcagctgagagctaaaaggctttaatgggaccagagactcagcctggcatttctgggggggataggaagctaatgataagggcctgggctcctcatggggcttcactgacacggagctgtgtccttgcagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggtcagtggggcttggattgggacgggtgaaggccctatgtttggtggggagaggctggcattagggtcagagaggtctttaggctcctccctgccccactcctcacctctgccagataaggcaggtgcaagtgtgtgggtgtgcccctggggttgtgtctcagagagggtcttggtgttgcagtttttcccaagcccatcctcctcaagcctcctggggcatcggtctcagagtactcctcttcagggcctgcctcggtgcctccttcggcattgctgctctgtcctttgtgcatctgttctcattccccaggatgtggctggttctctcttctatctctctctctccctcttgccttccatgtcccccatctctgccaattctgtctctctctgtctctgtccctctgtccccatgacccaaggcaggtgcctccctcaccgcgttgcttggtgtagcttgacttctcaggctggtgattatgctgctgcctggggcaggtgactccttttaccctttgattagggcctaaccttgcccacctcatcctttaatttcccaggaacccctaccacctccaccagggatgccctgggctctggaagctgcagccccaggaagcaggcagggttggccttcaggatcaggactgccctttcatacggggcaggtggatctgcccctccagcccaggcactgtgatagtcaggcaggcagaaggtgacaggagccctcgtctctcctccccacctcagagttcagtgtcaggggaacaggtttgggatgttggactgcggcactgccctaacatgtgggcaagcattgggtggagacagagctgctctaagggagactgtcagagaataaggtgatggcccaacgtagggacatacacagtggctcatacacattgtgggtggggccgggagaagtcccaggctccatcccctctcctcagggaggccttgccagctaattgctgatttcctactctaggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccaggtgagcagctggggtctggagcagagggtagatgggagggaaagacagggaagggcttcctgccctcggatgtggcggggtgcctaggtgcctgaccccaggagaagccagcctcccattgggcagatgagaggaccgaggcctggtgcagaaaggtggccagcccagggtcacacagccagccacacctctcctggcaaaggcccctggctacagccaatctcctccaccatctgtcatgctccccgtgtcctcccacagcagtcctgtcaggctaggggcatccccgcattttcttctgtggacatgagtcctgcagaactggccagaagtaggtgaggcccagggagagaactggagggaaccagttttgtgtgttctggggacacagaggacattgtgtacgtggaccatgaggattggcggcaggagtatgttcttaatgagtctgggagaatttactacgggaccgaagcacagattggtgagcggacctggaactacggccaggtatggtgcggctggccagggtcacatacacccagaggagctggggtgggtgtgggggctggggtattggagcagggtgctggcctagggttcaggctgtcacctctgccctccatccctccttccagtttgaccacggggtgctggatgcctgcttatacatcctggaccggcgggggatgccatatggaggccgtggagacccagtcaatgtctcccgggtcatctctgccatggtgagcaccctcacatctctgagtcctactgtgtgtgtgcctgctgcctcgccacacccccaccctcctcctgccctttctggattcctcaagaacccccagccctgtccctgccctcgtaaaggatacttcaggaaggggtctccctcctcttctctcccttgcctgccccccaccccgcctttcctggctcctgtcccagctcctgtggaatgtagggccaaacccaaaacttggcacacccaggattcacattcctgtgtcagagcccgggtgggaggggggcagatggctgagggaagggctgggtggagctcaggctggtgtctggatcctgaggcatttaggggtaaggggtggttgcaggatcggggcccggctggtccccatggaccacatggcaggtcctgagcccctcctccacctccgccctatctcatcctgtcctgggcaggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacaggtagtggagggactgggacaggagtggcccgggccctacagggagaagggaggaaagccaggcttacccagccctgcccagatgtggctacagtgcagggtgcaggcgggggtgggtaataggctggccttaattatcattaattagtgttaacaacagagagaggcctaagggaaaggagggagaagggacaggcaaggactgagccaggcaggtggcctagcttcccctgaccccaagtgctctgtagcccaaaggccttgtggcccccgtggccctgaccctggcagtctatgcccagcttggcaatcctagttgcccttctccccctgatactcctgacacgatgcctcacttgcccccaacccatgccttgaaccccaaccttcgctcctccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggtgagctggggtggactgcccatctgtgctgaagaatggtgacctgagctttggaggtggagggtgggcagggctggggaggctggggaaactgaggactcctgaccctggggctcagacccagcccctcctccatgtccatccaggaacttccatgtgtggaacgactgctggatgaagaggccggatctgccctcgggctttgatgggtggcaggtggtggatgccacaccccaagagactagcagtggtaagctgggccccccactccccaccatgcccctgcttatctcccccacctgattaacacagtccagagtgtcagtgctgggccgggccggagagccaagccatgtaaccccgcggcttcttaaacgggtttgtcagctgaaccaccacgtggatgttagtttatttttaccattctatataactctctatttgcctacattttacttatttataatggtttattttatttataatggttaatatacaagggaggttcaaaattcaaaagctggaagagtattcagagaaagaattcatattcactattcttacttgctttttaacttacatatcctggagataattaactgaaggaccattttaaagtcatttttataagtaatacatgcttggaaggaaaaaaaaagtatagaattgaacaacacaaaatgtaaagcttccctattctctctcaggaggtatttgggttttttttcaaaaatatttttaaagtaaatttctaggttctactccaaacctgatacattagactttcccaggatagatgctaacaatgtatatttttgaaagttcttctggtgattctgacgatcagccggattttttgacccactccaaagggtggccagagagatggagtgacctcctctggggcacagagtggtaggtcagtgacagagcaagtccagtccttttaagcacatactcttgctttcaacgagttccttcctgtctgttccattgctcactgtgagttatatatacagcatagaaaaaaatcagggctcagataggttcaaagaagaaaatagcccttatgaccctgccttaatatataattactgttaatataaccaacgggtctcttttctgtgtccacatacatgtgtttctgcagaaattagaactaccatacactctgttctcaaacaaacccccaccccttcttaccgtgataccccagccccaggccaccaggcctgccctgccagctaccttctgtccagcctctcccttaccccaggtcagagagtcctccctagcctacattcctcccctggcctcttcccagtgccctccctctcactcagatatgtgaacacagccccatgagctgtgcaacccggtgatgcctgtgatgctgaaacagcctgtcccagacgctggcagatctgagctctggcccccaactctgggaagtggtggggtggacatcaggcagggggctcagggccagccagactggggcttgatcccagcctgatcacttctcagatgtatgctcttgggcaagcacctcgaacttttaggctttggtggtttggatgtaatttggggtaatagataccatatatggtgattgggaggattaaatgagaaattctgtatctgaagggaccagcagcatgccgggagtgtagcagctactcaaaaagtctgagctcctttcattctccctgcaccacctgtcttgtgagatcctggcatgaacttcaccttgctgtttccccgtctgtaaaggagtgtgtagtgttatgtcttgtctaagattctttccggttggatggtactcacttaccactctgtcctctcctgccaggcctcttcctgtcagcctatctcttctagacagcctcctgagtatgataagggcagactctatttcccaccagctccccccagtagaaagggcagcaggctgcagagctgagggttgttccgcatctctctggaatggtggtggcggtggtgtcctcgctctcccagccagcaggcagggccactgtggactctgggttggttatgataaaggatggggcgtcctgtcctctgggggtcacagatggtggacatccagtgtcagccagccatgaaagagtatgtcagggacttggttatcaggcaggctggtccgcacatctgtaccctgcccccatcctccagcagagcagcctgggctgaggaaagcagattgagagccaaatggagccgctctctctttgttttccatacctgtgttgcactggctgtcaactgacccccaagtgtttgggtcagggctgatgaccttgttccagaggccaccaggcagtgggaccgggcctgagtgggtggggctggggccctgtgtggaccttacccagggtctgaagagccctctccgccttctcagatctcttgcctctgtcccgcctcactctctaggcatcttctgctgcggcccctgctctgtggagtccatcaagaatggcctggtctacatgaagtacgacacgcctttcatttttgctgaggtgagggctgggctccaggtgccttcttgggcttcagtcatgggttctctggtcccaacttcaccgctgactgaccagctctgcgacccggggcaagtcactcattatacaagtcagtttcctcacctgtaaaaggggataatcaaggctgccttgcttcctatactcgggatcagaagagataacgggtatgaaactgcttcactagtcgtaaagtcagccattgagtgtgagggattactgatattgccaaagtgctctgccaggagcctcccagaccagcttcttccctgcactctggcctcgtctggctcgtcttggaaagtctccccttgggctctgccaggaagctcccacccttgggaccaagccctgtcccatagctcctgggatcaggggaaggaggccgggagtcaggccaccctcagaccctctggctcactcattcctgctcacccccaccccccacaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggtaccattcccccaacccagccagctctgggccccacaacaagtgttcctgccaagtgcttggccacccacgtgggaattggaacctcacccttgaccctcaacccccaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctgtaagtgctccttacccagccctgccccctggatggctgggcacctcagggctgtggacatggagaccccaggagcagtggggagtccctgggggaagcctcatgtagggaagcaggcctcagtgacgccatgcctcttctccacagcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacggtgaatgcagtttgctggggcatgaggggtggtcagagagtgaaggccaggggataaggacatcagaggtgggcgctaagccagcagcaggctggcctgatgagcctttgtaggagaaggtcaaggaccggctctggggcctcagtttcctcatctgtagcatgggatcttatgtctctggttctgtgacagcctttattgaggaataggttggagtttcttctctgacttctggggaatcttctctcaggaggataaatgtgggactcggggaggttttgcttctaagcagcttcccctctctggtgcagtgtacggtccccgtgtgtttggccagggtctctgacgtgggggatgggcctctttttctctcagttactgggagcagcagtggttggccaggagtgtgaagtacagattgtcttcaagaacccccttcccgtcaccctcaccaatgtcgtcttccggctcgaaggctctgggttacagaggcccaagatcctcaacgttgggtgagtctggcctctccccctacccctgcttccactctggccttccccacaggctgccctggctcccagctttgctccctctctgtctggacaagtatgttctgtcaggacccaaccaagcaggttggggccagctagcaatacctcccggcccagctcagtcccaccagcctttagggagacctcttgggcacctggtgctatgccatgtccttgccctgcctcactatctaattagggagcagaaggcccacataggaatcattagtaactcattgctaatatttgcccagcactgaagaattgaccaggccctttcaggaatattatctcctttggacacaaaaactctaatttaagtacattagaaggccaggtgtggtggctcacacctgtaatcccagcactttggcaggccaaggtgagtggatcacttgagcccaggagttggagaccagcctgggcaacatgatgaaaccctgtttctacaaaaaatttttaaaaaattaaccaggtttggtgctgtgcgcctgttgtcccagctacttgggagtctaaggtgggaggatcacctgagcctggagaggttgaggctgaagtgagccatgtttgtgccactgcactccagcctgggcgacagagtgagaccccgtgtgtctctctctctctctgtcacacacacacacagacacacacacacacacagagacacacacacacaagcgaagttttggaatcctaatgatacgggttcagctctagcacttactggctatatgcccttgggcaagcgacttctctccttcaagcctcagtgttctcacctgtaaagcagggatagcaatagcccctggacctagggttgtttagtgcactgcttggcacaaagttagtgctccattggtagttgttatttttattattgccattattacccccacttacagatggggaagctggcggtcacatctcatatggtctcacagctcgtagggggcaaactctgctcttcccactgtggtgcataccatgcacaggctctcaaactcattgtttgttttgtgccatgagggccaagtagcagttccagaggagagaactccatccctcaggcccttacccagcccgtctgggcctgatcctgggctgggcaagcccctgggtgtagtgagggcacacacatgctgtgttcctgggcctgcggctgtcatctttgatacagacttacacgtgctgccccgtccccgcctaggaaaagcacggagggaaagcagagcaggccagagcctggccttctagatcagccttctgggacaggggcaggcttcatcttcagacagcgagttcctgagaaagaacaatggcttggggtggggaaactgaggggaggaagcagaggaccccctgcccacttgcccacccctccctcacacacagcagctctcctggtggtggctgccaccttcgccattaggccaaagctgagaaggaagctatgttgatctttgccccagcctgggcccctgggaatgctatgatgtgtcacaaagtagggctttcctcatgtcaccataccatggtctctggcagctcagtgaacagagcctgaaccccccgggtagcctgctctgctagtcttgcccagcaggcatctcttacccacacccccaccatggtggggggaggttcctcgtcctaagggatccgcagagctggacttgcctcagcagccccaccaggcctttgcctcttggccctgcctggaagtaaggaaagggccactgtgctgagtgttgggggacctgtttcctgtctttagctgtagggtttatgtgagtctccctacagtaaaagacagggttggatgatggtttcttaaggcagatcctccctggacagtctgtggctccttagctgctgtgagcccagaccagagcctccagtacaattgggagcctccagggggacatctctgagctgttggttcaggtacctaagattccaagatgggtgtactttgcctctcattcgcacatcagaggctgtggcatggaaccccattatagcataaggtgtgccacccccctgtggtgactggccacttaataaacattccagaactcactcctccagatggctgttgtcaccaccaaaagcagtcaccagagaggctggaagtctgttccaaacccttcctgggaatttccctcagagtctgaatcatattctctagaatgtcctcagagtggtcagtctgccttcttaggggtagatttgactttgcagagaaacctgaagtcatcaagagctaagactaattaataagataagtgaacaagtgggtaactgcccttttccatcagaaccgaggcatgctgtggaaggaaggacaggctgaccgtggcatcactgagcacacgcctgtgtgtatggtttaaatggctctgaagaagagtccaggaggagttttaaacatgtttcaagcccaggcaatacgattgaacaagtacacaattggacaatgctcgtttcgacgtctaagttctggtgtccttgttggggagttggtttcatgacccacactcagttccaggaacatcccagctttagcagatggcttgtactcagcttcagctcacaaaagaggtgtggtaaagtcccccacctcacaatgagaccaggggagggagagatcttgacatttccacctagaaaacagtttctcttgaaaataatccgttactgcaatgtaaaggttactttctgaaatattatagttcaattatggtatagagtaaatagacttctgagggctggtctgagcttgaacaaccttgaatcttgtatctatgaaaagttagcaaaaattaagagtgcaaatttgtaagcagtcaggacatagcctagccattaagttatagactaatttatagactcctatcatactacgttctattatatatccctgcctccctccttcagggagctcgagaaacaccaacaagataatcagatcccactcctccttttgggttcgcttccattttatgacccagaaagtgaggaacagagaagttaaatagcttctcataagcctttttttcacagctaacaagtggtagaaaagggagtagtgaggtccaggaaacccctcagaaccaggttccaagccaaatcgtttgccctgaaaaaaactcatccttggagttagggatgttggctcattctcttagagacaatagttaatgcacaggttctatgtctggaaagggtccccagcggcaggcttgggttgaatagggcaccagaggtaaggtttaggcaaaggcaggaaggacaaattcccacaggcacgagcaaatgcaatataaatgcagtcatgttcagtgtataaaatgaaacgtgcagattgctggaggagctcagagaagggtgagtttccttttcctagaggcaggaggtgctcaggggagccgtcactgaggaagtggtgtgccaggccttggaggaaaagtaggccttcacaaggacacccagggtggggaggcagagctgggtgctcattccacacaaggcaaagactgcaaagcatgactgtggaggtgagtctggggaagaaggcattcggtagggctgctcagcaggaggaatgatggggggtgatgaggctgtgcaagtagcagggactgggtcagagtgagcctgtgtgtcaagttagagagccaggatcgtgtgccacaagcaccaaaggagcactaaatccttgaaggatttagttcacctctgagtggttagcagaacagaatacaaaagtgggatgggaggcaaggagtcccgttagaggactagtgaaatcatgattcccaggggaggtctgggaatcaatttttcagaggcccatgtggaaaggagaaaatgaaaacactggttgtgtgtgtgtgtgtgtgtttgtccacccacctctctgtctctctcacacacacacacacacacacacacacacacagagacataagggtttatgtccatttaaagatgtctgttgtctgttcttgggaaggattttccttttttttcaaagataacatccttctaatgttttggtgtgtgaaaatgctcttttctctttggaacgacgatcatagcagagagtgattacttttcttcaacctatgctcttgtcaaaactgaaagtatttgaaaatattgtgttgggcccccaaagtctcattttgaagttttcttggttttggaaaccccaggtgagatgaggatgttctgtctggggcaggagcagtggtgatggaggggatggcatgagaggcctctgcggtggcatcagcagtctttgtccaggtggatgtgggagcagggagggaggagtcccagacgatggggagagttccagcacaggcagctggtgggtggctgctgagctggctatgcagaggcgccctggggatcctggtcttgggtgtggaaatttcaggtaagcctggaattgtctgaatgggtccacctcctgcttcttcctcctgactgccctggatcagctcttactccccactccacccccaattactccaggcccatgaccttgtctctgcccacagggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatgaagctgctgctctgtccatctttcagtccatgccacaccaagacggatggagccatggtttgtcccagggctgcacatggccttcctgtatcatccactgataggggctggtgtccctcaccagagagagggaaccacaagggaagttgaggctcagagagacagagtcgatactctttgtataactctcttctacctggaaattttcctgtgggtgagttttggaggattttggctttggtttgaatgaaactgttcccttacctcagggtttttcaagtgtagtctctagaccacttctattacaatcactgaaatgtttattaataatccagatagatgggccctaccatagacttcatgtgtcagaatccccgtggaagaggcccagaacaaactcaccaagagtttgactcctgtgcacactgaagatcaagaacgatgccctttcatttttcttctcagctgttcttttttctgcattcccactgcctgcattcttcttgggctagcagtagccatgagatcatgtacctgatattctggtcctgaacgcatgtcttcttgaacctttaagtttagaaggctttcaagacaaagggctcatggggcaggaaaaagagagctaaaattgagctgttcctactagctgtaaacacatgaacaaggtgcacaccttgaggcatcagtagtgtaacatgcacaagaagaaacaagcccttcccttaaggtgctcctgtccagtgggggtgacagacatgcaaacattctaaatacagtaaatgcgtatgtcacacttaccaggaaccaggctccaagcactttatgaattcatttaatccttacaataaccttatgagataggttctgcatggtagtagagggatgttcaggatgctgaggggcccagagaactgtgattctgcctgggctgatacagaaagtcttcatgaaggtgattaccagatgacccatgaaagatgagaaaaagtcaagtccaagaggcaaaggacagaggaatcacccaacacgtgtaaagcacagacatgtgagacaacacagtatgtttggaaaatgcagacagctggatgaggactggcatatgggtgcatgatgagtacaaagtggcaaaggatgtgcatgaagaggtaagcttgggccagttcattaaaaatccttttgccatatttaggagtttggactttcttctgaaagtaagggggagctttcaattagggatgatatgatcaagttttgcatttcacatgattcataatgaaagcaacatagaaaagaaattagaggggttgggctggaggtaggaagatagagtcctcttgggatgagagataggagaacctgaattagggtagaagcagtacgaatgaaaaaaaaagggtgggtttgaacgttgtataggaaatagaactgattagacttgataacagattcaatttggagaggagggagggcagagataagggtggtggcctgagtttctgactcatgggtgccacgaagagaggtgccatgcacagaaattcgaagctcaggaggaagaccatattataaaagggaaggtagaccaggcacggtggttcacgcctataatcccagcactttgggaggccaaggcaggtggatcacaaggtcaggagttcgagagcagcctggccaatatggtgaaacccagtctctactaaaaatacaaaaaaaaaaaaaaaatagccacgcatggtggcacatgcctgtaatcccagctactcgagaggctgagacaggagaattgcttgaacccgggaggtggaggttgcactccagcctgggcgacagagtgagactccatctaaaaaaaaaaaatgaagataacgacctctggtttttagtctggcctgtaacaagcttaggagtcctcactcctgtcctcacaaagaaaaatgctgaacaaactgaaagtcagcaactcttgttggatctatcagagaattgagggcacagggcaaactgctgcccctaaaactggagagacaaaaaggcagatacagagaatcacaacttaacagcagaagcccagaaacagaaacagaaacagaaacttctggggagccagtaccagggtaggaaaacttaaagtgtaattgactcatagctggaggcttagggtggacaaatttgagagctaaaaaatctatagtggccaggcatggtggctcatgcctgtaatcccagcactttgtgaggctgaggcacgcagatcactgagctcaagggttcgagaccagcttgggcaccatggcaaaaccccatctctacaaaaaagacaaaaagtagccgggtgtggtggcacatgcctgtaatgccagctacttgggaggctgaggtggatcacctgagcctggggaggttgaggctgcagtaagccgagatcacgacactgcactgcagcctgggcgacagtgagactgtctcaaaaaaaaaaaaaaaaaacaaaacatctaggggtcccattcttaggggggaccctaccctttttttggtttttgttttttattttttgtttcttgtttttgtttttcccaggctggaatgcagtggtgcaatcacagcttactgcagcctccaactcctgggctcaagcaatcctcctgcctcagcccaactagctaggactgcaggtgtgtaccaccatggctggctttttttttttttttcttttgagatggagtctcgctctgtcaccaggctggagtgcagtggtgcgatctcagctcactgcaacctccacctcacctctcaggttcaagtgattctcctgcctcagcctcctgagtagctgggattacaggcacgcgccaccatgcccagctaatttttgtatttttagtagagacgggtttcaccatgttggccaggatggtcttgatctcttgaccttgtgatccacccacctcagcctcccgaagtgctgggattacaggtgtgagctactgcgcccagtcacctggttaacttttagatttttttgtttgtttgttttgtttttgtacagacatggtctcactatgttgcccagactggtcttgaactcctagcctcaagcaatcctaggtgtgagccatggcacatggccacaagttttaccaggatcccacagtgaaaactggagaaccccctgccccgtgattctggcaaaggggaggaggaaagtagccactttgaaatacatccattgcattctgttctcactctgttgcccaggctggagtgcaattcattgcaaccaggctggattacagctcactgcaacctcaacctcctgggctcaggcaatctttccacatcagcctcctgagtaactggggctacaggtgtgcacatctatgcctggctagtttttcaattttttttgtagagacgggggtctcgccattttgcccaggttggtctcaaactcctgggctcaagcaatccacctgcctcggactcccaagaagtcagctacacagagatagcagctgaaaatgagtaattcagctgggcacggtggctcacgcctgtaatcctagcactttgggaggccaaggcatgtggatcgcttgaggtcaggagttcgagaccagcctgggcaacatggcaaaaccccatctctactaaaacaaaaattagccgggcgtggtggtgtacgacctgtagtaccacctacttgggaggctgaggcaccagaatcgcttgaacttgggagacacaggttgcagtgagctgatattgagccactgcattccagcctgagcaacaaagcaagacattgtctcaaaaaacaaaaaaaacccactgtaacagaaatgatgaatgtctgtgatgggctcatcaatagactggacatggccaaagaacatggtgcgcttgaagaaatgtcaacagaaatttccaaagctgaaatgcaatgagaaaaaaaaatgaaaaagaacagaatatccaagaattgtaggacaattatagaagctgtagcatacacataatcagaatggcagagaagaaaataaaggaacataagaaatgtggcaataatgactgagaatttcccccaaattaatgacagacacaaaacacagatccaggaagctcagagagcagcaagcaggataaatacaaaaaacaaaaaatgaagatagactgggctgggcaacacagagagacaccccttctctacaaaacatatttttctttttttttttttttgtagagtcagggtctcactgtattgcccaggctggtctcaaactcctggcctcaagtgatcctcccacttcagcctcccaaagttctgggattacaggcatgagccaccacacccaccaaaaaagattttttaaaaaattagccagggactgcgtgcagtggctcacgcctgcgatcccaacactttcggaagccgaggtgggaagatcgcttgagtccaggaattcgagaccagcctgggcaacaaagacttgtctctacaaaaaatagaaaaaaatgagccaggcatggtggtgcatgcctgtagccccagttactttggaggctgaggcaggaggatcacttaagcccaggaggcagaggttgcagtgagccaagatcactgcactccaccctgagcaacagagcgagactgtctccccacctcaaaaaaaaaaaaagagccgagcgcggtggctcacgccttgtaatcccagcactttgggaggccgaggcgagcggatcacgaggtcaggagatccagaccacggtgaaaccccgtctctactaaaaatacaaaaaagccgggcgcggtggtgggcgcctgtagtcccagctactcgggaggctgaggcaggagaatggcgtgaacccaggaggcggagcttgcagtgagctgagatcgcgccactgcacttcagcctgggcgacagagcgagactccgtctcaaaaaaaaaaaaaagtaaaacaacagaagttcatatctacataagaaagaaagaacattagagaaggaataaataaagggaaaaaggaagataactagaatttcacacatatccaatttggggtactttgggactgggtgtttcttgggcagtcgaatgtgcggatcagctgagactgatccggggcggagacaaggatgtgtgaaccattatctctgggaatggaagacatgggctaaagacggagcagtttcactaaatccttgtaaggtggtcaaggcaggcaactaatccagccaacaattaaggagtgtaagctgtgtgttaggttctgtgcttgctgatggaaatgagaggcaccaggaagcctgtggaagagacagtcaaggagagcagtcaattacattagggggctgacaagttcagtgcacaacagaatcctaaaacaagaaactaatttgtgtgtgtgtgtgagaccccgtctcactctatcactcaggctggagtgcagtcactgaagcctcaacctccctggctcaaacaatcctcccaactcagcctcctgagtagctgggactacaggcgtgccactacgcccggctagtttttttgattttcagtagagacaggttatcgccatgtgatccagtctggtctggaactcctgggctcaagcggatcgatcctcccctctcggcctctcagagtgctgggattacaggtgtgagtcaccgtgcccccagcctgtattctatttcttcttcttcctctttttttttttttttttttctttgagagagattctccctctgtcgcccaggctggaatgcagaggcaagatcgcggctcactgccacctcccgtctactgggttcaagcgattctcctgcctcggcctcccgagtagctgggattacaggcgcctgccaccacgcccagctaatttttgtacttttagcagagaaggggtttcaccatgtcgcccaggcttgtctggagctcctgggctcaagtgaccctcctgcctcggcctctcaaagcgctgggattagacacaagccaccacgcccagcctgtattttattttttaagggcgggcgccctcttctgttttataaaaggaacagtcgaattcctactggaagcgacgcgcgcagaggggaaggctttgtagacgccggctcgggtctggaatttaaagaactaaatttcgatgggtgaagacagtgggaaagggcggtggcatgatcctcgttttacagactaggaagtcgagcctcacgggagtgacggggcttctccgcaggctccgcgaagaaagcaaggctgggaggacccagacgaacggccacaacagcctcagcggccacgacagcctcagccgccaactcatgtcagccggcagagagtgcaggaagcgggcagctacagctccgctggggcgtggccttctgacgcaccgtcacggttccctctgtggccgcccattggctccctcttaccgcccttttccggggcaagggaagctagtagcggagccggaagtgaggcaccctcgggctcgagacagcggcgacgtttaaagctgagcgacccagtgccactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgcccctaggagtgatcggaaagcctcacccatccgggtgaggaacccggagggaccgcctccgggcggagcccgccgaccatggctacgcccctggtggcgggtcccgcagctctacgcttcgccgccgcggctagctggcaggttgtgcgcggacgctgcgtggaacattttccgcgagtactggagtttctgcgatctctgcgcgctgttgcccctggcttggttcgctaccggcaccacgaacgcctttgtatgggcctaaaggccaaggtattggagcaagtaggacctggaaggggaaagaaagaaaggggcgggatgcgagcacctgacaagggcccacagcttggggatgagactagttggaaaaggtcagcttgccccgaagtggggattctgaattcagtaccgtacaggtggtggtggagctgatcctgcagggccggccttgggcccaagtcctgaaagccctgaatcaccactttccagaatctggacctatagtgcgggatcccaaggctgtgagtaatccccggaacaagccctgaccccagttacacttggtgcagcaaagttgctcctcctgtctactggatgttggtgctaacttctctgtcttctgtatcctcaacagacaaagcaggatctgaggaagattttggaggcacaggaaactttttaccagcaggtgaagcagctgtcagaggctcctgtggatttggcctcgaagctgcaggtgagactggtttgaaggctattatgtggctattttctctaacccatttttttttttttttgaggaatcttgctctgtcgcccaggctggagtgcagtggcacaatctcggctcactgcaacctctgcctcccgggttcaagcgattctcctgcctcagcctcccgagtagctgggattacaaatgcccagctaatttttgtattttagtagagatggggtttcaccatgttggccaggctggtctcgaactcctgacctcaagtgatccgcccacctcggcctcccaaatggccaggattacaggcgtgagccaccgtgcctggccactaacccacttttgacctaatctcccctgctgtaggaacttgaacaagagtatggggaaccctttctggctgccatggaaaagctgctttttgagtacttgtgtcagctggagaaagcactgcctacaccgcaggcacagcaggtttcgctggggcaaaacatgtaagggcagagtgtggggtggctgtttcaaggattgtggtcttcatacctctgtccctgcccacagcttcaggatgtgctgagttggatgcagcctggagtctctatcacctcttctcttgcctggagacaatatggtgtggacatggggtggctgcttccaggtactaggaatttggaggtgtagtgtttagcctgagaccttttgaggcagtccactggaatagttccatgggctccgggcataagaaaccagttattctgttactatctgttctctttataaggggcctcattttctttttcagagtgctctgttactgactcagtgaacctggctgagcccatggaacagaatcctcctcagcaacaaagactagcactccacaatcccctgccaaaagccaagcctggcacacatcttcctcagggaccatcttcaaggacgcacccagaacctctagctggccgacacttcaatctggcccctctaggccgacgaagagttcagtcccaatgggcctccactaggggaggccataaggagcgccccacagtcatgctgtttccctttaggaatctcggctcaccaacccaggtcatatctaagcctgagagcaaggaagaacatgcgatatacacagcagacctagccatgggcacaagagcagcctccactgggaagtctaagagtccatgccagaccctggggggaagggctctgaaggagaacccagttgacttgcctgccacagagcaaaaggagtgagtggaacagagttgcttcttactaggagcacattctttgcctgccttcccttcatcctatcctctttgcttgctctcacctcaggaattgcttggattgctacatggaccccctgagactatcattattacctcctagggccaggaagccaggtaggtagtctgagtcaggattggatcaacagcctcctctcttggggactctcaagagcctgtgttcatctagaagtagtagtttgattctggtttccctcctacagtgtgtcctccgtctctgtgcagctccgtcattaccataggggacttggttttagactctgatgaggaagaaaatggccagggggaaggaaaggtgagtgggaaggagcagaaagctgggaaaggggatgggtagaacaagactgagaaatccacatgcttcagaattcagagggttcagggaatggtttcggatagtaggctctccctgctcccttctctacaggaatctctggaaaactatcagaagacaaagtttgacaccttgatacccactctctgtgaatacctacccccttctggccacggtgccatacctgtttcttcctgtgactgtagagacagttctagacctttgtgatagaactaaaatgctctctgtactctagtctcctgcctcctcagctctgcaagtagtttagtaggaatgaagtggaagtccaggcttggattgcctaactacactgctaaaaatatttgtaatccttaataattaaactttggatttgttaaaatactgccttgatgtgaaggaggggaattaaggtttccataaggtcagcataagtcattccttagaaacagaactggcccttccaaactgaaaggatccctttgcctttttttacttcccttgctaagtgttgttcagctgtgcctaaaagggttagcagggttgaaagcctggaagagaaatgtcctttggtattctggaaatatgtgtcctcaggccagaatatactttgtaaattctcatgctgccagattatctgggtgtggtggcactagaatggagatacttcatgggaataatactcattgttcttgaccccactgggtcagtgctgaccctaccaccaccc

SEQ ID NO: 1115 - DNA, 2448 bp, Homo sapiens
atggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagct

SEQ ID NO: 1116 - protein, 816 aa, Homo sapiens
MDGPRSDVGRWGGNPLQPPTTPSPEPEPEPDGRSRRGGGRSFWARCCGCCSCRNAADDDWGPEPSDSRGRGSSSGTRRPGSRGSDSRRPVSRGSGVNAAGDGTIREGMLVVNGVDLLSSRSDQNRREHHTDEYEYDELIVRRGQPFHMLLLLSRTYESSDRITLELLIGNNPEVGKGTHVIIPVGKGGSGGWKAQVVKASGQNLNLRVHTSPNAIIGKFQFTVRTQSDAGEFQLPFDPRNEIYILFNPWCPEDIVYVDHEDWRQEYVLNESGRIYYGTEAQIGERTWNYGQFDHGVLDACLYILDRRGMPYGGRGDPVNVSRVISAMVNSLDDNGVLIGNWSGDYSRGTNPSAWVGSVEILLSYLRTGYSVPYGQCWVFAGVTTTVLRCLGLATRTVTNFNSAHDTDTSLTMDIYFDENMKPLEHLNHDSVWNFHVWNDCWMKRPDLPSGFDGWQVVDATPQETSSGIFCCGPCSVESIKNGLVYMKYDTPFIFAEVNSDKVYWQRQDDGSFKIVYVEEKAIGTLIVTKAISSNMREDITYLYKHPEGSDAERKAVETAAAHGSKPNVYANRGSAEDVAMQVEAQDAVMGQDLMVSVMLINHSSSRRTVKLHLYLSVTFYTGVSGTIFKETKKEVELAPGASDRVTMPVAYKEYRPHLVDQGAMLLNVSGHVKESGQVLAKQHTFRLRTPDLSLTLLGAAVVGQECEVQIVFKNPLPVTLTNVVFRLEGSGLQRPKILNVGDIGGNETVTLRQSFVPVRPGPRQLIASLDSPQLSQVHGVIQVDVAPAPGDGGFFSDAGGDSHLGETIPMASRGGA

SEQ ID NO: 1117 - DNA, 27409 bp, Mus musculus
  misc_feature (1)...(27409): n = A,T,C or G
tcattattatcaaggcaggaacatggcaccgtctaggcaggcatggtacaggaggagctgagagttttacatcttcatctaaaggctgctagaagattggcatcctcagacagcaatgtggaaactctctcagagcctaccccaacagtgatacttctttcaacaaggccacaactactccaacaaggccacacctcctaatagtgccactccctgggtcaagcatatttaaactaccataccatgtgaaaacacaaggagaagactgctatctacatgccaagaaagggtaccctcagaagaaaccaactcttgccaccaacctccttaatctcagatgtccaactccaaggactgtaaggaagtaaatatttatggttccagccacatggtctatagtttgttcatctctctgtattcatgagatagtggccccaggaccacataggaatgttcaagtctcatatagaatgggtagtgatctgaggctgtgatgtagctcacacacacaaagtttgtagctaactggcacaaagccctgtgttcaatccacacttactcatagattggctgtggtaatgcctacctgtcatttcagaacttcagaggtagaagcaggagacaagtttgtgatcattctcagatatgtagtgaatttaagtcttagatctctaaacaaagaccctcctctaagtctcaagtatagctgtcattggctactttgtgtgttcatctttcttctaccctattcaacccctaacactagataaaatagaaaaatgatagagaggaaagaaaagagattcccaaataaagtcagtgatcagaaaggaggtgacattaatgttagactacttcctgttgattaggggcatcaagttccttggggcatgtttgatccattaggatatctaatttcttcttgttggttttcatttgttcatgactacttaacaaaccacgaccaacaacaaccaacaaataccaacaataaccaacaaccaacaacaaccaaccaacaacccatactacctctcaaaccctagcgtttatagacagtctaaaatgtccccagcatctcaaacatcacacaatcacagaagctatcttcagttggcaaaatcattcccctgctagagcatgaggcaaatcatagtcacctgtgtggaaaatctgaagcagccccacatccccacacctaggattaaaacaaaaaacacgttcccataatatttctgtgatttttaaagaaaccaaaactccagaattttcactacactgaaggaacattatggaaaaaagtttaagagcccaaacagtagagagaagagctgcaaagtactgtcttctgcgtgtgactcgaccatgatacccagggattcccaacagctgaggctacttgcactgggctaacttaacagtcatgtatagaagagagactcatggaaccctgcccctccctggtgaagttagccattgtgtctgtgagacctggtttctaaggacctgaaagaattggaggacttacagtttaaaaacaaaatttcagtatacttttatacaccaatggaacaaagaaagtaacagtccaaggaaggttgagttcagagaaacaggtaaataaatgtcaggaagcaaaaagaaatgtttacaaagtagccctttcccagaactttctcaggacaaaccaatttagacacaactgcctggcatgtactatagattatatttcataaagcacacacacatgtcagaagtctgtttgctcagatcatgaaaataccaaagagaccaccaggaaccacaactctaatgcaagcacagcagagtctttattcaagctcaagcttgggtcacaaacctccctgatacaacaggataggagagcggcccagaggtctagggaaaggggatttataaaggaaaaagaacctgcaagcaggggtttccaagacttggcatcacagggagggtaaagggatgctgatctttaagctaattggtttacagcccctggtttaaccacaaggagggagcatacatcaaaaagcagcacctggacctgggaacgacttatgttttcttagcccactctgctgttatcagctagctgcagctgctgtgtctattttgcaactgccagggacatttcatgatttttctcagacctcaagggtggtagccatgcctctctaaaggcaagttaacttaaaatggagtcttaaaaacaaaatggagtttattctgctactctgatccctacaaggccatatccagattcagggtacattgaccagattgggttctatagctgtgttctgacatgcaacaagaataagcatgtcttagaaattgaatgtaaatgtttgccacaggaggcacaaaatcatgttcaaggacaatctagggaacaaaatcacctgaggtaaaaggtcctctgccatttgccaaggaccaaccttgacttggaaaggggttctgaggaagaggatgtccgggagtggcaagacaaatgaattgtagtcaaattatgggtccaagctggctgcctacggcctacgttctgctggagacagctttccagattgctttctctctgttctgcttactttctctctgatctgctttcgctgaagatctccagacctctctctctgtctctctgtctctgtccctccctcctttactccctccctccctccctcattttgctaagacacactaccaactcccagacttgcattgtctctaattatcatggagtcataaattttaacaggaaggacaatcctcggaggaacataaaatatatacattattatacaagcaatccctacacccacagcagccatcaacacttatggacacccatgcccaatggccctgtcccaggggccagaaccatgtcctctgtccccaccaaggccaagcaggatggcagccgtttctctataacctctctcacagtgccgcaaggcattgttcgccatgtgtcattctttgactgctacctcgtgggcaagctgctggcagattctgggagggagggagtcactgccttcagttgtgtacttactggtaagccaccagactccaatggaagttccaaactcatggtcacacagatgaccctggttaaagtcagtgggtcacaaaacaaaacaaaaagacatgaatgtgtgaaagggatcttcaggtaggagggaggttggcaggaattgaatggatatacagaggatggaggagagaataatcaaatttatcatacgcatttgtgaaattatcaaagaataagtttaatgaataaaaattggtaattctatatatcttagtttctatatgttgctgtgaaaaaaaacactgaccaaaacagcttgggggagaaaagggcttgttttgcttgcacttcatgtcacagtccatcccttagggaagccaaggcaggaacatggagggaactgatgctgagactacataggaatgctgcttgctggcctcttccctctggcttgttcagcttgctttcttatatagcccaggaccaccaactcagaaatagtactgcccaccatggcctgggccctcctacattaatcagcacttaagaaaatgctgcatagacatggccacaggtcaattcaatggagagaattcctcagattttcccaggtgtgtcaagtaacaactgaagctaacaatggcactgtggatgggggtgtgcatgcctataaccccagcactcaggaggctgaagcagaagaatcctgagtttaagaccaatctgagctaaatagtaagttcccagctggtgaaggctacatacatagcaacaccagatagatagatagatagatagatagatagatagatagatagatagatagatagatggatagatggatagatggatggatgggtggatggatgataatagcaggcaaatagtagaaaatagatttagtgctggcaaccagtctctgtatatcctctcatgtactttaagtcatttctgaattatatatgatccttgatacagtgcaagctctgtacatgctttagtatttgaggagtattggtcaggacaaaatctgcatactcaggatagacacattatttatactgttagtccataattggttatatctctggaggaaaaacccagagaccactgtgttttcctactacactttcacaggctagtctagcagacatgagaatgaaaaatattgcaaagatcaagccagcaaaaattccagcccaacaaggactgaggaagatcctatggctctaaccctagtagaggagctcttggaagctgatggctacaaagggagagtcactaacttttggaaatgcaacaaccacccagtaagttgtctctgcttcaagaaatggccacatgtacacatgggcagcacaaactgaattcaatgtctgtgttttaaaataaccacatgaatttgagaaatgttgcatgacactattcatatgacatcccacacacaaacacacacacacattcttacctcttacaggaaaccaatgagagaatctagatacccaggaggaaaaaaatgacttgaagacagctccatcaccaaagcccagcctagcatgagtgacaactcaccaaagtgaaacctagagtgagcttcaacaactcaacaggttgagcagctcaacaggttggaaagtgtctgttccaagcagttcacctggcttctgcttcttctgggtggctcagctaatctgagccttttccaggctgcacagtttatctgagagcatctctcataagtccttactgcttatatatgcttggagaagaagagatctaatgaatctactcagtttcagagacttcctgaagcctttgagaagtttatttcctgaacgtgcttctatacagaatggaaaattgcctctctctttagaacaccctatgctctaatgagctcctccaggaggtggaggagtttatctgctatgtaatgtgggagaaggatggggaacactagaggatatttggaggtaaatagtagtggatagatacgatcagtgtacattgtataaatatatgatttttccaaataatcaaaaattattatttttcaaatagttaaaagattatttttacagggatacaggcaggaaatctgatggtcacttcctccatgacatctctttgtgacttccttctacccagaatgaccactccttccataaggtctgtccatgaatgcttacccttgcgcccccagattataaggttttgaattttacaagttcttcatttatcaagccagagagccctgaggtcatacaccttgtggaattcaccgttgtacttctttcccatgaagcattgtgcctggtccatggatgcatagaggcagataatgagcacaagttttggcatgactcaaagagtcattttgggactgacaagtaagggaagctagagagatggctcagaggttaaaagctcatagtgttctagaatttagttcccaggcacctcgcaactgcctgtaactacagctccagaggatccaacacatctggcttccaagggcagctacacttatatgcacgaacacacacacacacacacacacacacacacacacacacacacacgacaagtaaaagtaaaaaaagagcagttaagagggcagcatcttggagaagatgttgctgtaagcagatcctgaaggcggaagcattttgactcacaggtcagagagtacagtccactacgataagaaaagcatggtatggagaccaactggcttctttctatgttgagagcatgaggcagctggccataactcaaggggtgggaaggagtcagggcagagtgttagccctcagaggtctccccacacacatacagtgacccacctctgttaactttcactcccaaaccaaaggttctatgagcttgtggtggcgcacgcctttaatcccagcacttgggaggcagagacaggcggatttctgagttcgaggccagcctggtctacaaagtgagctccaggacagctagggctatacagagaaaccctgtctcaaaaaacccaaaaaaaaaaaaaaaaaaagaagcaccacagtgagtcaagcttcaaacacaggagcctgtgggaaacttgaagacagacacacagacacacccacagacagacagacacacacacacacacacacacatacacatacagacacacacatacacatacagacacacacagacacatacagacacacacagacacacacacagacacacatacagacacacatacagacacgtacacacagacacacacacatacacatatcagacacagacacgtacacacagacacacacacacagacacacacacagacacacagacacacagacacacagacacatacacacagacacacacagacagacacacagacacatacacacagacacacagacacatacacacagacacacacagacagacacacagacacatacacacagacacacagacacatacacacagacacatacacacagacacacagacacacagtacacatacacacagacacatacacacagacacatacacacagacacatacacacagacacagacagacagacacacacacacacatacacacagacacatacacacagacacacacagacagacagacacacagacacatacacacagacagacacacagacacatacacacagacacacacagacagacagacacacacacagacacacagacacatacacacagacacacacagacagacagacacacacacatacacaccttgcaccctttaggttgcttggttcctagtaacatcgtcagccccagatatgggaaacctcatcaacgcataaattacaagtgggaaattcagttctctgactgaagaggaaggacaagcggggaactgtgttgaattgtattgaagcctgtgggtacttttagagttcaaagtgtcagtagctcacaagggaggatgaaggggtagaagaccagtctatatttttctgatttagcatgaagcaaagaaaaaaaaaaagcatagtgagaaatatccagttacatttgaacatcatacaaaccaagctttttcatcttttcctcctccttttctttcccccctcttcttcctcctcttctaagtgtaaatagtactcacaaagtatttgagacatttcataccaagaaatatagtgactacctatttgtttttaaatttgaacatcagccaggaggtctcgctctcctgcactcaccaggactcacttcaagaagcaccacccaaaactcttacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaattggggctggggctggggctggggctggggctggggctggggctggggctggggctggggctggggctggggctggggctggggctggggctggggctggggctggggctggggctggggctggggctggggctaaagcttatgcctctgtctccgacagggcctcaaggtcagatggagagctacttcctacaggtgcagagaattgtgaaggcacaggagggtctgtgcatcttcgtgccctgctccttctcctcccctgagggaaaatggcttaaccgttccccactttatggctactggttcaaaggcatcagaaaaccatcacttacacttccagtggccacaaataacaaagataaagtgttagaatgggaagcccgagggcgcttccagctcttgggggatatctctaaaaagaactgttccttgctaatcaaagatgttcagtggggagactcaacaagctatttcttccggatggagagaggatttgagagattcagtttcaaggaggagttcaggctgcaagtggaaggtaagagttgtagacatagcagggaaccttggtctctcactgggggagggacagtggaagataaactgtgatgcaaagaagactacttctgggaggagccgctggagtcacaggattggtatcctctcccttagccctgactcagaagccagatatcttcattcctgaggtcctggagcctggggagccagtgaccgttgtctgcttgttttcctggaccttcaaccaatgcccagctccttctttctcctggatgggggatgctgtctccttccaagaaagcagaccgcacacatccaattactcagttctgagctttatcccaggacttcaacaccatgatactgagctcacatgtcagctggacttctctagaatgagcacacaaaggactgtccgactaagagtggcctgtgagtatggtatggtgctttgggctgtcctggtggtaggaggtagagaattccccaactccatgctcaggagggttcacggaggtgtggtggggatgtcatttagttggtagagtgcttgcccagcatgcacgaggccctgggttccatcctcagcagcacatatacgggaggtggtggttgcacatctatactccaacccttaggagggagagaagcaagacgatcaggagttcgaggttatccttggctatgtaacatatatacatgatagaatccatgatcttgtataaatggagcaaaggttgctggggagatgagtaggctgataaagagtttgacacacagccaggcgcggtggtgcacacctttagtcccagcacttgggaggaagaggcaggcgaatttctgagtttgaggccatcctggtctacagagtgagtgccaggtcagccagggctacacagagaaaccctgtctcaaaaaaaaaaaaaaaaaaaaaaaaaaaaagagtttgacacacgagtgtggagaatgggatttgaaccctcagagcatgcataaaagcgagtcaggcatggtagccccactggtaacctcatcactttgggagacagagacaagtgatccccaaggcaagtgagctagctagactggctacccaattagcaagctctgagttcaatgaaagaccctgcctccttaaacaatgtagacagtgattcaggaaggtacctggctcccccacacacttatgtgcacatgtgtgcatccatacacacatggcatgtccaccacatacattcaaaatcaagcggaggagggcacaccatcccgggtgtgcctgtaccctgagaggcgatggttgcttcatttctggttggtctcgtgccttctctgggatagtggtgcttttctttccctgagggacttctcatgaggaacaaagcattcccctctgaagttggctcacaaatcttctcccagatgcccccagatctcttgctatcagcattttccatgacaatgtatcaggtacgttggtctcctggggtcttatagggccggtccattcctttttgggaaatgaaaagtctggggaggggggaaggggcaggttggaactctttttactgcttctccctaccctccatcttgctccctctccctttccttatgtctgtctctctgcccctctttatctatctttatgcctctgtctgtctgtctctgtgtgtatgtatttgtctgtctgtctgtctccgtctttgtgtctatctctatgtctataaccatctctctctctctctaccttcatccttcctctgtttctctgtctcatttttgtctgtttctctcttcattcttttctctctatcactgtccatctcatcctctctccgcggtgtgtgtctctctagtcccagacttgcatgagaatccttcacatctggaagttcagcaaggccagtctcttcgcctcctctgtactgctgacagccagccccctgctacactgagctgggtcctagaggaccgagtcctttcttggtctagccctgtggggtcgagaaccctggcactggagctgccctgggtgaaagctggggactctggacactacacttgccaagcagagaataggctgggctcccagcaacataccctggacctctctgtgctgtgtgagtatgatctaccaaaggttcctggtcccaagaaggacaaaggagtaacatcaggctataaacagtcagattactgtgcagcttgtgttggggacccaatgagtgatgcacccacccacccacagcttccatccctgggagggatgttctgcccagagagaagggcctggcctgtctggaaccagttccctgtcttcattgcagaccccccacaggacctgagagtgactgtttcccaagcaaacaggacaggtagaaacgatggacagaggaagctgggcatctgcgtggggaatgggaggcatcccagttgatgggcacctggcaactctgccttctgttctcccccagtgttggaaatcctcaggaatgccatctccctcccagtcctggagggccaaagcctgtgcctagtctgtgtcacctatagcaatcccccagccaatgtgagttgggcttgggtgacacagaccctgatcccaatccagtcttcagagcctgggggtcctggagctgcctctggtccagagagaacatgaaggagacttcacctgtgctgcacagaacccactgggtgcccagcgcatctctctgagcctctctgtgcactgtgagtaggcaaagggacactggggatctgtgatgagggcccagctgctgaccattctcctcctccacagaccccgccccagatgtccagcccctcctgctcctgggaggccaagggtctgcactgcaactgctcgtccagagcctggcctgccccctccctgcgctggcggctggggaagggggtgctggaggggaacagcagcaatggctccttcacagtcactttcagctcacttggaccctgggtcaacagctccctgagcctccttcaggagctggggcccagcctctggctcagctgtgagtcctggaacacccatggggcccagaccacctctgtcctgctgctacctggtaaaggaccccttttgggactaagattcgctatggaggggcttggtagggcaggaggtaggggtctgtggttagagcgaagtctgggagggtaagggccatggcctaggtcggtgtgaagaggagcagaagggaaggcaggatttccggcccagaatgcagtcatgttttctagagggaaacgggaagaagcttaggcgcagtgtgcagtagaaaataagaccgcacacacataggatatgcccattccttttcagataaagacagtgccacagcattctccaagggagcagttttgggctttggcatcacagccctccttgccctgtgcctcatcgtggtcatgtgagttggaagaagctaataagggggctgggatatgcacctcctgggagagggcaggtggaacagtattagcaaggtggcgattattccctcagcgtgaagaccctccagaagaaaggaacccaggaggaaccctccaggcccaagctctcccggggcagcacgatcctggactacatcaatgtggtccccaagaccaggtccctggtgagttgccaactgtacttccaaactaacattgccttgctaattctgcacatatcccttccctagccctctgatacccatgctttagagatacaaaggtgcaaaaaaaaaaaaaaaagcatcctagattaagtccaaatcctggctccctctgagtcttcacatcttctgttcccaagttggaggaactctctccagcacttacgcttactttgcttcctttatcgtcaccaccaaggccatgactgcctatgtgtaactacttgatctgtagttactgtgctggcaatagaacccagagccatgaacattcctggtacacccatcccctcactgcgggattctaggtgggtactctactactgacccatacccctagcccctcacttagggattctaggcaggtactctaccactgaaccacacttcctgcacctctttggtggatgctagacaagtgctgtaccacagaacatcctcagccctaaagaataattactaacatccttgtgaaatggtgcttcctacggattaaattcaggtctcaaagtccgctggctgggctcatatgcctgtcccttccctttctgttcattatcacatgctttcaagaagtcattgaacttctctgtgcctcaactctaatagtgggctaatagtgatgcctgcctcctgggattatatatattaatatagtagctacatgttaatatactaatctaatttataatatattattttattatataatattatttaatattatttaataattatataataattaaatataatatattatgtatttttatatattgcatctgtaaaatattcagaggagtctgtggccctaattgagagcttagtaaaccctaggtacaaccatgagatcacatctttctggtgatgactcaaatgaacatctgtgtctcccagcttcctccctgcactccagacccttatccaaccctccagggagcatctacactcagacatccgtgggtatttcctacccaagcctgtgcagaagcatctgaccagcctggcccttcatgctctccatccgttcctctctctctctctctctctctctctctctctctctctctctctctctctctctctctccctctctctctctctcagcagatagtaaccgtcttccccaagcaagctaaagccttagcatcatctttcggccctgtttcccacagctgatccttcaccaggttctcttcagaatacactcaaactgcttcaccccagtcttccctcaactctgcagttcatgtttcatctcgcagctggacaccacagctgctttcttcattacctcctctgattctgctcttgtctcttccactgccgcagaccctctgggtccctttgtctgtgtggaatgagtctctggtgcaggtgggcaaggagtcggcgggaattgacagacagactcgacacaagggagtgtggacctgaatgtaatttgtcaaatcgagcatcaaactttttatactgaagaaaatagggaagatgggtgacacaccagcaaggtacaaagaggttactggattcttacacaaaacagaggaatgcaaacacggaagaactggcaggaaccaagtggggtaaaactcaatgttgacaactgggatcaaaaccagctccacctaaggtccacttaatcttagaagtcaggggcaagagcttcatgcccttgccatagttctactctagtctattgaatagtccaccttccccctaggccattgtaaatacttgtgtatgggtgtaactcagctacctatagttctatgtatctactctggttcctctttaggtcacaaacttccttcttcctagataatggtaaatttctgtgtagggcagtgacttagctatccatgcccaaggtcagatcaaggactgcctagaatctaacttagctatatgtcaaaatatcaacccttaggagcagttgtaataaagcaatattaagggaaagcacacagatatgtttaccaactaaagcaaggacactggagcattctttatccaggatgccatggttccaggagactaagtttccgtgaacttttcaactctgggcagcgcccaggtttccggggcctgtcgcgcttgtcactactggagtagatgtagcattccactccgtttctctgcatgtgacatcctgtagaaaccacacaagcacacttttcctctggaatggtacagccagcaaaaggaacaaagtctttatgcataggacgatttacttgagtctgagggagacacagatgtaaagtgaatggtccgtactacatgagtccatctataccccactgaccaagttacaaaattacagagacaaggctgaaaatgtcgctcagttggtagagctcttttctgccatgcacaaatcctcagtccagaacgagggtgagcagagtgctgtgtggcaagcactcgggaagtggaggcaggagcattagaagtataaggttgtcttgcgctgtacataaaattaaaggccaacctggactacatgagacgaatgacaagtgagtaaatgttttagggggaggggagtggtaagtgagactctgaaggacagcaagggggttgctccatagtgaccctgggccctgaatcttgattgtagccatcacatgtgcttagctgtgctagttaatgagaacagcaagaaaggtccccaggccgggcctatacttattcacctagggagcaaccttgaggtcacacagatccttgcgcacgcccagctcaggagcacaaccctgagcacgcccagctaaggcacacactcctgggtatgtctcactacggagcatgcctctgctcagtttaaggtcataggtaaagaagaaaacatgacagaagtgcctttggacatgctcagactggcctataaaaaaatggctaggaacactttgaaggtgagttaaacaggagtctcccctagaaggcaggtaacaaagttcattgttcagatatcagcatcgtgtgaatattgtgtcgcagttaaggtgtgaacagtggaaaactggagtaagggcacagggatcttgcacagagtacagaacgtggcactacttctatgacattttttttttttttttttttggtttttcgagacagggtttctctgtatagccctggctgtcctggaactcactctgtagaccaggctggcctcgaactcagaaatccgcctgcctctgcctcccaagtgctgggattaaaggcgtgtgccaccacgcccggcttccttctatgacattttgttttacaaagagactctcatgtagcccaggctggcctcaaattcccttcataggtaaggattttcctgtatagccacggacaactgtgaactttttattctcctgttcccacccccgagtgctgacataaaaagtgtgtgccatcatgcttgatttatgtggcgatgggcatggaatctaaggctttgtgcatgctaggcaaacactctgccctgagtgacacccttggccctgcttttgacatttttgtaatcctttgatcatttcaaaacataaagttgaagaaaattatagatcaaaacacctcaattccctattaaccttcctctcccctcccccagccctggcccaccccgtgatcacttctttggatttccagtgccattttggggacctcttagtagacacttccacttctcttacaagactaactgtgtagcgagatagagtaccctgtacttttagtttcaaactttaatctttatttagtattatttatcagtagtattattgggagctgtgcatgcatgccaagtgaacattcagaggtctgaggacaacatctcgggagtcagatctctctcaattttagatgccagggatggaactcaagactgcaagcttgtactataagcacctttacccatcaagccattcttctgggccctatcttgttcattcattcattcattcattcattcattttacttattcacttattcactttacatcccactcactgcccccctcctggtcaccctctcccacaatcctccttcccccatgccccatccccttctcctctgagaaggtgggggaatctttcttaagcacacagctccagactctgttagaatagttaaatgtgttgcttccttcctgccttgggagagtttttccctgaaactgcattaaaggctcctggctccctttaatgctctttgcttgattatcaccccatcatacatgcccagagtgacctgtcatttattgtgcactttaacatttatatgtaataattgtgcctattgatgggtacagtgtgccactctactcacacacacagcacatttatcaaattggggtaattaacataagctctctatctcagaattaagtatttctttgtggtcagactatctaatctataactataactctactttttattttgtttgtttaagttttgttgagatgaacttaaacaaacttaaacaaacttagttctggctagactggaactcactatgtaaaacaggctgccctcaaacttatagagacacacccggccctgcctcctgagtgctgacattaaaggcatgcaccacgctcagctttatactttatttgtactctaattatgtgtgcatgtgagcgtgtgtgtgtgtgtgtgtgtgtgtgtgtgtgtgtgtgtgtgtgtgcgcgcgcgcgcgtacacattatgggtgcagttcttgaagtggccagaagagggctcggattccctgaagttaagtggttagggatctgctgggagaggctgctgtaagtgagtttgggtcctctggaagtgcagcaagcactctgaactgctgggccatctctctagcctggactcctgctttgatttcttcacagtgttcatcacttgccttcattagatttttgttcatgtgctgtttgttccttgattcctgtgactctaaagctagagccccagttcccaagtcagaggctggcacatgctaggtgcacagctgcttgctgagtgaataatgatgcatacttgctctcccctcaggctcggaattggaaagctgaaccagatgccccttctaggagctcacccctggacactcacttccctaaaccaaagaagaagcaaaaggacccatatttcacgtaccctggttgcccagatcccacatcatcctctcaggtcccagtctctgagaataaccaggaagaactccactatgctgccctcaacttctcccgcctgagactgcaggagacccaggatccccaagacacctattctgattacacagaggtcagagtccactgagggtgtcctggggcttaggactgagacctaaatggtaaagtagttaagggagtctccaaaagaaagcagatgctctccttaaaaataatcctgggggtagggggtgttaaatatgtgtgccaccaagcttgatgaactcttagattgatcccgaggacccgcatcgtggaagggacctcccacaaactgacctttgactccccacatgtgcactgtggctcacgcctatgcatgcacatacatgtaagttaataaatagatgtacaaaacaattttctaaagacgatggctcctgtttgggtatgctctaagtgtgtctctcaaaggcttatgttggggaagtgtagtcctctcggtggcagggggagaggtgatgtgtgctttttcaggagtgggacatggtagaaggtgttaggtcttaggtcattgcacaccccttgtaaggagtcaatactggtttcacagagtggaccagttcgcgagcaaggagattacaagtttggtagccaagctttcttgatcttcccatgttttatcgatctctcatgcactcctaccaagatgccatctgtcatgttgtggtgtaggcacacggccttcatcaaagcctatggaagatttcaaaataccagtcaatagttgcttttagtgagaaaaagcctacccaatcctgtcttcaaggaagaagaagcaagaagtcagccagcttaaatactgaagcacaaagcgcaccgatcttcttagagcctctttcttcttatcttggtgtcttagttaggatttctattgctgcaaggaaacaccaggaccaaaaatcatgttgtagaggaaagggtttatttgtcttacacttccatatctcttttcatcactaaaagaaatcaggacaggaactcaaacagcactggaacctggaggcaggaactgatgcagaggctgtgaaagggtgctccttactggcttgcttcccatggtttgctcagtctggcttcttatagaacccaggaccacctgcctatggctgaccctctctcatcaataactaattaagaaaatgctatatagctaaatccaatggaggcatttttcccaattaaggttctatccatttagataactctagtttgcatgtcaagttgacataagtctatcaagcatactcagttttctattactgtaacaaaacaccatgaccaagacaacttatgaaagaaaacatttaagctgaaggctcatagttccagagagttatgagcctatgatcataatagtaggaatagtggcaggcaggcaggcatgctgctaaaaacaagaaaacaaaaaaacaaaaaacaattgatagctatatcctgatctacaagcacaaggcagagaaagagagctaactgggaatggtgtgggcttttgaaatctcaagcccacactcagtgatatacttcctctaaggccacattcagtgagctctgtctttgactgagtcttatttgattgactaaccctatgtcctggttatgtttctattgccgtgaaacatgaagaagagagctaagtcagaatggtgtggactttgagacttcaagcctatcaccagtgacacacctcttccaacaacaccttctgcaacaagaccacattgcttaattcttcccaaatagttccaccaacttgggaccatgtattcaaatatatgagtgtataggggccattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcttgaatttgagggatggctacaatcccttttcaaccagcctatcaggggaccaatacacacatgtaagcacaagacagctttattttgcttacggctgatccaggctcgttctgttaaaattctctcctgggccaacataatggcttagcagattaggaaacttcccaccacacccagaggcctgagttcaatcctcaagacccacctgttggaaggacagaggtgactcccccaagttgtcctctgaccttcagacacaaaatataatttttaaaaagactccgttttattgcgtttttgaagtcttttactcactagtgatttgtttagttttagtttctttttgcttgcttatttgcttttttagacagaacctccctctctgtgtagcccacactggtttgcaacccactaggtcaaccaaggtggccctgaactcatggagatcttccttactctgcttcctcaatgctggaattaatagagtgtgccagtatgcctggctagctttttggtgtgtgtgtgtgtgtgtgtttacacgtatgtatagtctggcctcaagctacgtatgtagcaaaatatatctgataaattatttctctgccagagaaatgagccaattcaagacagatgatgagatgagatgagatgagatgcaggtttattgggaagctgctctcaggtgagttcactggcaccaaggacagaggccagggaagtcaccacagggaggggagcagggagggggaaaagaaggagagaaaggaaaagaagagaaaaggagagtgtgtagaccaaactgtctggattatatagggaagaccctctggagaaagggcagcttagccccctggctgggaagttgatggttgagggttggatatgccaggtagggactgaaggatgctgggaaaacccagaggccaggtcttctttggcatgtaagccatgcacctcagacccttgtcccgtggcctaaaaccaaacaataacccagaactctggtcttactggttctctctctcaaatggggtccacagcatgtgccaccannnnnnnnnnnnnnnnnnnnnnnnnnnnnnnnnnnnnnnnnnnnnnnnnnnnnnnnnnnnnnnnnnnnnnnnnnnnnnnnnncaactgtagcctctcttggctgaagctgggcttttggccctctgcatggtgagtatccagaaatgggctttccttggagcaaagataggaagacacggttggctacagctcaaattttttcaatttttcagtcttggggagggctataaataaacatttattcacttattttatggatatgagtgttatgcctgcacatctttaagtttgctatgtctggtgcctgggaggagaagagagcatcagatcccagaaactggagttacaggtggttgtgagctgccaggtgggtgctgggaactgaacccaggcttttggaagagcagccagtgctcttaaccactgatccatcttaccagcccctcaatagagatatttcaatttaggcttaattaaaagactccgagggaaagataaaatacctgagaacatgggtgtaggcttctctaagagagagttgtggattcttttgtctcttgataagagaatagggtcctcttgctaggcatggtggtgcacacctttaatgcaccacttgggagccagaggcaggtggccttctgtgggtttgaggccaacctgatccacatagtgaattccagggacccagcctcaaaataacaacaggaacaacagaatagaactccacaacttgtccagttccaccactgtgtgatagcacatagcctgttgatgtgtgtggggaacatggattagttagtgcttgcctagcatgtgtggaaccctgggtctaattaccagtgtcacagaagggggccatgacggcacactcttgtaaggaggatcaggagtttaagatcagcttttgctacataacaagtttgaggccagcatgagcaacatgagactctcttaaatgtcacacaataagtagtggcatatgccactaatccaagggcatatacctttgagcttgagccccgactgttttatagagagttcccagcccattagggctctcatagtgaggccctgtcttaaaacgaaacaaaacaaaacaacaattgtcaatctacaaaataaatgaatgaatgaatacaccttagtctagtcttacatcttgacttcaaattcagtccaaaccctgtagcctccttacccacctaacataggttcacactggtacctggccaggtgttgaaccttctagcactttgcaaaacagcggggaataactttctatcatttataagttacacagtttgtgacactctcttttgggtgtgaaaacagcttccgaagcaggaggaggtgacagtggccccattcccatcccattctgaagacaactgaagagaaaaatgaggacttgggcccccagtgaaagctcccacacctgcaccagtggcctccgcctctagagggcagcacagcgtatgcagccatgccttagcatagcagtcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagataccaggctgggaagacaactctgttggtatcctgagtttgatctgcagaacccagttttcaaggataaacaaataaatgatcttcaagacaaacctggtgacctgatttccatccccagaacccacatgatggaagaagaatgccaattaccataagctggcctctgatgttcactctccattacaaacgcatgtggttatgtgcgtgcctgcatgcacacaggcatgcacacaaatgtgcaaacatacatggataaataaataatttttaagagagtttaaaagccaggcatggcactatttccttataatcccagtgccggggacactggggcaggcagattcctaaagtttgatggcaatctcactagactagtgagaaacctgtctcaaaaaacagtgcgtggagactgatacccaagactatccttttacctccactcataagtgtatgcacatgcatggagagagatggaaaatataagcaagcagcatgctgagccctctgcgctactttgtaacaaaacaagaacttaaaagctggaggagaactaatttggctcaggggtcacacagctttgcctagtcgagaggagagtcttcacttagtaagcaggctggaggtcacacccacaacagcaagtccccacggcctctttctctactgatttctaaacccctgggaccctctcaatgacttttagatgaacttgctaaacccttctgaccaattacattctctttcagggacagagcagaaagtcactggagtttgcagcaacccccagagctgaattactggcttttctacccagagtttcttgcttactcagattaggagctgggtacagcttacttcctgggtacaaagaggtatggcctccacctacccagggccaaaggcagaaccaagggaaggaagctgcctttaaagggccaggtacatagccagccaatttggagagttcctcttgttccaagtggagctgaacctggaggagggagagagagagagagagagagagagagagagagagagagagagagagagagagagagagagagagagagagagagagagagagagagattgagagagagagagagattgagagagagagagagagagagattgagagagagagagagagagagagagagagagagagagagagagagagagagagattgagagatccctccagtctgggacggggcatacaaggactctgagagcctatgtgtctgctcaaagtcccacagtaggtaagtaacagatcagggaacagaagaggagctggagcttcgctcagtgggacagtgactacctaacatgtgccaacccctaacaccgagaagacaaacaacaagaaagttgtgtcatcttcgtttgggggtacccactccagcagtccaatgggatggcctgcttcccaaacacttctcaacttggccttcagcttccaggttcactacacatcaaaaaccattctctgtgtggcccaggcagacctggaacttgcctaggtcgatcccaaccctcttgtctctgtctgcttcaccagtggtaggattgaagctatatacctacagcccaagcccttccattctcttacagtgaaattgggctgagggatacaggtcagtggtagaggacttgctggggatgccagaggcctatattccatcccaatagtgaagggggggggtacggagagagggagagggagagggggagagggagatggagggagggagggaaggaaggaaggaaggaaggaaggaaggaaggaaggaaggaataaaggaaggagaaggagggagggactatttactgcaatgccagcactggaaaggnnnnnnnnnnnnnnnnnnnnnnnnnnnnnnnnnnnnnnnnnnnnnnnnnnnnnnnnngagggagggaaggaaggaaggaaggaaggaaggaaggaaggaaggaaggaaggaaggaaggagaaggagggagggactatttactgcaatgccagcactggaaaggcaagagacagaaggatcaggagttcaagatcaccatcagctacatagcaagtttgaggacatcctgggctacatgagattcaggaaagagagaggggaagggaggagagaggaaaggagagggacatgggggaaaggaggcaacagaatggaggtggtgggtagtggaagaacagaagagcattggatgagcacttgctgaggctgtgaggtttggaactagagaaacgtctcagtgattaagagaacttgctgttcttgcagaggaccagggttcaagtcccagtacccacatggcagctcacaatcatctgcaacacgagttccaggggatctgatgccatcctctggctttctcaggcactgcatgcatgcggtgcacaaataatgcaggcaaaataccatacctggaaagtaatttttgaaaaagaagtcttagttttgtttccagcatcacaaaaacaacatatatatatatatataaaatcaaagttcaaaatcaggctgggcatgtagctagtaggtagagagcatccctagcatgtacaacacccttggttcaatcccctacactgcatagaacatgagcaggggcacacatctgtaattccaacacttgggagtggaagcatgtagaccaaaatttatcttcagctacatagtgattgtgggaccagccttatcttcacggacctttgcccctccaaaacaaaaaaacaaaaaacaaaaaacaaaaacaaaacaacaaaacctaaattaattaattaattatattgaaaaaatacaaattccagccttttccttccttattcttatgcgtgctgtgaccagagacctactctgttttgtccactagagcagtggttggttgagttttcttttatttttgaaacggagacttgtgtagcccaagttggcctggaattccctgtgtagctgaggatgaccttcaactcttgatcctgctaccatgatggtagcaggatcagggccaacttacaataactattccttaggcaaacagagagaagggcaaaagcttctcaaccaactgcagtggcagtaaggagatagcagtgtctccggctaaggggctggagggatgacttaatggttaaggacgcttgctgctcttacagacgacctgagttcaggttcccctgcaagttcagctccaggaaacccaagcccctcttcaggcctctgccgtcactgtacttacatatacatacatgcacaggggcagacacataactgaaaataagaacacacctctaatggcagtatgctggctaacatgaagttgatagctcactttatgtttaagcgtttaagactgattgtgcttttgctttgcagagagctgtaatggaaaaattaggtatccaaggttaaggggtgttaaaggtggctcctctaattgcctggtcgtgtacaagtctttttaaaaaactgatgcttatgcaagataataggtcgtaagattcgctgctgcttttgcgtctgtaaacaaaagcttgttttgctccagataaccaccttcttcttgtaggtaaacagaatgtgattttaccttccttgactttacaaacccccgacggatgtagccggactgtatttggggatcccaagtcctgggtgtaaatctagcacccgtagctaaacaaaagcctcttctttgcttaaaatttattaacggtcagactccgaatgacccataatagcagcaaggacagtgtttatatatactataaagagtctcaccagaactaatgacattggccccatttctaaaatgaggaaactgaagcaaagagactgggcaaatttaagatcacaaaacaggttagaggtcatatgtgatagaatgcctaagtttaccaggatgcctaggtttaccatgacctacggtccccagtctaaaagtcacagcaattcttaagatcatcctgcgagcaacagaaacgcagagggagaaataagcgcctaggcctagatccctgggtctgtgggaggaggctgggtctgaatcccccggatctaagtgaggaagatgaagatctgagggaggaaggctagagcctggactcctaggtctctgaataaaaaagactggcactggtcccctgagtctgagattgaaagtctttggtctagaaccataggtctaaaagacgagagctggggtgggagagctgctgagtcctggcattctctgtcctccatctaggtgggaagatattctgggccacccaaaggcaacgcctggcatcccgttagccacgcccccagaacagccccctttactttcaggcccagcccttccttttgcccctccctttcctgttaaagttccagaaagatctggaaaaggcttcagacacgattgaggagatggacgagctagaagacggggctttgagtaatgggtgagtgagataaagaccttccaggaaagagagacttgctaagaaaagagggcagagaatattagagcgagcagtgtcttgaactgaacatatcgtttaaaaaccaaatagacagattcaggtactatgacctaggaattctctcaaggattttggtggctgactgttgagcaagatacttccaagccgggcgtggtggcgcacgcctttaatcccaacactcgagaggcagaggcaggcggatttctgagttcgaggccagcctggtctacaaagtgagctccaggacagccggggctgtacagagaaaccctgtctcgaaaaaacaaaacaaaagatacttccagatatgggggcagaaggaacagagccaggttacatgagacctcgtctcaaataaataaaataattaattactaagttaagccttagacacagcagctgggaattggagctgaaatgttgggccctgagattaatcagaaaagggaataagacagtggatggaggaagtcacaggtactgtgtctcctggaggctgttcaaag

SEQ ID NO: 1118 - DNA, 1639 bp, Mus musculus
gtcccagacttgcatgagaatccttcacatctggaagttcagcaaggccagtctcttcgcctcctctgtactgctgacagccagccccctgctacactgagctgggtcctagaggaccgagtcctttcttggtctagccctgtggggtcgagaaccctggcactggagctgccctgggtgaaagctggggactctggacactacacttgccaagcagagaataggctgggctcccagcaacataccctggacctctctgtgctgtgtgagtatgatctaccaaaggttcctggtcccaagaaggacaaaggagtaacatcaggctataaacagtcagattactgtgcagcttgtgttggggacccaatgagtgatgcacccacccacccacagcttccatccctgggagggatgttctgcccagagagaagggcctggcctgtctggaaccagttccctgtcttcattgcagaccccccacaggacctgagagtgactgtttcccaagcaaacaggacagtgttggaaatcctcaggaatgccatctccctcccagtcctggagggccaaagcctgtgcctagtctgtgtcacctatagcaatcccccagccaataccccgccccagatgtccagcccctcctgctcctgggaggccaagggtctgcactgcaactgctcgtccagagcctggcctgccccctccctgcgctggcggctggggaagggggtgctggaggggaacagcagcaatggctccttcacagtcactttcagctcacttggaccctgggtcaacagctccctgagcctccttcaggagctggggcccagcctctggctcagctgtgagtcctggaacacccatggggcccagaccacctctgtcctgctgctacctgataaagacagtgccacagcattctccaagggagcagttttgggctttggcatcacagccctccttgccctgtgcctcatcgtggtcatcgtgaagaccctccagaagaaaggaacccaggaggaaccctccaggcccaagctctcccggggcagcacgatcctggactacatcaatgtggtccccaagaccaggtccctggctcggaattggaaagctgaaccagatgccccttctaggagctcacccctggacactcacttccctaaaccaaagaagaagcaaaaggacccatatttcacgtaccctggttgcccagatcccacatcatcctctcaggtcccagtctctgagaataaccaggaagaactccactatgctgccctcaacttctcccgcctgagactgcaggagacccaggatccccaagacacctattctgattacacagaggtcagagtccactgagggtgtcctggggcttaggactgagacctaaatggtaaagtagttaagggagtctccaaaagaaagcagatgctctccttaaaaataatcctgggggtagggggtgttaaatatgtgtgccaccaagcttgatgaactcttagattgatcccgaggacccgcatcgtggaagggacctcccacaaactgacctttgactccccacatgtgcactgtggctcacgcctatgcatgcacatacatgtaagttaataaatagatgtacaaaaca

SEQ ID NO: 1119 - protein, 455 aa, Mus musculus
VPDLHENPSHLEVQQGQSLRLLCTADSQPPATLSWVLEDRVLSWSSPVGSRTLALELPWVKAGDSGHYTCQAENRLGSQQHTLDLSVLCEYDLPKVPGPKKDKGVTSGYKQSDYCAACVGDPMSDAPTHPQLPSLGGMFCPERRAWPVWNQFPVFIADPPQDLRVTVSQANRTVLEILRNAISLPVLEGQSLCLVCVTYSNPPANTPPQMSSPSCSWEAKGLHCNCSSRAWPAPSLRWRLGKGVLEGNSSNGSFTVTFSSLGPWVNSSLSLLQELGPSLWLSCESWNTHGAQTTSVLLLPDKDSATAFSKGAVLGFGITALLALCLIVVIVKTLQKKGTQEEPSRPKLSRGSTILDYINVVPKTRSLARNWKAEPDAPSRSSPLDTHFPKPKKKQKDPYFTYPGCPDPTSSSQVPVSENNQEELHYAALNFSRLRLQETQDPQDTYSDYTEVRVH

SEQ ID NO: 1120 - DNA, 74234 bp, Homo sapiens
  misc_feature (1)...(74234): n = A,T,C or G
acaggcatgcgccaccatgcctggctaattttgtatttttagtagagacgggatttctccatgtcggtcaggctggcctcaaactcctgacctcaggtgatctgcctacctcggcttcccaaagtgctgggattacaggtgtgagccactgtgcctggcctgtgttgtttcttaaaaacaaaacacaaaaaacccttttctcatccctgtgactcctgtgatgtcccttcctcctcctcttagtcactgtggaaacctgtcaaaatgatgtctaaggcatgggacatgcagtgtcttacaccaagatgaccacacttggtgctacttgtccccgcccctcccaccccacagttgatgggacaatagattaatatccagccccacagatgggcagtggcctataaggagagccagtggggcacctgacaccagagggcaactgaccaatcaaagcctctcttctggcaagagtgcctctaacagacactgtccgtcagtagtctcctgagcatccccagcctcctcctccacagcctgcctcaacctcagagacaaaaaaggcaggtgctgacaagtccattttgcagacaggcgtggccagatgacccagttgtgacttactgatacaaacagaagtcgctgagtcaagcttctgagaaagctacagctttcctgataaaaacagacatactcttttgtccttcatctacagctctttcccatcttccttctttgaaagtagggtgatgccagaacagcagcagccatcttgcaaccataagactaacaagttcaagaccaaaggccaacacattacgaatgaagtggggaaagatatggcaagcctagatccctgacaactcttctgggctggtgaagagatgacaataactgctcacttccagacgttctgttgtgtaagaaaaaacagcccgtgggattaggttttctgttacttgtagccaaaagcagtgctacctgacacaaacactttgttaatataccagacgggaacaatgccacagtcctccaaggggctttgtggttctgaagatgctgtcttctctttctcacttgcctttggggtcagagacgtctggattccagttctgaccccaccaattactgtttaaccttaatcaagacactttctctccaagcctcagttcccctgtctgcaaaatgggagtagcagtaacacctatgtctcacaggcttgttatgagaattaaatgagacagcatatggaagctatctggtgtgtaacatgaggcaaacacacagtagtgtcagtgatgaagagcccctttaactgaggtaacccgagcattttctctgagaagctgctggtcatgattcaaagtgccacctcgggaggcagcctgcctgggtttattcagttcctctgtcctcaaatttccaccactccctcgctgctgctcactctttgaggagaaccttgcttcttatttcactgagaagaaggaattatcagaagagaactttcacatgctctcaccaccaaagccccttcccttcctacacctctacccacctcccttccctaagacactgtgtgaataagctgtccatgactatcctaccaccacgtacccaatcccgctcacctttaaagaactcagcaactacaacctccccctctagtagaccaatttttctctttctaatggatcattcctgtcagcatttaaacatgttattgatatttcctattttaaaaagcaaaactctatttccaagtatcctcctatttctctacatcccttcacagaaaaactccttgaaaaagctgtcaacaccaagtgtctctacttctccccattcttgcttgaacatgctccattcagactttcgcccctcaccgctccgctgaaactgctcttgtcaaggtcgccagtgacctccacgtggttatacccagtggtcaatcctcagcactcactttacttgatccacactcgatgtcacccttctgcttgagttgctgtcttcctttggcttccacgactccacattctcctggtgttcctcgctgctcactggcagctgctcctcctccgcccctctgctttcacaggtgttactcaggcctgcgctgctgtgtgaagaccttcccttccaaacctggttccctgaccctttatctttcacaggtgttacccaataaacctctatcttggtgtttgcttcccagaggaccagaactaacacagctgctatcaccctagttcaaacaacaaccatctccagcttgaataggaataaaagcttcccactggtctccttgcttccagccttgcctccctctttccccaccctctattcttcacatggtagccacagggatccttttcaaacaagcctaatcgcagcactcccctgcttgaaaccctccatcaacactgtatcactctgagaacaaaatccacaatcctcaccacagcttacaacaccccccacgattgggcactctgctactctctgagctatctcctgccactctctcaggtgttccagctacactggcccctgtgctgtttcctgccaggcacactctggtctaaggcctctggctgctgttctcttcagagtgcccttggcctggatggtctcatggatcaccacttcatttcattcagaactatggtcaaatgctctcagagaggtttccctaatcacactctccaaaccagcacttccctcaccctctagcctagtggttctcaacggggagtgattttgacccctggcgacagtgggcaatgtctggagacaatttgggttgtcacactgagtggttctatcagtatcaagcagttagaagccatcacgaagctaaccatccttcaatgcacaggacagcaccccctccaacaaagaatcatccagctctaaatgtcaatagtgcctaggttgagaaatcctgttccatcccagcagtacattcttttttccatatcatctgccatccctgagagtatattatgtactttttcattctccgtctctcaccagaatgagagcaccgcgagggctttcttattcactgttgtatctccagcttttagaagagtgcctggcctacagaaggagtctaataggtatttgttaaatgaattaacaataaaaaaaaaaaaccagtcacatttgtttgagctcccactttgtgtcaagcccatgctaaccactgtaccaacatcagctcatttactactcacaaccagcctaggaggtgcacgtaaccacactcccgacaggtgagctggctcagcagggtaaggcaactcctctacatttagtaagtattcatgtgaagcacaaggcaagcccaagctccacagtcctgctctaccctgaaccaaactgtcttgccatagtccacagctggatgaaatttcctcagatttgtcttatcccagactcaagagtcccaaatggtccctgagtcatgctcaatcaaatctgaactcctctgtctaggagtctccattaactggccccaaactgctccttactgtcccctaaacaggcagttccgagatctgtaaattttacaggggcctttgaatcacatttgatgcatttgttctgggtgtggagaggtggctgggtgatgtcacaagagccagtctagagtggaagatgtgacaccgggggtggcgggctccctccctacccctgcatgcctctgtcactcctgccctgtacccacccttcttcctaaattcaaaatgcccttccctctacttcccaagacccatctcgcatatgcctccttcccatcctaatctcattccattgtgctttttcccttattgtgaattactccaacctatattatatacataatccacaccgtactatcatacatttgcatatttatattatcccattctagttgtttcttataatgaatagtttgtttcctggcagggcagggaactgcaaggaaaaagaaaatgccttggcttttaatgcttaagtgcttctcccaggccttagaatagcacaggatacccagcagactcttggcaaatactcatcaaatgaataaaattaacagagcttgctgttcaacacgttacatttcaggtgttcctggggctaccaagaggagagatgaaatcaaagtgagagtgacgcacaggataatcagcatataattaatcacagcagctggtgagcactgtgaggccaagtgcagagcaggaagagctaaaggaagaacttgacaggatgttatgtcttacagagaggacagaaaggttagtagaaacaaataaaagacactcagagggctaaggaaagagcctctatagttattataatatgggaaagttgaaggtagaaaaatggtttaaaatgaaatgaagcaggaagtcaaagggtatttgaattgacaaggcatctggcaaagatgtattacaagaaagcatgtggaaagaatggttccacagtagtcagactgagggacagctgggaatggaagtggtacatcaacttgctgaagagcccaggatgtcatttgctgcccatctgagatgtttaacaaaaaacgtgtcacctaatcagctagaaaatatgaactagtgacccaggagagcctaactcctgcttgccttccaccatagacctgccagtgggctgctcagtcattcattatacttgaggctgggtgcagttatttgaagatcttttgagtgattcaatttcattaaaattacaccatggaaatgtgacattatgaaggatcatgaaccaactacagaaatacagaaaagctgtggcatgagcaactcacacctgagtcacttccaatacttgtaccctaatcatggactctcagttcactggtattaagaattaaaatttatttcataacaacatgagggggagagaggaagaagacaggaaagaagtacatcgaagtaccgacggaaccctttcagacaaagaaagtagaatgaagcaggactagactctgcctccctgttgtgccgaacctctattgactccaatggggatggcatcaggttcaatagaccgaagagacctaatgccagcaaatgagacatggggttttattggggacttacatacagggcagagagtccaatggtggcggagaaccacaatggcttgcaaaaagcatgcagtttatatagcatttccacttagcaccttctccctaacaatctccacctggcaatcttcattcaactcaaaactcggggcctcaacccgtgtgcggcccatgtttcacaggacgagccaggggctcagatgtccctttatagacaaggaaggaacctccaggttggctactcctggattccctagctcagaacacacattcagatgcgtctgccatacagggtcattctaagggtatgtttcagttattgctatcaggcacgtttaccacatgctcccaacacccaataaagtgaacatacaaaaattaaaaattaaaaagtcaaaagttcaccagcatcaaccaaataagaaaagggaaccaaacatgctaaaattgtaaaaagagtcagccaagaggaaaaaatagaaaattcttccatctgtattccctgaaaccagtaaccaggaaagaaatgtcatgctgagattctcacaaataccctccgattctgaacagccaacaggggagtgggtgagcagctctgaaaacaaagcccttgagggcagaagcccacacatatcacaggggctcgggagtggcagggcaggcacgcagggctggccaccttccagggtgctgggccatacttggggactacccagagcctggagtggtgacagagggacaccactggctggtggagggggctctgggacaagactttaagggagtctgggaagatagaacagaggctagccctcccacaaggggctcgctcagcatgagctgagctccagttctctcccacacctcttcaggctagaatagaatagagagaaagcaacctaacatttgaagtggggaagacaaccagttccacataagtggggagaatgacaaggagactccacttacactgtatctgagcaagtaaaaggtggggataatgtaggtgttgacatcaagcatggataagatgaaaacaaatggcatggaaactaggcaaacataccacaaccaacagaaggacagaaaggaggaggggagaaaggaaaagaaaacccaggaactcagcctgggagaaagtggcttctccatggctatctcaagctatggatgattcaagagaagtaaaaatataatataacaaaagctcaaagacaagataatacaccacagaataagatgaaaagattgcagagtgaaggaaacaaatttagattcaaatggcatcagtaatgagctagtagataaattagagcagtaaagaacagaataaaaatgactgaaaattgagtaaggcacagagtaaaggtctgagattattttagtgaatgcagggaaaaaagaaaaaaaaatcctatcacacaatcaaaagaaatatgatagatatggaaggcaaaggtgatgaaacaaataactatatttcctgaaatagaaaatccagtaagtataacagagaaaatattcagaaatagaaatcaaaaaattaaccctgatgtaaaggaaggagtaaatctggcctcagtattctccaaaaccatattcaaaaatgagaaggcagccaggcatgatggctcatgcctgtaatcccaacattttggaaggccgaggcaggaggatcacttaggcccaggagtttgagaccggcctcagcaacagtgagacctcaactctataaaaaatttaaaaattagtgaggcatgctggtgaatgcctgtagtctcagctactcgggaggctgaggtaggagaaatgcttgagcccaggggatggagattgcagtgagccatgattgtatcactgtactcgagcctgggcctaggtgacagagcaagatcctgtctccaaaaacaacaacaacaacaacaaaaacaaacaacaacaaaaaaccaaaccagaaggcaattgatcagaaatgtctaaaaagatctcagaatgctatacccagttatggtctttttttcttccttttaaatatttttattttattttaatttatttatttagagatagtgtctcactgtgtcgctcaggctggagtgcagtgggcacaatcatggctcactgcagtctcaacctcccaggttcaagtgatcctcctacctcagcctcccagtagctgggattacaggcatatgcgaccatgcccagctaattttttattttttgtagagacggggtctcactatgtcgcccaggctggtcttgaactcctgaactcaagtgaccctcccgcctcagcctccaaagtgctaggcttacaggtgtgagccaccatgcctggcctaaaaaatttattttaaaaaagtaatttatctcttacagttgtggaggctgagaagtccaaggtcaagtggccacatttggtgagagccttcttgctggtggggactctgtgaagtcccaaagtggcacagtgcatcacacagtgagggggctgagcatgccaacatgctatctcttttcaagtataaaagtaacaggcagaaattctgaaacatgaatgaacttaaaaatacaacacattccagctcttgtaacaaaaaaccactggacaattgtgattcttgagcattctgaaaaaaaaacactaaaaaaccactagacaagaaatcctgccctccagcacttgcgaaggtaaaagcgaagcaagttgtgaacactaaatacactgaaacgtaggacccacactgtagctgaaggaatgatgagtgcagaacagataataataaaactaacaacaaaaattaaggtcggggaaaaataagaatgggtagaaatttaagtactaattgcctcatctttcactgtaggaagtcaaatattctgttctatatatatgaaattaaatgtaatatgttctgttttaaaaacaatagcttatatatcctatttttttgaaactacttccatttatcctgtcatcccttaaaccagacatgatgggcaccaaaagttaacactgttcctttctgaaagatgggatatttagggattagttaatgatggttagaaatctttaggagctatgcttatgaatgatttttccccttttctctgctttcttatatattctgtattttgaaatgcatccatatacattaaaaaaaaaaaaacccaaaaacctgaatgcttctgaccatagatgataaatcatgagacgattaagaatgacaaaaaagaacaagactgagaaaagactctgctatagagaaaaccaaacttgtttaaaggcaaacgagcagaaattagcagagaagaagcagactgagaagcaagggcccttgaaatgagtaagggttccaccagttcactaataaaccccatctaaatgccagtaactcccaaattaatacctccataccaggtctttccctgaaccccatattcctatccaactacttactcatgagcatagtcggccctccctacatgtgggttctacattcatgggttcaactaaccgcgactgaaaacatcttggggggaagcatctgtactgaacatgtatagaactatttttcttgtcattactccccaaacaatacagtacaacaactatttacatagtgtttacatcttgcccctacatctattctctaaacagcagctagagtgatccttttatttatttatttatttgagagggagtctcaatctgttacccaggctggactgcagtggtgcgatcttggctcactgcaacctccatctcctgggttcaagcaattcttctgcctcagcctcccgactaagaacctgagattacaggtgcccaccaacccgcccggctaatttttgtattttagtagacagagcgtttcaccatgttggtcaggctggtcttgaactcctgacctcaaatgatccaactgcctcgggctcccaaagtgctgggattacaggcgtgagccaccgtgcccagcctagagtgatccttttaaagcatagatcagatcatgtctttcctttgctcaaaactctccaatgactcacatcacatcttactcagaataaaacccagtctctaccatgccctataaggtatcatatcttatgatttccagcacaggttcctgcctcagggcctctgtgtttgctcttccctccatccaaaatgttctccccacagttgcaaggttcactttcttacttcattcagatctcttctccaataatgtcagagaggagttccctgacttttctactaaaattccatccccacacccttttcctgctttattgagagcaataattctgtctctttgtttataggtatctccctagagcttaaaaaagtatctgacacaaaacaggtactcagtatttgttaaatgaatgaatcgataaaagaacccaggattttattattctcaaaatattataaagtctttccttcttattgatcagactacttgcatcactataattcagacaaatattatttgttcttagtgagcagtacatgtaagttatgaaaaactctaccaagcctaggagtaaaggttggtttctggtcaattccacacatgtgtgtttgaggaaggcaggcgttgtcaccagaatcaaccaacacagaccttagtaagtggaaaagagagctctggctgccttatcacctatttacgacagagacttcagaaactaatgctggctttagaaaaaaagacgaaaaggagaaaaaaaaaagaaaacataaactaatgttggcttaactgtacctgtccctgttgggtcacctccttggatcatgaagtctttgataattctgtggaattttgtgccattgtagtaacctcgacgagccaactcagcaaagttcttacaggtctttggagcatgcttccagtacagctccagcacaatgattcccatgctgcagagggagaggacaacagctccagtaaacaaaaaggtcagggcagacaggagtattatggaactgctccaggactcttgattttcaagcttgtaagtcatgaaattgtgataaccactggatttcatgctcagcaaaggaaaacaccacaatgcaagtaacataaacacccattatcttttttgagtaaaacacgcaggtgttctgggtacttcttttcagcaaaataacaagcatggagaactcaaaattctaatactatacatatatacatatgtatatatatatagctatatctgattatctgaaaccaatataaccaacccctaaattaggaaaaaaattcttacacttaatttttaattttttaaaaaaagagacattaaaatatcaggagttcatatttatttagaagtttctgggtgggggtagggactgggtagatggaaaataggaagatgtttaatgaataccttttaaaaacttttgtatttttgatccatgtaaatacattacctattcaaaaaatttcaataaaaggtacagtttgtgtttgtttgggagggagtataacaaaggcaaaacctggtaactttgaatctttgcacctacccaataggatgagtgctttttcctcaccagtactactaaaagataaggaagaggcaagagaaaggacgagtgccttcccctctactccagcacatacctagactttaagctccaaggatgtgacaatttttttttttttgagaaagggtctcctctgtcacccaggttacagtgcagtggcacaatctcagcttatcgcaacctccacctcccgggctcaagtgatcctctcacctcagcctcctgagtagctgggactacaggcatgcatcaccaagctcagctaatttgttgtatttttttgtagagatggggtttcaccatgttgcccgggcttgtcttgaactcctgggctcaagcaatctacctgccttggcctcccaaagtgctggattacagatgtgagctatggcacctggccagatgtgagaattgagtcaactctgtatagtctggatacccagtgccttgcacagtgtaaacactctataagtatatgaggagtgtgctagaaaatagctaacagcctttctgcctgaaattcatccaattcatctttcacactgctcccattcaacacagattgacagttactctgtgtgtggtactctttccctcatgaagcttacattctggaggatattttcaaaatacagaaagtagccttttggaaagacaatcaggaagtacgtatacaattctgaaatgtgcatacctcagtaatttcaacttccaagtatcctctaggaaaatatacaaaagtgcctaaggatacaatatgtgcaaggatgttcatctcagtatttgtcatagccaaaaaaaaaggaagcaacttaaatgtccttgaaataggaaatgcctaaaatatcaactatccatactatgggcagctacctgaattactgagtgaaagaaaaccaagttacagaaaaaacatacatacagtatgatcatatgatcccatttttttgttaaaaaaacatgagagaggtttatatgtacatagaaaaaagtctggacaatcatccaacaaactgttgatggtgttttcaggaaggaggtgactttcacttcttactctgtatgtctacattgcttggatttaacaatttattttgtaactttaaaaaataccaacaggagaattcagaaattacaggttggagcctgaagatgtagaattttgccatataaggtggggaagatggccagggagcatgaaatgaacagcatgagcaaatagagagaggactgacagaactctgctttagctgaaagcagcaatgggcaagaacagaaaggcagaggaccttggctggtccctggctgttgaggggagaatggcaggtagacaagggccagatgaaaaaaatcaccttgaatgtcaggattaatacgtttttactttatactgttatagcagcaagacgttattaaaggttttttgagcaggatcccttccttgtcctactttgtaaagatcactttgagctttttccaaagaggcaatggaatgaatagagctaaaggatctagcaaggtgagacgagcacaccaggctccaaacgaggttcttccagttactagctgtgtggctttggtcaaggctttaagctgtaaattccggcgtttcctcctgctaatattgaaagggagaaagttaaataataccttcatgatttgagttgctaagattaaactaaatgagatgacatacagcggggcatggcgccagcaggttggttaccacatcactctttgatagtggggaaaatgtgcttcttcctgtattttactggaatttgtttctacaactgtattacttatcacgtaatgtttacatgtctgtctctttcattataccgtaagctcctaaaggcagggctgtctgtgttttatctacctctgtatcctcagaactcatattccatatgcctggcttgcggactcattacacgtttgttgaatgaatgaatgaatgaatgagcggactgggggaaggaggacaatcaggcagctattgctgagacctcagcacaagaccccgcggagcttggacgcgggcgatggcggtcccctctcaaccctctgggggccgtctcggccgctgctccacgcccctccacgtggaggccggcctcccggaggaacgcgccaggaacgcagacccgtggtgaggcccgggctccgcgtctcctctgccagccccagacgcccgaaccccctcacctggtctccaagtaaacgttgggtggctgccaggaatctgggggaattgccgccatagcgaagccggcggcggaatgcttgtctagtaattgctacttccggcgtcgattagctggggacccgtcgctgctgcacacttccggtccgttcaaccctttcgataccaggatttgggtggccaagacaaggaagaggacggtcccttcttccaatgccgggaagctggggtgggagacgagaagaagctgggctcaagaacagaggaaaatgcaaacttcattcgcggtggtctccaagtggcgataccgcgccactctgggcgatctgattggttcgtttaggcatggaaggcgggaacaaccagaaaagctgcgctctggttggagttatgtcctaatattaaattcgaagaatttcttagtctcacaattgggcagggacgggaaggggaggcagagaatgaaagagggtagtttagagatgccagtaaagaatttttgtaaggcgctgtacgatgtacacagtgcttgcactttcttatctcatctactccacaaaacaattctataagtagatagtattattaccatttttcagatctgaaaatagactcggcagttaatacttgtttttccatagtcataaagcaaatctgagcctgcagaatccaaagacgaggagtctgaggagaaaagagagggaaggggcaggaagaaaataggagataaagaaaggaagagacaggagaaaacaggacaaacggatcagagcaagaacaaggcttaacattggctgggatagatggtacctgaaagttgttaggagggtttgcgcagggcgcgaggaacagaagcaaattagaggagctataatgtttggagggaggacaaaaatgaaatagagtacctaaacttaacgctgtaaatgctttgcacaccacttaataatgatggttgaatgtttaccatgtgccaggcatcaagctaagcattttattgcgtattttcacgcttaatcttcaaaatcccacaaggtagatattactattcccattttactttgaggaagctgagccttacagattaaataacttgcttaaagtactacagctggtgcacttgtgctcttaacgacagttcaactgtaatgtccctaattgtcaacaaggaataaggatgtacaaggttgtaaagataaactagacagctccttgagagaggagctgggcctccttcatctttgtgctcttcttgcacagtacagagcacagggtgctcagctttgctgaatgaataatgaacggaacactacattttaaactgataaatgctaaagtataatttttacacctcctgcagtttcaagttcatgcccaccttgtggcccttgagctggatgaaaaagtcttaatccttggtctgtttagtctgttgttaagttgcctttctctggactttatgtagttctttactgtgtatctcgggagtcatgtgccattcccaggctccaatgtctgaatattgaaaagccacccccaagatcatgatcactttcttcctaaatcttttactgcagctcctaccagtcacttggcactgaggagacagagatgagtctcacacacacagtgccctgccctaaagaaactcacattctaggagagatgggcaactaaatacgtagctgtaggagcgtggaatgaggactgtaataagaagcacacagtaggttgggtgcagtggctgacacctgtaatctggcactttcggaggccgaggcgggcagatcatctgaggtcaggagttcaagaccaacctgaccaacatggtgaaaccctgtctctactaaaaatacaaaataagctgggcatagtggtgcatgcctgtaatccctgctacttcggaggctgaggcaggagaatcacttgaacacggaaggtggaggctgcagtgagcagagattttgcctttgcactccaccctgcacaacaaaagtgaaactccatctcaaaaaaaaaaaaaaaaagaagaagaagaagaagaagaagaaacacagttttccctgagctctggttactccagagtaggtttggacagtcaaaaatttcccctggagtgacagcctgggttgagatccagaaaataaattggagttagccagaagccatgaggggtcaaatcaaatcaagaaataaaatgtctccaattcctcagaagcccccctactaatcattacccattccttcctcccaaagggtagaccactttctgccttctaatatcatagattggttttccctgtttttgaattttatataaatggagttataaagtacgtatttttttgtgcctggcttcctttccttaacaatatgtttgtgagatgtattcatgttgtatgtagtggccatttttcatttttccttgctgtgtagtattctgttgtacaaacataccacaatgtataatggtgctgcgatggatattttgtgtatgtatcttagtgcacttgtgcatgaatttttgggagtatatacctagaagcagaattgctgtgtcataggtaacatgtataatttagtagttaacactagactgttgcaaagtggctgtagcaattttttgtttttttttgagacacaatctcactctgtcgccaggctggagtgcagtggcacaatctcagctcactgtaacctccacctcgtgggttcaagcgattctcctgcctcagcctcccgagtagctgggactacaggcgcatgccaccacacccagctaatttttgtatttttaatagagacagggtttcaccatgttggccaggatggtctcaatctcttgaccttgtgatctgcccaccttggcctcccaaagtgctgggattacaggcatgagccaccacgcctggccagtggctgtagcaatttatgtatgcaccagcagcctgtgagaattgctgttgctctgcttccaagccaactcttagtattgctagtctttttcatttaaggaatcctgaagcctctataacaatatctcagtagtaatttcactaacaactaatgactaatgaagttgaattctttttccatatgtgtgccatttagatatcctctttgtgatacctttttgtgttcaaatcttctacctatttttctatttggctatgttttcttatttgtaaagttccttatatatcctggacagaatataacactggaaagtttctaattttaatgtagtccaacatatgcattttctctcttacagaacatgtcagtgttggacagacattattggacatctcaatattgcagctctataattctgttttgtttttatcatatagatctgcaatgcatctagaacttatcttggtgtatggtatgaggtaggagccaagtttcatttttttctatatggatatacaattgacccagcaccattgattgaaagcattatcttttcctcactcctctgtttcacctctttgtcataaatcaagtgtccatatatgtgttttctggttttggtctctctattctgtttcattggtttcatacatttatgtcactgtcacactacctctgtagctatagcattagtctgaacccagtagtattttgtttgcagatttcttgtagaaagcagttaagagatttggcgctacacacagggcaggttaaggagtctgggttcaaatgctgatccttccattccttatctgtaaaatcttgagcaagttaacctctccataaacttcagttttgtttgtatgaggatgttatggggctatttatgccatagggttgatgaagtggctccatgaattgaaagtgcttagtacagtctgtcacagtgttaaagcaaactaaatatggcctgagaagggctttgtacttctatatttgagtccttgtggatgaactataacctagctttatagtcagacaaatttgaaaacttaacttaatagtatatacctgtaacaatagctgaatgttggccaatcccagcggccatacttcaacaactcatagactgccgaatgttcaaattgcattcaaataaggcaaacactgagctttaaccaatctcgctgtttctgtacctcacttcctattgctgtacgttagtttacctttttgtctataaatttgttctgatcacgagtcacccctggagtctctgtgaatctgctgtgattctgggagttgcccgatttgcgaatcattcattgctcaattaaactccttcaaacttaattcagccaaagtttttcttttatcagatggtgtcaggaatgggatctaaagtggagcttctagcgacccccaggagcactgagtgaacatgcaaggtacctgcaggatccacttgtgtctattgatctctcacagcagctggggatcacaggtaagctccctctcggatctctctttcctttcccttttttatcttttctattactcagggcaaccagcttgcccagagatcacgtgttgaaacccctagtcagacattggattaaagataacggggcccatctgagggcaaatataaaccttgccagtttgatattgagtgctaagcagagtggctaatgtctgtgttttatcacatgtattttgctctggccggaacaacaacaaaaaatttttcctttatgatgcggcttggcccccagtgtgatggtgtggcaagctgggtcactggggccgctgagggaaagggaacccagaaggctggcatgccagcaaaagagtaagaatttcttaccagtcagatttttggcttctctctctctgtgcaaatggttgaatgaatggtaaaaatcactgtttatttatctcttctctaaggttttgattaatgcaaaaaaaattctgaggttagtcttaaactgatgtatttgtgctatgaattcgtttttctgggtcaaggggtaccttaggataaaacacgggcttaggaccccacaagctcgctggtcaataacaaactttcctgcaggtccctgaaacacaaaaaaaaaactggatggggtctccatcttgttttatgtccttgggaacttgacctcgtaaccacgtggcagtactttctcttggtctccaccttctagggaacagggattttagggtttatgccatagttagctctaaaaattatcctgagtcattaaaagcctctgcaagctcaaaattaactactctagactccttctgggaagggcagtagactgctctgtgctgtggctcactggcctttcacactggcggttccagttccattccctgcttaggaagtaagtcatttctgatttaatatctgcataaccttctctagtctcttctcctccacagactatcttaaattttccttcctcgagcacctaggaagttacctttggtaaagttcaaaagccagaaatatcagccatttggcctgggtaaaatcagtaataagaaatttaaaaggactttattaaagagtgctatgcttaaaagtcaggttaattaaaaaatgaatattcaggctctaatggcctggaatccatgggaaaaacaggaggcaccagaaacccttttcctggccctgttcctccaaggactccaccataaagccaataaccaattaagaaacttaaaaactggcaaaagaaaaatcttacaactactatagtaatcttcttctgcctgtctgtctaattatatatgtattgtgtgtaatgtttatataaaagagctcaaattaattggcttaaacaaaaataagcacttaaatattttgaaagcaaaataaaaactgtaatgcctcttggttcatgtaactttagtaatctttgggaaataaaaacaactttaaatattattgataaagacattttgtctaaattatgcaggtcagatattagctttgctatatgcttcaaggtcataaactgctttgacttttgaaaattgttcaatttattttggagacattaaattctaaataaggcctggggatatatggaattagccatgccccctagctatacaaaggctataaagaaaatagatttcattaagaaaggatgttgtatggtaaattcttgtcctaaagtaaaatgactggttgtttaaaaagagggatgtttagggcaagtcagaaagtctaaacatgtcacacatagtctgtgtaagttgtgaaaaaatttatgaaaaggaattcatgccagacatgttgtacaatttaaggtgattaggcctcctaaatgcttcataaaatgccaccatgactcttaactgtacagcctgcctgctttatagctaggtaaggcctgggacacctgtagttagatgctggaaagagtcggacctttatctgcatttctgtctgggtcctgggctccacacctagtacataattaaaatccttacttaccaaggttttcaccaaaagtaaaagttgctaagagttaacattgtaatatgtaattgagagtactgaaaaaataggtttacatgcaaggtgtgtaaggagaatgaaatgtgttttttgtaagagattataagaaaatacaggaatgtaaatttttgcctaggttagagggttaaaggattgttttaaattaaataaagctaaaggtttgaacaagttgtggaaggtttataaaaattaattataggggccaggcacggtggcccatgcctgtaatcccagcactttgggaggctgaggtgggtggatcacctgaggtcaggagttcgagaccagcctggctaacatggtgaaatgccgtttctactaaacatacaaaaaattagccaggcgtggtgttgcacgcctgtaatcccagctactggggaggctgaggcaggagaatcgcttgaacctgggaggccgaggttgcagcaagccaagatcacaccattgcactccagcttgggcagcaagagtgaaactccatctcgaaaaaacaaaacaaaacaaaacaaaacaattaattattaggattctatgtgtgaacatattggctaaagttaaaatggcattattcagtttttttttccataaatgggacattggaataaaagcacaacagagttttcttagaagattgttctgctctgagaaaaaaaatagtaaagggttataaaaggtttataaaaatcttaccttatggtcaaactaattaaaactgaatagatttctaaaatattattaaaaactagctttaacattaaaaatacactaatggaaacataaaatttggttccctcttttagaaaggatttttatttaatattaaaagataatgaaaggtttttgtttaccttttaaataaacaacaaaaaaaaatggttgaggaaggaaagaaaggagatagtcagttggcctcatgctatcctcattggatcttgtttggaaagctgagtctcctttctatcaaaatactgttttttcctttaaaattttttaagttatcattttggctaaatgaatgacttatggtaacctaagattctattttgtaatatccaatgttttaaacctttggtatttaacaaacctttcaaaatcaagctctagattatcatgctaaataagccaatactaaaattgtttaaatatacaatttgaatgaactccatggtctaagtcaaattacctatgataacccattagctatcagtgctatgcacctaaattggagaaacaactggtattcaagaggacgtaagtcccgtgttaagcatggactcatgaagaaccaggatggccaccttgtccttcttgagtccttaaagcttttgttattaaacgttctggaaaagataaaataatccaaatttaatatattgatgtggtgacttataaattgcagaaataatttaaatccaatgtttggttccatattcctggaaagacgatcaaagcttcagatgcgtttggctacctgatgggccatttaaacatttataaagagatttcattcaattgtcattttctttttttttttttcttttttcttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcctggctaattttttttgtatttttagtagagacggggtttcaccttgttagccaggatggtctcgatctcctgacctcatgatccacccgcctcggcctcccaaagtgctgggattacaggcgtgagccaccgcgcccggcctgaattgtcattttcaatgcatgttttctggttgtataaaagctttcccatgcaatagggctgatgttataacagtagattatagtgtattttcaccagacaaagaaaactttttatgattcactgaggacaatcccttcacaatctagaacctgcagattggatcgtctgagaacaccagagaaagagaaagactgtccttgccatccacactacagcaaaactttggagctttaaaccttgggttcataatctcacagctgagaagggtccctccacactcctggaactgtacatccattggaacccttaaggtaaaactaaccagaaaagtttctccccagaagatggcatccttgattagaatagcttttcccaagatcatagatcaaaacttctactatcacaagactcttatctttgaatattttttccttgtttatgcctctatgaacaatagaaattaaaagtgggtctattatatgcacttatagggtatacttttatttgtgaaggattttgcagccagccttaaacatgaataaccttatatttcaatagataaaagatgaaggcccaatgtaggtaacaaactttagtggtacatacattgcctcataatcagtcaaaactcctcttaacccacatcatggattaaagagaacattgacaagaggccttcactcttctagaaagacatccatttgttaggtcctttttccatggtttagaataaaagaggcaataatttgaaatgtctccctcataataggctctacagcaaattctactttaaaggctatcgttacacaacagactttaaattctcctttgaaaattatactaagtaatagaattggctaaacagaaaagtacctgtgcagctgttgacacctgtggcctatggagaaatacagcaaatgtaaattataaacaattctggccgggcgtgatggctgacacccgtaacctcagcactttgggaggcagaggtaggcggatcccctgaggtcaggagtttgagagcagcctggccaacatggcaaaaccctgtctctactaaaaatatgaaaattagcctggcgtggtggcaggtgcctgtaatctcagctactcaataggctgaggcgggagagtcacttgaacctaggaggtggaggttgtagtgagctgagatcgccgctgcattccagccttggtgacagagcaagactccctctcacaaaataaatacaataaaaataaatatccagttgtaggggattagtgaaaagaccacttagtcaagcaaggagactcttcatctaactcattcttcaatctatttaattttaggtggtttggcttatggggaccctgggtaaggagcatactccaaactcttgctattatccgcccgataatgataataatagtctccctggtgcactgtattctctcaaagattttaaatgcttgcatgcagccatctctacaacgtcaaatgatctcttttcaactggaataacaaaaactgaaagaaatgtgtgaccatgaaggcaccgtaacctatgaatgacatgctgagaccagaaacccaaaatgatgtaactgagagtggcgctaaggccctaagttctggtcacgctgtcacctaagtaagaacctggccaaaagtgaggaatttttttttaaacaaaatcatgggaggccattattttggactgagctcatgcactaggcaccaacaaaccaaaccaaactaaaatggagtcactcatgctaaatgtgacataatcaaaccaaggctttaaaaaaacacaaaatgctagaacagaccaggttttttctcctgtaaacagatgtttcagaataaggaggtatcctctactcagcccttattctcttcctgcaaaacccactgttctactgtttcctagtgagtttcaaaaccatacaggtacacttatgacagcgataataacatcaatgaccaaggttttggtcaatctctcaaaattgagaaaatgaccaaaacgggggaattgttaaggcaaactaaatatggcctgagaaggactctgtccttctatatttgagtccttgtggatgaactgtaacatagcttaatagtcaaacaaaattgaaaacctaacttaatagtatacacctgtaacaataactgagtggtggccaatcccagcggccatacttcaaccactcacagcctgctgaatgttcaaactgcgttcaaatcaggcaaacaccgagctgtaaccaacctcactgtttctgtaccttacttccgattcctgtgcctcactttgccttttttatctataaatttgttctgaccatgaggcaccctgggagtctgtgaatctgctgtgattctgggggttgcctgattcgtgaatcttccattgctcaattaaactcctttatacttaattcggcttaagtttttcttttatcaacagagtaagctctcactaatgagtgggctgagtgaaaactggagggatttgttcgtctttctcaagagtagtagcttccagaaggaaggggctgctcttcatttacatttcccttccactcccatcccttaatgcctaacatgctgcctggcacatagtaggggactcagtaaatgcttgttctatggatcagttcagctatgaagtctgtgtgagccagtccaggtaaattaggaagacaaggatttaggactggggcgaaaagagccagaacggaagaaggacgccagggggagcaagaacctacactctccagatatcgcgagaggtcccgcgctcgccacgacactgagtgttctgttttgggcggaagcgctggacgagaggaggaattactctagggtacaaggcctcgccccaggagtggggggttgcttccgggtcgcgctcccggaaacaggaagttgcccatcctcctcgcccggcggcagctgtccccgaggcgggaggagcccgagggggcgcgagccccgcatgtgagtgactggggcccgaggctgggtggggggaggccgccctgtgacagcctcgccgccgcgcccgtctctgacatcctcgcgcagccgcttctcgccgctgctaccaccctctatcccagcgcggatcccttttctcagtctctccagttttgtagactgacagcatcccctggcagctcccccggggtcgactcccttaagacatctgtcactttctttgactccgccggggagagcaaaacgaggtggaccttgcttgaacttggttctcaggcatcacagcagtgtccataacttgagcgttgctaatgaagtccagatttctgcccttttgacggaatttttaagaaattaagagtagattccccacccccttctgaaagatctttttctaataatcgttagggggcaataattttttttctttaaatgtgtacttggtatgtgataaacctggcatcttggatttcagaaagaaatatgacttggtttcttgacacaagtaaaatagttgtttgtaatcacctcttagtagaaggaaatttgcctgcgtcgtgttttgtagtattttaagactgttaaccgtgcaggccacactttctagtctcagagccctcatagcctttgtattcgcaaatatgtttcttttaaagtatttagtcataaatcactttataatagagactacttccagatacttagtattctgacttttctgatggctcatttggtagttcctgtggtgggatcttctatagacgtctctcccttaataaattcgttcatttgaatttgggttgtcaaaatttccctctagggaataacatgcctttaaaataataactaataaattcaattctgctacattgaagttttgactaaaggttcatgtagcccaacttgcataccagaaagaggtcctgtttctgtcagaccttttctgccttggactgaggcatttttcaagacctgctttgaatacctgttcctccacagctactccacacaccagaaacaatgtccaaatgctagattcctaacctgctaaccttaaaccctcatcacattgttgctacctctgcgtttttttgtttttttttttttgagacggagtctcacactgtcgcccaggctggagtgcagtggcgtgatctctgctcactgcaagctccgcctccccggttcacaccattctcctgcctcaggctcccgacctctgcatttttaaaaatgaataaaataataaaacataaaatgaataaaccatgagccacgagttacattcaattagttcggaatgataattttaggtcctttctataaatttgttcaacattgatctgattccacatctgaggtgaattcccacgtctgttcttagttttttgtgttttctccatttatctctgctttcaagaaacactatttagggtgggaggtagacaggaaaatagatgtaatgccaagccctagaggtgcataggacaaaaactgaggtcagagtcttaaagagttcacttattggacaaagcactggagactaggctttttaggcagaggaaattgtgtatgcaaaagcaaaaagatgtgaaatagtatgacagtgtagaatgtgaagaaggattgatgggaaatgaaactgaacaggtaggcagtgaccagatcataaagggccatggtaagtaatttggactttatcttttaaaaaagacaggaatctcattccatcacccaggttggagtacagtggtgctattacggttcactgcagcctcgaactcctgggctcaagctacccctcacctctgcttcccaagtagctgggactacaggcaggcaccaccacactcggccaatttttatttttattttttttgtagatacagggtcttgctatgttacccaggctggtcttggaagtcctgggctcaagcagtcctcccacctcagcctcccagtgttgggattacaggcatgaaccaccatgcttgacttaggactttatcttaaaatgattgttattaggtatttaatttgtctggctattggaacaaatgtgttacatcattttataattctctgaaataaaacattgtggggtagaaataattatccccattttatacatgaaaactgaggcttagagaggatgagtagtgtctcatggccacacagtaagtggtaaaatctagaatttgcatccagctttttccaactccagtatctgtgttcttagtcaccatgctaaactgctcctgcagaggatggggagtcttggaaggtgcttagcatgagccaatttgtgtttcaaaaaaataagtggccgagtgcagcggctcacgcttgtaatcctagcactttgggaggctaaggtgggtggatcacttgaggtcaggagttcaagaccagcctggccaacatggtgaaacccattttttaccagaaaaatacaaaaattagctgagtgtggtggcgcgtgcctgtactcccagctactccagaggctgaggcacgagaatctcttgaagccaggagacagaggttgcagtgagctgagatcatgtcactgcactccagcctgagcgaagagtgagaccctgtctcagaaaataaaaataaaaaactggacaaggtagagaatggattggggaagaggagaactggaagtatagagattaactacatctttgtgatggtccataggagagatgttgaagaccttaactgtgctgttaatgtagagaggaagggatgaatgtgagaattatataggaggctgaatcaagaggacttagtgatagtttcattggtgggagtgaggtaggaggagaatagtttttaaatttggaggattagtgtttccattaagaaaagaggtgcagtgggaggaatgagttgaaggggaaaacagtaagttgggttatagacacattacatacagggagctatgggaaacttggatcaccgtgtctggtaggcaggtagataaatgggtcttgaaccctagagagagttgtagactggagaagagatttgggaatcaccaatagctggtggtcaaagtgttggagggaataagaaggtcaaggataactggtggataccagcagagaacgagagaattatgttaaggtttgagtacacttgagggagatagataatggggtagcaacagcagctgctgcagagaggtcagataaggtaataactgaaaaaaacgtccttcgaacttggcgtttagaaagccatttgtggcctcagtgaaagcaatgtcggtggagtgaggaggcagaaatatgatttcaacaggttaataaatgaatggaaacctgagaaacaagaaagtgtgttactttctccccccaacccccaaaggagctttcctctgaagggagggagggagagagtaccagaaacttagaaaggaactattatggcatttttctgatagtagaaactggaaagggtgaggatggaagcaagtagaggtaagcttaaaaatgtgaagacttcttcaagtatgtcaatgtcctaaaagaccaaaaaacaaaaacaaaaaaaaaaagaaaaaccacacactggggacttgttctgaagttaagtagattaaagagaggcatggcagccaaattcaatgtgtggtcattggttggatcctggatttttaaatagctatatgatctttttaaaaaaatttgatagttaaggaaacttgactatagactgaatattaggtaatattaagagattactcattttaatgggtatggcaataatgccaatggttgtgtgtagaataacgtcgttattcttaggagatgcatgttgaaatatttagaaatgattttataatgtgttgcaaataactttcaagtagttctggtaaaaacagaaagaaaatatagccaaatgtaaacaactggtaaatctaaatgaaggatatccaggtgttcattgtactatttttgtacaaaaagctttacacatttaatgtgtacagcttgatgaatttggacataagtatgcccttgtgaaaccatcaccatgatccatgccatcaacctatccatcacctccaagtttcctcctgccttcttacttattattactattagcaataagaacacttaacataagacctaccttcttagcatatttttaaatatacaatacagtattgttaactctgggcactgtgctgtatagtaggtctctaggagttattcatcttgtataactgaaactttgtattctttgcccagtacctccctgtttccccctgcctgcagcctcctgcaaccaccattctgttctttgcttctatgagtttagctattttagattaatcgcacaagtggtatcatgtagtatttatctttctgtgtctggcttatttcacttagcataatgtcctccaggtccatccgtattgttacaaatagcaggatttctttcttttttaaggctgaataatattccattgtatgtatatactacatttaaaaaaaaaattttattcttttgacacagagtctcagtctgttgctcaggctggggtgccatgatgtgatctctgctcactgcaacctccacctcccaggttcaagtgattctcatgcctcagcctcccgagtagctgggattataggcatgcgtcaccatgcctggctaatttttgtatttttagtagagacagggttttgctatgttatgttggccaggctgatctccagctcctggccccaagtgatccacccgcctcaacctcccaaagttttgggattacaagtgtgagccactgtgccctgcctgtaccttgattgtaaattttaagcatttattgtagttttaagttattactcttttaaatcgtattaatcatttcaatgttttatcagttatttttccttttaattgatgtttgtttctttgtagtggttcttattataatctaagaagcactttttctttttattattattatactttaagttttagggtacatgtgcacaacgtgtaggtttgttacatatgtatatgtgtgccatgttggtgtgctgcacctattaactcgtcatttacattaggtatatctcctaatgctatccctccccactcccctaccccactacaggccccagtgtgtgatgttgcccttcctgtgtccaagtgttctcattattcaattcccacctatgagtgagaacatacggtgtttggttttctgtccttgcgatagtttgctcaaaatgatggtttccagcttcatccatgtccctataaaggacatgaactcatccttttttgtggctgcatagtattccatggtgtatatgtgccacattttcttaatccagtctatcattgatggacatttgggttggttccaagtctttgctatttgtgaatagtgccacaataaacatatgtgtgcatgtgtctttatagcagcatgatttataatcctttgggtatatacccagtaatgggatggctgggtcaaatggtatttctagttctagatccttgaggaatcaccacactgtcttccacaatggttgaaggagcactttttctttactagaacatatatttaattaatgggatcactggataaaatagaatggaatatattcataacactaaagaatggataccatacttcatgggtagtgtaatattaaagagccaagtagagaaaaaagaaaatttaatttactctggatatagctcctagtgttgaagattgggatgtatcttgatggacttttgaaactttcttttgaactgtactgtttccccttttgtgctttaactagatgaatcagttttctatcctagagttacctcgctggcatagctcttcagaaaacagaacgtccagggtaatggcatatcagtgttcaggacttacttatctctatagaggaattagttctctgttaaacagggcaaaagagaagtttacatttctcttaacttcttttctgctttaaagaaacatttgtattggtaagttctatcagagtttttctgtcagatatgcctctaccctgtttcttcataggcagagacccagaaggaattgtggagaacatctcatcagagctctcagttgtctcctcctatttctgaagtactccagaagtgaaacaactccctggcttacctccgacaggcctctcttgaaagcaaggtttcttgacctcgttttgaggaggggtaggaggaggttctcctgtgcattgcaggatgtttagtctttacccaccagatgctaatagtacccctccagtttgttgatttttaatttttttaaaagagctggagcctccctgtgttgcccagccgggagtgcagttgctgttcacaggcgtgatcgtaactcactgagcctctaacttctggcctcaagtgatcctcctgcctcagcctcccgagtagctggaactataggcatgtgctgctgtgcccaactcctgtccagttttgataatcaaaaatgtcttcagacattgccaaatgtcccctttggagcagaattaccctgagaactattgttgtaaagtagtgtctcttaattgggggtgtgtgcctttaatcagcagagaagaggcttgaaagcgtacacacctgagctccactcctaacagttctggcaacttagcatatccgaggtggtgcatgatactttgatcctaataactccactagtgatcctgcctgtgcccttgcaggtctatgccactgttagaatcaggctaactcttcagaacttccccctgtagcaaagctcactttggccagagttggaactactttctgcaggtaagtggattgccatcaagcctcagccgatttcactcaatcctctcatgcttgatgcatagtaatgaccttatgtttgaatttttttttttttttgagacggagtctcgctctgtcgcccagtctggagtgcagtggggcaatctctgctcactgcaagctctgtctcctggggtcacgccattctcctgcctcagcctcccaagtagctgggattacaggcctccgccaccgcgcccggctaattttttgtatttttagtagagacggggtttcactgtgttagccaggatggtcttgatctcctgacctcgtgatctgcccgcctcggcctcccaaagtgctgggattacaggcgtgagccaccgcgcccggccttgatttttttttttttaagggatgagtttttttgttcttgtttaattaccatcgtatccaaccaaatcccaatagtgtccctctagcaagacaataaaaaatgtctccaggcatccctgggggcagaatcttttccagtttaggacgactgatataaccaaagccaaaaagagggcttatcacaatccacaggtattcttagaaacgtcactaagttgctattaactacctttctgataacttgagaaatgtgtcataatctctcggaagaaggatgcatggcttgcaaaaatatattcagtgttttaatatcattttaacttgaattacccaacaagaaaagaaacgtatttttttgtgtgtgatacaaactgggagtttaataagatttttatgtgtatcaaaaaggcttacaggccaggcgcggtggttcatgcctgtaatcccagcacttgggagtccaaggtgagtggatcactttaggccaggagtttgagaccagcctagccaatatggtgaaaccctgtctctactaaaaatacaaaaattagctgggtatggtggcatgtgccattttttattgtcttgctagagggacactgttggcatttggttggatatgatagtaattaaacaacaaaaaatatcatcctttaatcccagcctgtaattccagctgctcaggaggctgaggcatgagaatcgcttgaacccgggaggcggagctttcagtgagccaagattgcaccactgtgctccagcctgggcaacacagcgagactctgtctcaaaaaaaaaaaaaaaggaaaaaaaggaaaaaaaaaagacttgaggaggcttacaaaggttgcaaaacagccatcaaaaataatgatgattaatcctgttttcctcacctgtacttttgtccccttcaggattctcctaccggcacaccgtgttctcttctgtgtgtgatgttctcttctgcctcagggatacttgcttgtgaccccacctcccagcatccacactagtttttcactggaatttgtttctagcagtcctttctggatcctttccattctggtcctctactgagttttaatgggttttgactgggtattgttagataatgaattgtaacatatttaaatgaatattattcctacttgctttcatagaatgtctttgttagtttaaacaggaaaatggcatctcagaatcactgatcacaaaaccaagatgtgaaaaatgttgtaataagttatccctttactctatttgcaggaatcattgtagtcaatcattttccagttctcagccgctcagttgtgatcaagggacacgtggtttccgaactgccagctcagaataggaaaataacttggtaagggaggcagcatgcaacaaccctgaagtcaggacacttgggttcacatcctggcaagttatgaaacctttctgagccttgaacatgtatgaaatgggatcgatcacagctaccttatgggatcacagtggtgattcactgagataatatttccagagtgtttagcaaggcacctggcatatagggtgggaataggaataggagtgcaattgaacatgagtcttcagtttctaatgaattgaatttttctccttcctgaagtgttcatagattcttagaattttagagcgagactctaaaatttgtagtccaatcctcttattttttggatgcagaagtagaccaagtaatttaaccgaaatcatctcactagcaattggcaaagcttgtctccaggttcaatgctgtttcatttttccagctgtaatatttgaatacaactctatagagaaccaaaaagtcattggcatggcaaatcatgccttgcttcttccctatggtgccatggtcatgcattgctgtacatctctgactcattttgtgcccagtgatgttccttagaagtgactgtgagaattttgtgattacaaaattgatacaggaaaagtttgggaaatatgaaagtcacaaagaaaataaaaaccagctgtgatctcattttccagagatcatctactcctgaattatttttaattggaaatgctacatcttaatttctgggggtttttttggtgttattgttagtatggctcttaatgctttgtaatccatcctcctggctgctaatcaaaaatggcttagtgaaaagaatgtggggtcgaaatgaggctcaggtgacaaccgactgggtggtctcagataagtcacttcccatctggaaatctactttatatctctatagatttgcctattccttgcaggtttgttaaaaaggtattaagaaaaaaaagatgtgtctattcctgacttctcatctaaatgcagctatataatctgtagtttttcgtgactgtcttctttcacctagcataatgttttcaaggttcatccatattgtatcatgtatcagtactgcattcctttttatcgtccagtgattttgcattatatggctctaccacattgtgattatcctttcatcagttcatggacatttggattacttccatttgggggctgttatgaataatgttgctgttcacatttgtgcacaagtttttgtgtggacatatgttttcatttgtcttaggcacatacctagaagtagaattgctgggtcatatggtaactgtgtttaactctttgcggaactgccaggctgttttccatagtggctgtaccattttatgtttcaattcctccatgtccttaccaacactttttgtctgacttcttgattgtagctatcccagtggatgtgaaatgatatctcactgtgattttgatctgcatttctctgatggttaataatgttgagtatctttttgtgtgtttattggtcctttgtatatctttttttgagatggagtctcactctgtcacccaggctggagtgcagtggtgtaatcttggctcattgcaacctctgcctcccagattcaagtgattcttctgcctcagcctcccagatagctgggattacaggtgcctgccaccacacccggctaatttttgtatttttagtagagacagggtttcaccatgttgaccaggctgatctcgaactcctgacctcaagtgatctgccaccttggccttccaaagcgctgggattacagacgtgagccactgcacccagtccatttgtatatcttttctggagaaatggctattcaaatcctttgtctatttttttatttggttgtctttttattactgatttgtaataattcttgatgtattctatatagaccacccccttatcagatatataatttgcaaaaattttctcccattctgtggcttgtcattttactttcttgatggtattgagacacagaatttttgaggtttttcccctcctcttgtcttctacaaaaagtttttaattttgatgaagtccaatttattttttcttttgctacttgttcttttggtatcatatctaagaaaccattgccgaatcccagaatcatgaagcctccctctctgtgttttcttcgaagttttatcattttagcttataaatttaggtatttgatccattttgagttaatttttgtgtatagtataaagaaagggacaggcatggtggctcacacctgtaatcccagcactttgggaggctgaggcaggcgaattgcctgaggtcaggagttcgagaccagcctggccaacatggtgaaaccccgtctctactaaaaatccaaaaaaatttgctgggcgtggtggtgggtacctgtaatcccgctacttgggaggctgaggcaggagaatcgcttgaactcgggaggcggaagtggcagtgagccaagatcgcgccactgcactccagcctgggcaaccagagcaagactctgtctcaaaaaaaaaaaaaaaaaaaaaagaaaagaaagaaaggtccaacttcattttctcatttgtggatatccagtggtcctagcatcatgtattgaaaataatacattaaaaattatatagctgtcccttggtatatgtagggtattcgttccagaatctccatatacacccaaatccttgcatattcaagtttcacagttgattcttcagaacctgtttatacaaaaaatcatccctctgtatatgtatatgcagtttttgcaccctgaaaatactgtattttcaatcctgggttggtagaaaaaaatcagcttttaagtgtatccacatagttcaaacccatgttgttcaagtctcaactgtagtttgtactgtctttttatctgaatgtggggggtatagtgtggtgggctcttctctcattcccccagttcctggaagtctagattgcatgccttttaatccaccattagaagtcttctgattctgatttaattgctctgagttgatgcccaggtatgagcatttatgaaacgctctctaggtgattctaatgtgcaagccaggttaagacctaatgaactaaacacttaatagtcgtaaagaggaccaaacaggagtgattgggaggcacactgctggaagaggaggtgtgctggcgtgcgctgggttgtgttgtaacaacatgactatgtcctccaccctacaggtggcagcatctccttactgagagaatacacgtactatgtcagtactttttggggctagaagtactgtaggaatgaagtatgcaaaataaaaggaccctctgtattgaaaataaatatataaataaataaagcccagtagaagagagcacaaacccgaagaagcactcttcttcctcctgtaaatgaagaaaaatattattgttctgtaacttaaacacctttttaaatagccatttaattattttatcttattttatttctctagagatgggatctcgttctgtctcccaggctggagtgcagtggtatgatcatagctcactgcagcctcaaactcctgggctcaagcagtcctcccacctcagcttcccaggtagctgggactacaggtgtgtgccaccaggccaagctgatttttaaaatttgtttttcttttcttttcttttctttttttttttttgagatggagtttcgctcttgttgcccaggctggagtgcaatggcgtgatctcggctcaccacaacctctgcctcccgagttcaagagattctcctgcctcagccgcccgagtagctgggattacaggcacccgccaccatgccaggctaatttagtatttttagtagaggcggggtttctccgtgttggtcaggctggtcttaaacgccggacctcaggtgatccgcctgcctcagcctcccgaagtgctgggattacaggcacgagctattgcgtccagccttggaactatttaatttcattttacaaatgatacagagagaactctactttgccccattagtttttaccttttgttctctgggcatgatgaaacaatctgtctttaaaataactataggaacacaaattgaatttttaaattagttaaaaatcttaggtattttaagtatataaaatacaaataaaatgccctttattttctaaaattgtatttgtagaaaagcatgaggactctggttgctccagaagaaattaaaaaaaagaagaagaaagaaaagtgtgaggactgcaagccacatgccatggtttttgtgttgtctgaaatctttgctctgccaagaacaaagcttatcagcctgttgctctcagtaaatcaccttcagtaatcttcagtgatcagttcttcctcttgtgttgaacacaaatgttcaacaacagcgttaaacaacactgtgcataatccattttttttttattttaaggaatctccagtagcagatctcccatcattggtgtcagaaatcttttttggatgtcattagtgcttcagagtcccattaggatatattgtgctctagaccagtgctcctcagtttgcactagtttgggaactagtgcaggtctgtaaactgttcctggcccacagttaacgaatattttaaaacttgtatggcaatttgacattgtctctgtgtattcattgtgtttcatgaaagtattggtctgtagaggattgaggaaagcacaaaactggtccttctctacagatggtcaagtagctttgaagaggaagtacctaaagaaaccacctttctttttacatttattttctctccgtctctctcagggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggtaaaatgtttcctgagttggtaattgcttcaacagaacacaaactgttcaacattcttcacaaatgctattgttgactaatcccaccactgagcattggtttttccgtgaataaattggcctttgctcttgttaccatgtgttactaggaaatttgactgtgttgttaaaggtcctagatgaaagctgcatatttacagttaaattatatttgtgtaatattattatttaattttttattatttgtttgtttgttgtgtgtgtgtgttttgagacggagtctcactcttgttgcctaggctggagtgcaatggcgcaatctcggctcaccgcaacctctgcctcctgggttcaagtgattctcctgcctcagcctcccaggtagctgggattacaggcgtgcgccaccacacccagctaattttgtatttttagtagagacaggttttctccatgttggtcaggctggtcttgaactcctgacctcaggtgatctgcccacctcagcctcccaaagtgcttggattataggcgtgagccaccacgcctggccttgtgttttgtttttttttgttgttttttttttgagatggagtcacactctgttgcccaggctggagtgcagtggcgtgatctcagctcactgcaacctccgcctcccaggttcaaacgattctcctgcctcagcctcccaagtagctgggattacagccatgtgccaccacacctggctaatttttgtatttttagtagagacagggtttctccatgttggtcaggctggtcctgaactcctgacctcaggtgatctgccctcctcggcttcccaaagtgctgggattacaggcctaagtcatcgcacctgaacagattttttatttttctagtcaaggtcacactgtgttgcccaggctggagtgcagtggtgccatcatggctcactgcagcctcgaactcccagactcaggtgatcctcccatctcagcctcccaagtacctaggaccacaggcatgtgccaccacacctggctaatttttctattttttgtagagatgggggtttttccgtgttgtccaggctggtctcgaactcctgggctcaagtgacttgagtccagtcaatcactgtcagactgagttcgagactgcccacctcagtctcccaaagtgctggggttacaggtgtgagccactgcagccagcctttatgtatgtatttatttattttttgagacagagtttcactcttgttgcccaggctggagtgcaatggtgtgatcttggctcagtgcaacctccgcctcccaggttcaagcaattctcctgcctcagcctcccaagtagctgggattacaggcatgcgcaaccatgcccggctaattttgtatttttagtagagatgggagtttcactatgttggtcagctggtctcgaactcctgacctcaggtgatccactcacctcagcctcccaaagtgctgggattacaggcatgagccactgtgcctggcctaatacttgtatttttggtagaggtggggtttcaccatgttggccaagctggtctcgaactcttgacctaaggtgatacacccgccttggcctcccaaagtgctggaattacaggtgtgagccactgcgcccggcccctttgtgtattattattattattattattattattattatttttttttttttttttttttttttttttttgagatgcagtctcactctgttgcccaggctagagtgcagtggtgcgatcttggctcactgcaagctccatctcccaggttcacaccattctcctgcctcagcctcctgagtagctgagactacaggcgcccatcaccacatccggctaattttttgtatttttagtagagacagggtttcgccgtgttggccaggatggtctcgatctcctgacctcgtgatccacctgcctcggcctcccaaagtgctgggattacaggcgtgagccactgcgcccggccccctttgtgtattattattattatttttatttatttatttttattttttttttgagacggagtctctcgctctgtcgcccaggctggagtgcagtggcgcgatctcggctcactgcaagctccgcctcccgggttcccgccattctccggcctcagcctcccaagtagctgggactacaggcgcccaccatcatgcctggctaatttttttgtatttttagtagagacggggtttcaccgtgttagccaggatggtctcgatctcctgacctcatgatctgcccgcctcggcctcccaaagtgctgggattacaggcgagagccaccatgcccagcctgtgtatttttaaatggtgaattttaaaatacactgattatatggtagcagcttggtgagccttgcagtccctatagttctcaaattctaaattcttccagaagtaaacctaagtggcttgtttatgaaaatggattagttcttaaggcacattggaagtagcagaagaagcctgttttgttttgttttttttcttggtattaaggtatttgtttgctgggattaatgccttttctatctttccttgtaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccaggtaaaatgcaacatttattacttattagatatagttttcttgacagtatatgataggaaaggaagtaacatttattgatacctaatgagaggcaagctccctatattgtatcttttaattcagtccccactaaaactctatgagatggggtttattatccccgtttcacagattaagaaaccaagggtcagagagattaagaaactcgctagaggaacatctggtagagccaaatacacacccccaaattccagaacacacatgatggggacaaatgtctttgcccataaaaaggatttgattgtatctcatccttttctctcctgtgattcctgtccataatgcatatttaatacataggtattggtttattgaaagcaaccgagttcagcttgcttctaaaggtcctctaacagtccttggcctattgggctaggtttttgtctgggtatatcccactctttcagtttagtccttctgtctgtcacagctcatttaatttagtcctctaaagtatatcaattttgccagtaagtagaaattaaaaaacacataaatttagtaacagtgcatcggtggcataagaattcatagtctgatagactatttgaggggtttccttttgagaacagtgttaacatgtaataagagttgaaatttactttttcaggctgggtgtggtggtttacaactataatcctagcaatttgggaagctgaggcaaaaggattggttgagcccaggagttcaagaccagcctgggcaacatagcgagaccctgcctccaattttgtgtgtgtgtgtgtgtgtgtaaagaaatttactttttgagaaagggggatattattttgggatttttttggtgatgtttatcttatttggcaatgtagaataatatgtgtattaatatcacaaatggattatagaatttattgtgtaaccatgatccgaaacttttagaatgtgtcttaaattttaggaaaaatgctttcagaaaaaatgtatttaagctttataatcataatgtcattctctttttttttgagttggagtctcgctctgtcgcccaggctggagtgcagtggtgcgatcttggctcactgcaagctctgcctcctgggttcacgccattctcctgcctcagcctcctgagtagctgggactataggtgcccgccaccacgcccggctaattttttgtatttctagtagagacagggtttcaccgtgttagccaggatggtctcataatgtcattctttaagatctaatgagtcataaaaatcatcccttggattgggtctccatcgaaagctatttttgtatacttgaggaagtcatggaaaggtttccaaaattgtatcaaaatcagaggaagggaacattgtaagacaagaattccacctcaggagtttttgtttttttttaaaaaatcaacagctcagatatttcatttgaaaatttcagatgtaacttccttgtatttattgggaaggttgcttttgaaatgtcaccaacagagctaaaaaaaaaaaaatgcagtctcaaactcctattagaacggttcaaagtgtttggaggaaacagcgagagaaacttgtcagttaggccagtctgtgcctcttcctcagacacaccagtctcctttcctgactgtcttcccctcaaagcctccctaacggcaactcctgatgagttttcctgacctggttgatggcattatcttcttccccagtcctataaagtaaatctccatacacggttgaactgagaaatggggcatcgtcaatgaacactgctcgcttcttctctaaatcatagtttaaacattccagaaacattagtgtcttgtaaacaagctggattatttggactacttcaaatcaatattttgccttgcagatggaaataaaatgagtccttggagctcagttgtagagagagcgagtgagcattggaagggtgtggctttagctctttaatgttgttgattctattaaagtgctgtttttacttgtaaatgtggatgtggaagcaccatattttcctatgtatgataattctgggaagctgtagacatgtgaaactaacagcattttgcgtagcatttggaagaaaagttaaaaacacgtaattatatgaagagtaaacagaaacacatgagggagaattaagtgcaacttaatctgggcctgtaagagggcaggaaaagtaaaaatatatcattttttaatgtcctggtatcaaaaaacaactaccttcaggttaggattagttggccatacatttaaagtaaatgcaaggggagaatggtgtgacagattcccgaaaggaaaccccatatggtttcctgaagtgctggcctgtctcacactcccagggtcatctggtgctccttgcagtggcacctcgggaatgatggagggcagctgcagccttggtgatgtacaagaggcaccaccaccaatgactggaagtttcccctgaccccacccagggaacaaaaaggtgacagaggtggggttctttttctagatttcagccttagataggaaatcctgcccctaaatgctctcaataagaagaatgaagtgactttgcagcgagtcatggaaacatcccgctctgcagcaaaaaataagtaaataaactgacagttgtttattacttaccagatgccagaccctgttcagggggctttccatatatcggcttatttaatcttgacaacatccctatagggtagcttcaggttttatgcccattttacagatgaggacactgaggcacagtatggttaggtcacttgctcaaggtcccaggtctggtcacggagccatgatttgaacccaggcagccagtcttcagagtctgagcccttcgcctctgatgtgagtagtctgtagctgtgcagtagacctgaagagtctagctttaagtctgatgttggagttctaccactgtctctctcggatcatcagttactttctcttaactccctagtccctgaagagacaatattctttctggctgttccaaagataagtggtcttccaagcttctgaccctttagaattttcccgacctggtgttgtcttagacattcagcccagttcatcctccctagtctgcaccctgacattcagcccagttcatcctccctagtctgcacccttatggataatatttgactgacttaatccttcctcttactgacccagagttttctctttacattcacattcttactgcttttctcccctcctggcttcatatctttatagtcactttactcctgccggccatccccttggtttttaccatttccatggaatcattgagtcttaaagccagaaaagaattttagagttaatctagtacataccccattttataaaagaggtaactgaggccaggagaggtaaaggagcttgcttacccagctaaaagtggcaaaatcacacttgaaccctagtttcttaactccctctagcattctgtccaagatatcacacttacagcctgccatctctgccctcagtcaagccaggcgctagcatgttcagccaattattttgtttactttggtcattttctggccaacttaaaaataacatattcatttctactgaggaagcctgggatagttctcacatacagtgaaaaggcacacatttggaactcgatgcatcccgtaaccttcaaaggaaggatgaagtagatccagcaacatcaagaagttttggaaatagcaaatcatttattggcctcaaactaagaatctagtaagacttagagagtccagatctgtgctcaaagatgaactgcttagaccgcaaggaaaaccttcctcttttatttgcaaaataagcttaccttctgtgataataacagctctgtcaagcacttactgtataccaggtactgtgccgtgcagtttatttctcagtcttcacagcagtcacataaggtagatactgtttttatgttcatttcaaagatgaggaaactgatgtgcaaggggattgactgacttatctgaagtctcacatttatttatttttaattttttcttttgctgtgtttttgataataaattttcacatttagaaacaaatttttgtacaagtgagaactcatgaaaatagactttctctgtggtttggagtggttcaaatgcattgcttcctggaggcaaggctgttggtgaaatgatttcttgggctctttccctctacggtgtgtgaaaatggctctgggcatggtgccacacatgcagggacctggcagaagcctccttcattgtcaaggcttcacccctgcctcatgcccggggtactagaagaggtgctatgcacaaacaagcttctggagagcagcctgattaaatattgagcacacactagtgaaagtcatgggaactttgtcatgggctttgcagggttttcttggctatatttataatgcaagaaatgatgaagttatatttatttaatctttattttgaggtttctgtgaatccagattgctcatttgatttttctccccatggacttaattctattgttaaagcttctgaaaaatcagccttcctgcctgccttcctgccttcctccctccttcttttcctccttccatcccttcctccctctccccaacttcattcactcattcagtaaatgtttattgagaccctgctatatatgccaggcactgttctcaacaaagcagtgaacaaaacagacaaaaccactgctcttgtagagctagtattggctttgttcttttctttcttccctatcctttttatccagagggagttttttgtcctggaaagaaatcttttgttttgttttgttttgttttgttttgttttgtttttgccaggtaaataatctatgtaacagtactctccccactcagaattccaggatatgttatggttgtctacagagaaccagcctaagtgagttttcttgtaaataactctcaggcaccaggaagctccctgatgggtgagacgctggcccatccatttttctgcccagtgcccaacttgtaaagaagggtggatagttatggtctctgcacgttgacttcaaggctgtgttttgtctgagagactgtttttgacatctccaacagtgaaatcattccaaatcatagtgaaaacttgaaatacaagttataagctttattgaacttttatatgtaggatttctcttctctgtcatacctttaaaaaatgtttaaaatatctggtatgagggatatctggagtaaagaagccttagaaattaaaagtaggaagttgctatataatttacgctgacttttctgtctggtgcttcaggaaaagtggttagaaacaggagggctggaaagaagtgagatgcagcatattaggtagtcaaaagccgtaaactagggtggcatgggctcggctggctgtgtgctgttggctgtttcccaggatggaattttgttcactttgtggcatgatggctccagccagttgtatagagaacacgtcagacaaaaccttttcagatggacagaggccaagctggagtctggccacatctctttctgttgtcagggactctgtggggagaggaagaggagcctgcaccctacctccacccctagttcaccgtttgcccgttcctctctctaagcttatgctttatccaccttggtgatctcaggctacagagaaatcaaaagtagttctttcttttaaagtttgggctcccttagttcaggtggatggcataggctaccccattccagtgatccttttttcttgttacttcccttccttctttgcgggccaccagcctggccacctctgctcctgtcagatacctctctggggccagccttctgagatgatttacctctacacttcagcattgaattctcagcttcagttttcatgatctccaaggacattttgacttggaaagtacataaaatacatgcatacaaagacagtaagaggtgtaatattttgatatttaaaaatacttataataaagtaatatttctcatctctatccttttaacttttctactcaagcaactgctaataataacttggtatacatccttctgagtttttccatgtctatacaaatagatatacttaatatatataaatagaaatacttttttgttcacacacatacaaaagatctcatatacatatttttggctagacacattgtattagtttctaaggctgctgaaacaaagcatcacaggccgagcagcttaaaacaacagaaatccagtacctcacagttgtggagtctagaagtcagaaatccaggttgatagggccacgtcccctctcaaaggctctagggaagaatccttcctggcctcttccagtttctggtggttttcagcagtccttggcattccttggctgtgtcagcataacttcagcctctgcctttatcttcacgtggccatctgctttctatgtgtgtctttgtgtcttctgtcttcttctaaggacatcattcagattggattcagggctcatcctacttcagtatgacctcatcttaaatgactacatctgtggccaccctatctccaaggtcatgttctgaggttccaggaaaatgtggattttgggaaaacataattaaaccctctctatatatttttgaggattttatattagttgattctgtgactcttctataatttaaccattttctagggttgttgtgggttttttttttttttgctattacaaaaatatgtacctgagagattcatatacacatatctttatatagatatactttttttctgtaagatatattcttggaaatggactcgctgagtcaaagggcatgtgcattttaaattttaataaatgcaaccaaattgtcttcataaacttataccagcttatactttcattaacagcatatgttgatcattgacactggatgttgtcaatgttttgccagttagaaaactaaataatagtatctcatttcaagttgcatttcattgattattagtcaaattgcatgtcttttcaaatggtttataggccatttatatttataatacttttctgtgaattccttgttcatattttttccccattaaaaatttttttatctaccctgggcaacatggagaaaccctagctctacaaaaaatacaaaaaattagccatatatggtggtgcacacctgtagtcccagctactctggcagctgaggtgggaggatcacctgagcccggggaggtcaaggccacagtgagccgtgattgtaccactgcacttcagcctgggtgacagaatgagagcctgtctcaaaaaaaaaaaaaaaaaagttttttgttaattcaaacagaggcttatatattagaaatactgattatttgtctcgtatatgcaaatattggtcaaatctgtccatttttcctttatagcctctaggaagccttccttgtcccaaagattataaaaatactcatttctcagtcctcacaacagtcacttagggtagatactgtttttatatccatttcaaagatgaggaaactgatgtgccaagggattgactaatttatctaaagtctcacatttacagacacatttttatacaggtgagaactcatgaatatatgtgaactctctatggtttggagtagttcctctagcttttttttttttgagacaggatctcactgtgttcccaggctagccttgaactcctgggttcaagagattatcctgcctcagcctcctgagtagctgggactaaagtgccaccatgcccagctcctttagttatttttaaaattttatgttatctatttgtatcttttaatcaatctagaatttaatttagtatatggtgaaagggtaggaatctaactttattttcttccatatagatggtcacttgtcccaatttgatttattgaatctaccctttcctcacttaattaaaaatctatgtttatcctttattggccaggcatggtggctgacacctataattccagcactttgggaggccaaggcgggtggattgcttgagctctggagttcaagaccagcctgagcaacatgatgaaaccctgtctcttccaaaaatacaaaaattagctgggtgtgatggcacacactggtagtcccagctacttgggaggctgaggtgggaggatgacttgagcctggaaggtcaaggcgacagtgagctgagatgtgccactgtactccagcctgggcgacagagcaagaccctgtctctaaaaaaaaaaaaaaggctggtctcaaactcctgggctcaagcgatcccacctcagcctcccaaagtgttgggattacaagcatcagccaccacccataaatgttttatcttgttaaatttattgctagttattatgaatgagattattttccatttcagtttttaactgattgtggccagtagagtaagaaagctattgatttttatgtatctgaaaatctgtatcttgtattctgtcaccttattaaattctctttttagtactaacagttttttacttgtgttcgcctctaactttcagttccctcaaggaacaccacctccaagtttttcttttagtttgctattcctactttctttttctttcttgatttccctttactgggttttcttctacctgctttttaaagggatctccacctggaaatcccaagaatatctaaagctctgaataaaattaaaattaaataagttaggctgggctgggcgcagtggctcacgcctgtaatcccagcactttgcaaggctgaggttggcggatcatctgagatcaggagtttgagaccagcctggccaacatggtgaaaccctgtctctactaaaaatacaaaaatgagccaggcttcgtggcgggcacctgtaatcccagctattcaggaggctgaggcaggagaatcgcttgaccccaggaggcggaggttgcagtgagccgagatcgcgccactgcactccagcctgggcgacagagctagactccatctccaaaaaaaataataataataataattaaataaattatagttaaaataattctcctaactcttaggttaagagctgctcggtgctagcccatgcagcacctttatacaaattcgaggaaggtgcccctttctcctggtgctttactctcatctcctgggaagactgtcataattaactgattctgttggaatatgacacgctactacagaaaagtgtcataataaatctgcagatgacgttccctagatgagcactaatgacataggtgataccagagatctgcaggtttattatgacactgaccaagaggacagtatagtgcaaacattcacagtagtgctccttggggctgtagatttcatcttcactgcttctagaatccaccccttttttccattcccactgcctcattcattatatttcacttctcatcacagtgaaccccccccccccgaccttttccctaaaaaagggcaaaaccaaaatataaccagatcttccttttcccagcctctctcttctagggcaccctaatcacaatccagaataatcttcctagaacatcgagaaattcctgctcaaaagcctccaacagttcctctttttgttctgagtagagccagacatgcttcaagccctggaagccctcaccacatcttcctctgcagcctgtttccttacccaaacccccactgcacgcccagcatctgctgtgttcttcctgccacactctggcacctcaggaacttcctatcacctctaactttcagtttgttcatccacagaatgagaatagtgattcctcctcagtaattacacagtgaaaattaaatgctataacatgggaaagtgactaacatagggcaagcactcagtgcattagcttgctttctccttccccttccatcgcaagtactttggaaaccgaaatgctatataattgtaacatgttgttatgattatgccccatggtgtgtccattacccagagcttttgcatattggcaagaatttatcatatttgaccctgaataagaagcatttgaaaatattggagaagaaaaaatgcaactttgcagcctcagtgtgccactgaaacaggtggtactaaagggttttcagctacccccagagtactgtgggaggagaggcgccctcccaggagcagggtgtagcggtaatcctctgactaataatcttcctgcgggttgagactggctgagaaaggtaggtggcagttgcctccaggaaacacagatactatcttcaagagatggaggatgctcagcagaccggccaagaacaaacacggtctttccctgacgaggatttcctatgccccactactactgcctcagagaaaacaagcatgtagtgcttactgccaaccacagaaaatgttttgtggttaagagtcagtttccaagtatgtttattggtttaaaaaattgacttcgtttcagccacatttggttgtctgttatcatttgtcgtaggctctctcctgatttggtttccattgggttttaatcagaaccgtcttctgaaacgttttagattcaaagcagagtttaaaacaaacacatctctcagagaacctagacgaaatccaaaatggaacagaaagtaaacaagaaataatgaaataacattataaacagcatggtaacagagggaagctgggaaaggctgtgcagaaacaagagcccctcagagaaggagccaaaccagacaggcatgtcagggagccgctgtcacacagcagggtctgggttgggggtcttccatttctgaccagcatgtggggctggaaactatggctggcggccccaccccctcctgagctgggatagagggctgtcttatggacagatgcaattcactttattccaaagatggctccagaaaagtcctgtctaccctctccatccctttcctcttctgtgtccttttctcactcttccttcccggagtcctggctcccatgtgtacttgtgaagcaagggtctatgcacacatccagcatgtgtgagaagtgcattagggcacagcgataataggggtcacccttctatccacaccagcccccctgtgctgtagacgtttcagccatatgggtcataggttagaaaatgttgggggaactacatctttagctccacattgctgaatgtttttcctagctgttatgctttatttgttgatttgatttaggaaatgcatgacaggttaaaagatattttccacaaagtgtaaaaaggtatacagagaagagtacctctccttcctgctcctgtcctctactccctcctcagaggctgcttcatatataccttaccttttcagcggtctccagtgcttatcattgtttgtttttaaaaattattatgggctggatgcggtggcttgcgcctgtaatcccagcattttgggaggccaaggtgggcagatcatgtgagcccaggaattcaagaccagcctgggcaacatggcaagaccccgtttcaactaaaaatacaaaaattagccatgtgtggtggcatgcgcctgtagttccagctcctcggaaggctgtagcaggagaatcccttgaacccaggaggcaggggttacagtgagctggacggcaccactgcactccagcctgggcgacagagtgagactctgtctcaaaataaataaataaataaaagtcattatgatgtctttcctttcttgtttcattgctggagctactggatgtaccagctatgctctttcagtatctgttttctccatatcccttcctctctcagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaaggtgagcagaagcctgagtctcccgctgattggctgcttgcttaaaggctaggtcaagctctaggaaatttctgacaagtaactctgtgttgttttgttttgtttcctgccttgccaagacgggaaagcccctgttggaggaagagattcagcattttttgtgccagtaccctgaggcgacagaaggcttctctgaagggtttttcgccaagtggtggcgctgctttcctgagcggtggttcccatttccttatccatggtgagtgtgaaaagggccgggcacagtggctcatgcctgtgatcccagcactttgggaggccgaggcaggcagatcacttgagcctaggagttgcagaccagcctggccaacatggcaaaaccccatctctactaaaaatacaaaaattagccaggtatggtggtgcatgcctgtaatcccagctactctggaggctgaggcatgagaatcacttgaacctgggaggtggaggttgccatgagctgagatcgcgccattgccctccagcttgggtgacagagtgagactgtgtctcaaaaaaatgggggggctatgggggcacttagcgtgcgagtaggaaaggggcagaccagaaatacctgcaaaacagtaatagctatcactgagccactaccacaggcccaacactttacaaatccaatgctgggatcccactgataaaccagtgatgagagataaaagggatggatgaagaggtgtgtcagaaggaggggtgccaccatgggggggacagcaagtttgtctaatagagtcataatttatttcgaagtatgcatttagcattttatgtagaatggggcctcatgcagggggctgaagagagagtgcaaataatagaaggagaattgcattttttggcacttgtttctgccaggcagtgtggcttggtgcttagtgtctgtgtctcactggggacactgataataactctggaaagtaggaatgattgttgtcattcttcagatcagacaagtggggatcagtagctaggcgtggtggctcatgcctataatcccaacactttgggagtctgaggcgggttgatcacttgggcccgggagttggagaccagcccaggcaacatagggagaccccatctctacaaaaaatatccaagctacttgggaggctgaggtgggaggatggcttgagcctgggaggttgaagctgcagtaagccatgatcataccactgcactccagcctgggcgacaaagtgagaccctgtttcaaaaaaaaaaaaggttgggggagggggaaagaaagaaagaaaaatgggaaacagagagattaagtaacttgcctaaggttacccagccaggatcgaaaccccagtttgtcctgctgttccttcctgtgccctgcggaagacatggttcattccttgtggttaaggttgctgtctagtaagaaaagaaagccagtttccatcttagaactgtttcgaaagaattaaaatgactttttcaggctttttgttaatttcttaatgcttctatctttctttaaatgtgctgtttgtttgcgtgctagagtgcccagttgaacaagctgagcaggcttccccctgcgtctccctgtgcctcagaagaagggtcatgctttttgtcccttcctccttctctcttctccccttcccccgcctggcctgctgttacttcagtcttttccaagatagaatgaatagattatttctttccttccaatatatattgttttagctgcaatttagaaacactccacccacatactcaaatcatggctgtagagtttatgcctgtgtgtgtacacattatagttcattgactctgtgcaactattcttcagggacctagtacttaagatactgtactcatatttttccctctttacccaccgcccacagttttcccacccttacttggctctctcttagtcatgggctggcttgaccagtttaattactttttttctgtttcatacttctacaggaggagacctctgaacagatcacaaatgttacgtgagctttttcctgttttcactcacctgccatttccaaaagatgcctctttaaacaagtgctcctttcttcacccagaacctgttgtggggagtaaggtaggaaattttgagaggacttggtctagaattttctttatttgggacctggactgatgtcataaccaaggccttccctgcatattggcttagagggttacagggtgaattgaggggacacccacacagtctagttctcccctcctgctgctagccaggagacttgcaggggcccaccttgtcatgaaggcaggtttccagaaaatctagttaccttgcaaatctgcctcctgcccttaacacctgaggcaaactacttttctatattaaaagaagtgaaatcttaaaatttgaaggacttgagggtgcaattagtctggctttcctaccttaaattagaaagtaggcaagcagccatgatcggtggtcgctcacgcctgtaatccagcacttggggaggctgaggcaagaggattgcttgagcctaggagtttcagaccagcctgggcaatatagggagaccctatctctattttttcaaaaaaagaaaagaaagctataaggtaatagtatgtggatgaatagaataactgctccattttgtggataaggaaactgagtcccagagagattaagtgagttgcccaaggacacaccctttaccctctcacccccaggatggtttttgccagaaataaacaattaagagatttcaggtagagaacttgaaaggcaaaaagtgtgggagcctgggaaggatttgataggcaggcagcccagctggggtagaaaagcccactctgcccccatcatttcccacttcagtctggggccaagtgctcagagccaaagttacctctctggggccagtggactgggagaagctgttctgcatttgtgtctgtttacttttctctgaattgctccttttgttgagtctcattcctaaggaaggtttttgagcctggatcggtttgggagaattaaaagcatgcattttccttcataaaaaaataaatttcccaaactatggccccctgccacctctggaccatggcttccacctcctgatactatcgcttggctccaaatttgctgaattgtgttaaaggaatttaaaagcctataaaaacaatcattttgtctagaagtaagaagttctgtctgccagcactggggtggagatgctgggctcttgcctcagattttaaagaagtttatcctgctgtcgccggctggaattccaggcccttgtatgatttcatcttcataaatataattctgggacacggctttatctttctcttggttttaccacttgaataccaaagttaatttctccagcgtgtgcaacaccaaggagcccagccaaaggagtaaatacagagttactcaaatgcttacgagagtcatgctgtggttctcgaggatgttttgggaagggcagtggccagacaggcaaaactcttgagaacccagtttcttagagaatctgtttccccaccctggcccaagctcccctttccccgcagccttgttaccccaccctgttgtccacatccctgggccctgggccctgggccctgttaaagtcacgtgtctgtgggcccagtgtccaaaggcagccttgggacagaattggggagctggttgttaagtggcactcggggagaaggtgagggcctccaaggcccacttcacccactccacggtgtggcctagggctggcctgtgccaccctcttgtctgtttcttcccatcctgggaatggatgaacatgaccctgcccacttcaggcctgtgtgaagaagggatacagccacttgttttggtccttctgagattgttttgaggactacagatgttaaggcttctgccaatattagtaccagtcaactgaaggctagctgaagacaccaggctgtccctgtcaccacattagccggtgaaatggctctggtgttgccatgaaaacattatgggcaaggcctgtggcagcagcagagagaacagggttggggacaggggaagatggggccaaaacccaagactctggaggccctgagtggtgaagagaaaaccaagacatggcccagggagtcagacttctggctcccactttatatgggcatataaagggtttctctgaagggcaagagataggaggaagagatgagagaagaggccctaggggttttctgtcatcatcaaggtaaggagaaatgtcccagcaagacccatctctctctttatccctattccttgccctggtcccagccccaccccagggttcacagctccttccctggcacatagcaggttgcatttaatgcctgttgctggcagtatcatgccctcagaggggcagtagttacctgtgcaggtgcatatgctgattgtctccttagttttcaaaatcagaggccagtcttagtgtcattagtttttaatcggtagcatggcatatctgctcccctgggtcttgccaggcagtgtaaacttaaacttgctgctgtacaattcttatcagggccctggtagtaagaaataacattccatggaagagtgcccaaaggatatgctgattatctatttatctaaaaagttttcatcaaaccagaatctcagaatgttgtatacttcagccaccatgtgctggtttctgctggaactacctttgttaaattgcaattaggtatttttctttggcttactttgaagctgtggctaaaaatagttgcaaattacaaagctcatgcaggatctactctggggctctcgttgagggtattgcccactaaatcacacagtgcctctttaggagaacccatagaagagattttactctggtcttagtaccaagagatgccattcttaggagaaagtagtttgtttttgtcttttggacataattgcaaatttttgttattggttctatttcctctttgcttatgctaggaaactcagagccatatgtgaaagcatttttatttactaaaccccctggttttatttcgttttctttgccttccttttcctcccctcctcattctttcctccagatgcataagatgcctgacctatttatcattggcagcggtgaggccatgttgcagctcatccctcccttccagtgccgaagacattgtcagtctgtggccatgccaatagagccaggggatatcggtatgtagggccccaggagggcagggtcaatggatctttttagtttttaactcaaaagctattttaagaatcacatactgccttcacaaaagttttatttagtagaatcaaaaataacattctcctgttaacaggctcaatatttatgcttagaaatgaaacaacttaatgagaaaacatagcagaaagaaatggcttgtacatacaacatatagaatgcgtgtgtctattgatcatagaaacttcaagttaggaaggattctggaaaatatttagaccaatccctcgttttatagatgaaaaggttgagacccagagaggagaggtgaccaccccaaggccccactgtcagtcgagcagagcgtcaggtcttaagtgcctgcttgaacacagtcaagccaggagagggacaatcaaggactacaggaatatatacccattttgcaaataaaacaataccaagcagtatataagggcaatggtcacacaaggaaatgttaccttctgtgtggctgccacagccaagtcacagcctcacattgatgactcacccttgaccctggctcagtgtttgcccaaatgtgacttgtcctgtgccttatatcctaattaaaaatctgttccaaagaaacaggtttgaatccactgctgtcagtagcaatctgtttgacagccgagttttcttggaagaagcaaataaatcagcgagtgtcaccattgacctccttgcttttcctgcctcacaaaacctaggcaagacctggagtctctggcagagcccagactggttttccaattgatttcttttaattttacccattcagaagacccccaagcccctagaaaccttgcatctcatatgagggtaggaattggactgcaagctatgccaagtcttaatttaggttacataacttttatttcaattcagaaatgaaaaataaaaataaggtacaaatcaagcattaactaataatggagcacagctggcctggctcttgggaaacttcctacaaaaacgaggattcttgtatggaaatcgttctgaatctttttcctgtaatggagtgactcttaacacaagagatgactattgcgaaaatctctctggcatatttaggtttggagcatgtggttgtgcttgaacaagtttctgttttatattttacaaatgcctaacaattcagacaactacagaaacaccttagttatctgaattccagacttccggctcccacgagcaaccggaataccaattacagaattagggaaaaattaaaaaaaaaaaagtctggcagtgatcaagaaagcttgagcatcaaatgctggtacagatagtccagattagcctaacatccggtgcatgatacctgctgtgctgtgcctggctggtttgttgactagaaagaaaggacccctatagttggcagtgtctataaaaggccagtcacatgacagaacacagagatggatggggactgaagagaagaagaagaggagagcaagtctgggagaagaatgggggcagggaggggtggggaagccagcgagcacctgaagcagtgacagaaatagacatgatggctgtcactgccacggttaacaatgaggacaggaaagcagaccctgaccaagaagaatcattcagtgttacaggacagatggcggttcctctaccttagggacccttaagaatggcaccatgacatgcaagttctatgatttttgacaaaatgtacattttcctgtggagatggaggggagaggggttccagatcaccagaaaaccttttgggggtcaggtacaacatctgcagtcactgtacaggatagtcattgcccatcatgaccaagtcaccaagtaaaagttgaattctactcagtgctcttcatttaaagatgagcagggcccatagtacgctagaataaatttcccatcaagagattttttttgtttaaaattttattttcttatggtaaaaacacttaacatgagatctaccctctcaacgaatttttaagtgtacaagacagcattgttaggggctgagcagggtagctcacacctataatcccagcactttgggaggccaaggcaggaggattgcttgagcccaggagttcaagaccagtctgggcaagatggtaggaccttgtatctacccaaaattacaaaattagccaggcgtggtggcacacgcctgtagttccagctactcaggaagctgagttgggaggatctcttgagcccaggaatttgaggctgcagtgagctatgactgcaccgctgcactccagcctgggcaatgaagcgagaccctgtctctaaaatcactgaattaaaaatttttaaagccatgcgcgatggctcacgcctgtaatcccagcacttggggaggtcaaggcgggcagatcacctgaggtcaggagttcgagaccagcctggccaagagatgatgaaaccccgtctctactaaaaatagaaaaaattagccaggcatggtggtgtgcacctgtaatcccagctactcgggaggctgaggcaggagaattgcttgaacctgggaggtggaggttgcagtgagccgagattgcgccattgcactccagcttgggcaacaagagtgaaactccgtctcaaaaaaaaaaagaaagaaaaaaagaatttttaaaagtattgtaaactataggcacaatgatgttcagcatcactggggattattgaaaggttgaagtttttaggtttaccttcatagcccactcaaatgataggtcagtgtttcctaaacgattcttcagattactcatgaccccacaggtgggaccagaaggcctttgaaaagacccttggcaagtagggtctcgagtcagtcgactttgggaaatgcctgtcttgttgatgcatagtacattattagtgtatcaaagatgttgaaaagccttggggaaacctagtgtttctcaggcttacttggccatggaacctattttctttggaatatcttacaggacactactgtttgccaaacccaatttgggcaatgctggtttaggtttaggttaatctggatgttctgtaatgaaaccacattatagatagacacaggaaaattggctagtaggtcttgtgtcccctcggaatccattctgtcttcttgctgtaaaagctgagacttgatgcccaacagcagcctcatctagagcatcctgcctttgtaagcctgctgaattgtgattcacagttccctgggtgaggggtggtgataaagcatttaaagaggactgataataactaggaatacttatgctaggaagtgccagaagactttcagagcaatttgtctttaagccaggtgtagtggcccacacctgtaatctcagcactctgggaggctgaggcaggaggatcacttgagcccaggagttcaagaccagcctgggcaatatagtgagacccctatctcttaaaaaataaaaaaggaaagaaaaagaaaaaaaaggaaactaaattaaatagaaaaagatttgtctttgactctgcagtgcaccctgagggccagctctggcagacctgccttgctcgtgcccacaggtgtgcccaccctctgacatttacatgccttcctcttgctatttcccctcaaggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtgcaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgcccagaagtcagctctctgaggagacaggctactttggccccagtttgaagcattctgtccaaatgtcctgagctctccagcagtcaagtagtgaatggataccatacttattatggttgatgaaaaaaggcagagcttatcctcaattttttttagggaagagaaggaataaaataaaagtggttcaagctgggcatggtggctcacacctgtaattgcagcactttgggaggctgaggcaggcagatcacttgaggtcaggagttcaagaccagcctggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactnnnnnnnnnnnnnnnnnnnncaagggaagggaggggaggggaggagaggagagcagattgggggggctcatgttctgagagaaaggaataatagcatttgtctagtacattccagtttacaaagtgcctgatatacatgatctcctttaatcttcacccaatcctgtaaagtaggtgttagatccccattttgcaagtaaataagtggaggcttagagcagttaaccgctggcaggtaggtagctggttccatagcacatcattttcctgcggcatcacggcatggtgccgaagaagacagctgtggatgtcgttgactcagatgtgcctccgttggggtgggagaacccagggatgggggtcagcaagccaggaactccgcagggtttgtttttaaaactctgctggacagaagtggaggaggaaagaatctaaccatatgacttttataaaaatcctttcacttttcccctccccatttgaaaactctttttaagagtgaatgtagctgaaacacaactgtgtccagccattttcctgtctccacattcttccagatgtgtgacagaggagggactctgctcaattccagttgtgggtccccttggagtttacatcacttgtttttcaattcttggttttctgttcccttctaccaaaacccagcataggactcagtgtacacttactttaaaacaaaaactcacatttcttagctgcaggtgatggcctcagtcattttaatacagcctggaatgagtttgcttattacccagtcactttcgtagtgaatgttcaaaccccaaagcaaatgtttgcatctccttgtccataaaggagaaagccaggttataggagaaagagagagaaaggcgcatgtctgtttgcacagagagaggcaattttgtctacctttcgagaatcagttataaacagaagggcctcttaggattttgagctctcctgacaatgaaggaaaagctctcttgagtatacaagttccacactcattacctttcagtggtgacccatcacccactacaatttgttgaaggaagggagtgtcagagatatgctttaaagttgtactttaggctgaaattctctctgtatttggacctgcagatgttgtgtacagaaccgatgcatggcagggtcaggaagctaggagagtgaaggcgcttgtggagacagctctgtagcaaatgaaacacggaagcctccgggaatgtgtttgtgtcaccagcagcaggcatttccctgtcctccccacccccagtctccacatccccagcagcctcttccagaagcatgtcagggagacggacaggtgctctccttctcgtgcaccacatccaagtccacccaccgtggacgcagtgtgactaaatgctggccttgaagagaaaccctcagccagcttgtctgttgtccaggtccctcagtgtctctggtttccctgccctgcataatttaagcattagtgccaaatacatctgtcatattcctctccctggagactgcgaaatgtccagactttttcagactagtggagggaaggaatgttacataactaagtggaggcctggaactgtcaggatttgacagggctggaccagagacccttccgcctctgcctagtgtgtctgtcaggcaggcagcagccatcaatccaagaatgagccatggcggcaagcactgtgtggagaaaggaacccagccgaggtctgagtttcagacagaaactggggagttgggacatcttctctgtgccaggcttcattgacaccatcgctccccacagcagctccttggggcagggggctcacctgtgcagccacccttactcacagtagcatcccattcttcacactgcaaccccccagcactgtggacccttccagggaggtgacaggagccagcagacacatgacattcccagaaagccccatcttatccagacaggcttccctccatacttctttccacagttttaccctcagaaaaatgttggctgcagtcttcccttccttcacctccaccctggggaagggtcagtaaccaatgccgagggtcggggaaggaggagtcacaggcaagacagggactcagcgcagtgctcccgccatcatcggggacaggtgccagggtcagctgcagctctccttccgggagcagggtgtggtggccctggatggtcccagggagcagagggaggcaggcagctgtcacagccacagcggctctgaatggcttgagcttttagtatgtgttcaagtgcaggatactacaaactggtaaagacttccaccatgtgaagaatgtatgtaaattaaagtttattgtaatgaaggtttttactttttgcaattaaaagtgttggttgataagaactttcctcttgttggtgtcattctttaatttccagttttctcttgtttccccttctcccatgacatgagagacttctagccatatcttgctcatgaggccggcctgtggggctcctctgtgcccgcctggctttggtctctaccatttgcacccagcactgtccttgcattcacagcctccactttctccgcaccccagacgttacccacagcggcttctcatctgctattcccatgaattctcaaatctcagtccccctgttaataccctcccctgtctgtgcacttcacccagaatgcaggtgagcccctggacgcctttttttttctcaccagcttgctgcacacagcccagatgccctcccagtgatgcctcacccacggcgtccttggttctcgcaggacggccaggcatgtgtgcgggactccaggccccttgctggctcaccccagctgcccccagatgacaggctgctctcagcacttagttaactcggtggatttcagtcagacatttttgtgtgtgttcattttttagccattatatatatatatactttcatataaatgcataaatatgaccattttttatatgctgttaagtgtcctcctgtttaatttttctctgttacttgctgccccttcctcttccccatgttaccccaccccttttcctagtcaggtaactgtgatatatacacagccatactctgccgtgtatttttccataatttcctccatgctctctaatcataaacaaggttttgttactgctttaccgaaaatgggatcatattacaggccctttctttgtcctgcttttcttactcaactcctcacagagttctcttcaggtcagctggtagggctccagtcccttcttcttgatggttaatactccgtggcgtgggtgtgctgtcatttattctgctgttgtcttattgatggtaagtcacatcctgttaaatgattagtcgggctataagtcaagaagtctggagtccactttaaaatacttgtttttacaaaatgtccattcttgtttgttccaaccctaatatattttattcaggaataagatatattattcctttccacaattctgttcatttacctgcttgaaaactggaattcagccctccccaaaaacggggcggggggtaagggcttgattccctgttaaaacatgatgagatagcctgttttcagtccccttctttctccaccccactatagcatttgatactgacttgtggagaacccgtccctccctcccttggcctctgtggtactcactaccccttcctggacctcttcttcctactctgtctcctttgtaggatcgtcctcttctgcctgtctctgaaattttggtctctcctatggttctgcctgcagtttctccctgggatatctcaactccatgcttcaccctccagccatgggcagatcacctccagtctatgctcagcccacacctctcacttgagcagtagccctgtgcatccacgtgatgggaggtcatctctgccaactccaaagcacctctacatcaccatgtccaaaaagtctatggcagccgcaaggggttcctctcctttttcttagcctctacttctgaccaggaccaagctcaggacaatcctgcctccttatcacatatcgagctccactgctgctgtctctgtctaagagcttgcttcactcttagactctgccagtaattacctcactggtttctcgccgcacattccccatcccaattcaccatccatgtagctgccctgatgtctggtcacctcccttccttgctcctcagtgactctccattgcccacaggagaagtcctggccaccactccagcctcatctcctttgcttccccttctcatctcctgtgcccctcctctactggaccatcctaattcctggaaacgtccaggctggggtttttgttgtttgttaatttttggagcagttctaggttcacagcaaaattgaatggaaagtacggcgagttcccatatatcccctgttcccgcatgtgcacagcctcccccactatcagcatccctaccagagtggtgcatttgttacagtcaatgaacctacgttgacaggtcattatcgcctgaagtctatagtttatattaggttcacttcactgttggtgttttacatcctatatgggtttggacaaatgtatgttgtcctgtgttatatgtctgccattatagtatcatacagagtagtttcactgccctaaaaatcctctatgctctatctgatcatccctctctccccactaacccctggcaaccacagatcttttactgtctccatagttttgccttttccagaatgttcaaatagttggaatcatacagcctgtagcctttttagactggcttcttccacttagtaataggcacataagtttcctcaacatcttttcatggctcaatagttcatttctttttagtgccaaataatagtccatggtctggatataccagaatttatgtatccatctactgaaggacatattgtttgcttcccaagttttggcaattgtaaataaagctactaaaaccattcatgcgcaggtttttgtgtggacagaagttttcagttcatataactaaatacaaaggagtacaataattggatcatatggtaagagtatgtttagctttttttttttttttttttttttttttttgagatggaatcttgctctgccacccaggctggagtgcagtggtgcaatctcagttcactgcaagctccacctcctgggttcacaccattctcctgcctcagccttctgagtagctgggactacaggcacccgccaccacgcccggctcattttttgtattttcagtagagacggggtttcaccgtgttagccaggatggtctcgctctcctgacctcatgatctgcccgcctcggcctcccaaagtgctgggattacaggtgtgagccaccgcacccggcctaagtatgtttagctttttatgaaaccattgaattgtcttccatagtggctgtaccattttacagtcctaccagcaatgagagttcctgttgctccacagcctcaccagcatgtgtcagtgttttggatttgggccattctaataggtttgtaacaccttactgctttaatttgcaattccctaatgacatacgatgttgaacatgttttcttatttaccatctatatatcatttttggtgaggattccagatcttttgctcattttttttttattatagtctggttggttgttttcttactattgagttttaagagttctgtggcttgtcttctcatttcttgacattgtcttttccagagcagaagtttttaatttcagcaaagtccagcttatcattggtttcttcatggatgatgcctttggtgttgtatctaaaaggtcacctctataaccaaggtcatctagggccttctcctgtgttaacttctaagagttttatacttttacattttatactcacatttagattcattctgagcgaatttttatggaaggtataaggtctatgtctagattcattttttgcatgttaatgtccagttgttctagcatattgcctttgctcctctgtcaaaaatcaacactttggctgggtgcggtggctcacacctgtaaccccagcactttgggaggccaaggcgggcagatcacgaagtcaggagtttgagaccagcctggccaacatggtgaaaccccatctctactaaaaatacaaaaattagctgggcatggtggcgggcacctggaatcccagctacccgggaggctgcagcaggagaggcatttgaacttgggaggtggaggttgcagtgagctgagatcgagccattgcactccagcctgggcaacatggcgagactccatctcaaaaaacaaaaaaaaaaaatcagtatctttatgtggatctgtttctaggctctctctctcgtggtcttttgatatatttgtctgttcttttgctgataggacgctgtctcgatcactatagctttatagtaaatattgaagtcagagtggtgtcagtcttctaccttgttcttcttcagtattaagttggatattctgagtcttttgcttcttcatttaaacattagaatccgtttattgatatccacaaaatagcttgtgtttgattttgattgggattgcattgaatccatagatcaaattgcatccaggcggttttaattagaagttataattcctagcccatgatgtttttgaaattcagtatgaatttttgcttagtttgaattccatcttattactgcacattcctgtgacatgacacatgtcctttaggctttcttactaaatcaaactgacaagcctctagacaccatgctgaagacagacatttcaccaatcttattttttcagaataatgactctattatttttttaaaaataatacattcttattataaagaactgaagacagtttgggtgatcttatggaaacctccactcagtgccaggtgcggtagcttacagctgtaatcccagtgctttgggaggccaaggggagagaccgagagtttgagacctacctgggcaacatagtaagaccctgtctgtacaaaaaaaaaaaaaaaaaaaaggaaaaatttaattagctgggtgtggtgacgcacacctgtagtcccagcctcagcctcatcgcttgaacccaggaggttgagactgcagtgagccatgattgcaacactgcactccagcccaggcaacagagcgagaccttgtctcttaaaaacaaaaaaccaaaaaccacccagagataactactaacattaggtgaacagcattctaggtatgtctaaggtatttctaggtagaatgctaaatagaaatgcttatattaaaatgctattttaaaaagaaaagttctgaatctaattttatgtgaatctaacaggagaaaaagaaactgaagtagatgtttcttccccacaaaaattagtagttcccaaaagatctccctgaagttaatattatgagaaacattaagaaactagaattgttcttaataaggtttcctttttagatggcataatccaaggctctaaagataaggaaatagcttgctctttctcctcaatttgtttattcctatattgattttgtttttaaagtctatgcatttccttctgctctgaaaccttaattctcaccacagtctttttttctttctttttgaaacaaagtctcactatgttgttctcaccagcctcaaagaatcctccagccttagtttctcaagtagctgggacttcattttattttatttttatttatttttttgaggtagaatctcactttgtcacctaggctggagtgcaatggcacaatctcagctcactgcagctctgcctcccgggtttgagcgattctcctgcctcagtctcctgagtagctgggattacaggcaaacaccatcgcacctggctaatttttgtatttttagtagagacggggtttcaccctgttggccaggctggtctcgaactcctgagctcaggtgatctgcccacctcagcctcccaaagtgctgggattacagatgtgagccaccccgcccggccttcattttatatttaaactgattttgtggctcaccaccagtatttttgccattgcttcttcatttctgagttgttatttttaaactcttgattgaagtccagccacagtggctcatgcctgtaatcccagcactttgggaggtctgggcgggcagatcatttaagttcaggagttcgagaccaacctggccaacatggcaaaaccccatctctataaaaaatacaaaaattagctgggcgtggaggcaggcgcctgtaatcccagctatttgggagactgaggcaggagaatagcttgaacccagaaggcggaggttgcaaagagcagagatcacaccactgcactccagcctgggcaacagagcgagattccgtctcaataaacaaacaaacaaacaaacaaactcttgattggctgaattgcaccgttaggaatgactcaggaatggctcatgagttctgtattttctgcgttagggaatgtttctgtggtctttatagttgtgcacaccttggctgaataaaatattcttgcatcacaccttcttttgctcagaatttggatatatttctccattgtcatctggtgttgactgttggtagggacaacactgaggccagccgaagagtcccatctaagaggataccctctaacgagatattcccttggctttttctttcttttttttctttcttttcttcctttctctttctctttttaaatctatatgtctgaatagttctttcttgttctttatcagtttttcctggaacaaagtgtgctttttagaggtgcaattctattcttcattctagggaagatgtcttgtattttcttgatgaatactttttctttttcatgtgttaggttttctgttttaaattctatttttattctttttttcattgtcttgatattttttatacctttcatagctatctctctttttaatgcatgtctcttttctcttcattcaccatgattatctcaggcctttccttgatatcagattgatttttagccatatctgttcattttcttgctatttctcatgtatgagttttgaagaagtgccgtcagtttctttccttgttatttcatctgtttcagctttgagtgcctactttcttgaattcatgttttttttacatttttctatagctgagactactactgggaattttttttcctgttccttggattacattttcttctggacttggctctcatcaatcacatgcatgttccttcctttcactgttttcctttcatatgtttgtgtatctgccatgtcatttcttttatatgttttgtacttctgcctctggccagacgttttgtttgcttctgtaaaatatgagtacattattaattccaaaagtatctgtagccactacttagatttaacaaatgttaacattttactgtattttaaaagcattgcttcatgcaacccatttagtacttgccatgaaacgcccccatctttactctgtt

SEQ ID NO: 1121 - DNA, 3591 bp, Homo sapiens
atgcttccagtacagctccagcacaatgattcccatgctgcagagggagaggacaacagctccagtaaacaaaaaggaatcattgtagtcaatcattttccagttctcagccgctcagttgtgatcaagggacacgtggtttccgaactgccagctcagaataggaaaataacttgggattttatattggaagacatggatcttgctgccaacgagatcagcatttatgacaaactttcagagactgttgatttggtgagacagaccggccatcagtgtggcatgtcagagaaggcaattgaaaaatttatcagacagctgctggaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcatccatcacattaggctgatgtccttgcccattgccaagaagtacatgtcagaaaataagggagttcctctgcatgggggtgatgaagacagaccctttccagactttgacccctggtggacaaacgactgtgagcagaatgagtcagagcccattcctgccaactgcactggctgtgcccagaaacacctgaaggtgatgctcctggaagacgccccaaggaaatttgagaggctccatccactggtgatcaagatgcataagatgcctgacctatttatcattggcagcggtgaggccatgttgcagctcatccctcccttccagtgccgaagacattgtcagtctgtggccatgccaatagagccaggggatatcggctatgtcgacaccacccactggaaggtctacgttatagccagaggggtccagcctttggtcatctgcgatggaaccgctttctcagaactgtaggaaatagaactgtgcacaggaacagcttccagagccgaaaaccaggttgaaaggggaaaaataaaaacaaaaacgatgaaactgctttctgggggttggttacttagttacctgccctttgcatgcatgtgtgaaccagctgtgagctgcaaggcagtggccagagcctcgccctcctgactcttcctgcaggtggctcaggaaggattcagcctggccacttggctaggactctgccagcacccatctgagactgacctcttccgggcctttggacactatgaccttgatgctgcccttcaggcaggaaacagggctggtgcctttcttcacctgcatggccagcttccttccctggcagtggagagggcagccaacaggttctaatgtcagagccatcctttaccaggtgggcctgcttgtccctgtcttgcctgccacatcactctactttttggaaggccatggctgattaaagaagttcttgtagtttcccaagcaaagtggaatctagaaacagtgaaaaaagttcagataactttgaattgcattcaagaagtacacttctttcccattgtccgtggctcttggagtctccgtgatgccaggctagagtctgattatataataattcaaaatggtaactcccaaggtaatgctttcttccatttcatcaggttcttttatccccactgcaccccctccccttctcccttgcctatctggatggcttctcagaagctcggccctagtcctccctgccttggcggggccagagcccactactgctgaggcagcactgctctcgtcagctgtgttgcctttaccaagtgtcttcagagggttatgagttagagtagctggcctggggagagggtgcctccctgggtttgatctttagggtctgactttctgcagagaagatgttttacagatgtgtcaaagctgatgtaatgtggttgggggaggaaatccagacccaaagtgtttgtcagctgggtgtgcaactgcctatgtgatcctctgtcttaaaatgatttctgtctgtgctgcgaaacaaagacaaggtgaggtgtttttcttttttgtaataatataaagctgtgtgtttctgattggatgattcactatgtgcattgttttctcctaagtgcttttagtaggtagcaatcaaatggtgtaaataaggatgttcttttcctgttccttttatttttttctctctttattattcttttattgacaccactagatagctggccactggtcatgccattgccaagatgaagaaaaagcaaactacactttggcctctggttctgaattgcagaaatcaaaggatgcagtaggtgtctatgtcagaattatggatcagaggcagacaatgacgagtgaagatggttgtgaagccctcttcattcctggaggagcctgcatctcatctctcaggccctctttctctgtgggtctcatgaacagcagtggggaccattgagcacttgaatggcctgtttgtctatgggcttgcaaaggacaagcagagttcacagagctcaggatagaaacatcagagcctcctccacgggcttcagtgaaactccgatgaactgtacctgagggaattttttcttaatcaaccccttgtgtggatgaatacaggaacaacaaaacttgtgtacgtatgaaagtcatgttgttaagcagttatgatttaagaggttttaagtcagagggatcatctggaggccggctttgtgcaagcttttacagccttctgcagtgtccttaccctggctgtacatggggaagggctatgtgtaaacaagtgctttagaggcctctgagagtttttaaaaatcagacccattaacaaaagagagggtttcttaggaacaaagcaactattttgattactgagatctctgttttgtttctgtgagttactctgtattcctttccccatttcactcttgcccttcacatcttaaatgtccataagaaacccttgcatgtgttggtattctgaggcatcccgtgggaaagtcccctaagtcccattttgtacttcaacaaaaaatgactgtagcagaagataagtggagacttttatggatatactactcattttacttaaaatctacccagttcagacttgaatgtaaacttgtattaggggaaaattctccaaagagggttttctacatacacagaagcagttcaacttctcaagttaattttgataagcagaatctactactggccagagcgacaggagtggctaggggttgccagccagtccctttctgatgatcaaggccctgcacagcaggatgccacaggatgcccctgccatctagctggaagcatcaaaagtccctctgtatgacccggtgtgggaaagagggttgtcaggatgagaaagtggggctgcagggtgacgataagaccacctaaccaactccccacctccaccaccacaataagaacaaaactgtagggctctaaagagagggggtggtttacaagtttattgagcatttactaggaagtgacatggcgatgacctctgtacatgagttaggttcactttcatgtggcctcccactacagagatgcgtatgc

SEQ ID NO: 1122 - protein, 322 aa, Homo sapiens
MLPVQLQHNDSHAAEGEDNSSSKQKGIIVVNHFPVLSRSVVIKGHVVSELPAQNRKITWDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKMHKMPDLFIIGSGEAMLQLIPPFQCRRHCQSVAMPIEPGDIGYVDTTHWKVYVIARGVQPLVICDGTAFSEL

SEQ ID NO: 1123 - DNA, 69090 bp, Mus musculus
  misc_feature (1)...(69090): n = A,T,C or G
atttttaactggtctgtaagacacagaaattggacatgataattgagcaccatgtggcattttcagacattggataatcaggctacatgggtgtgggctctccaaccttacccttcaagggactcactaacttttgccaagctgctgtccctgggtccttctattccccattgagggcaggctgcacaccgctaagcaaacacaggaaaaacgactttaacattgtgttgattggatttctttaattcttcgatcatgtggaacattctctgcgggttttccacaaagttccaatttctcaagattttagggtttctgcttcctgatggatgcctcctctccttgctctgtaaagttcattttctccgaagccttgttttctctgcaggcttctgcaattcagatttcttagcctccgagaggttagaccagctttgcccatttgtgtccctcataataatatgagaaggaaaatgccagtttcctctgcacacattcagttcctcatccacattggccatgacacatgtgtgcacctcactggtaccacggtgaaagagccttaataccatgccctgactttgttctatggttagtatgggcagcagctagtggtcatgtcaggaagctgctttgatgctagaagcacaaggggtgagggtggggctgtgtgtgtgcttatgttttatttattaagttatgctagtttgcttatttgtttattaaaagtttctctatgtcactttgtttgcttatttatttatttcttgtttatttaaagtctatgtggcttttttgtttatttacttatttaaagtatgtagcatttgcttatttatttatttcttatttatttaaagtctgtgaagctctatctatctatctatctatctatctatctatctatctatccatccatccatccatccatccatccatccatccatccatccatccatctatctatcgtctgtctctgtagctcaggctagagactcacactcactatcctcctgcctcagagtccccagtgctgggactgcaggcatatggcataaacaccctagatcattgtgagttgaaacccagtgaattcaaaactcaaaacaagatggaactcggtgtgggtgtccacaggaagcatctgctccaggcctgctctgaagctacggggagaagtcaagggtaacatcttctagagagaggaagcagtaagtggaggtgggaagggaagtcttcaggctctgtgttactgaggtggtgtctcaatggccgtcttaaggaatgcttgatctgttaatgaaggtaaagagctgtatgtgcccttgtatttgttaattcatgtacttgcatatgtgtatttcgctgtgtaagccctcacgtgtgtgtctgtatatgtatgtgtgtctttgtatagctctgtctctctgtctgtctctgtgtgtgtgtctgtgtatgtatgtgtgtctctgtgtatctctctgtgtgtctgtgagtgtgtgtgtgtctgaatgtgtgtgagtctgtctctgtgggtgggtgggtggtgtgtgtctgtgtacgtatgtgtgtctctctgtgtgtgtctttgtgtatctctgtgtgtgtttgtgtgtgtctgtgtctctgtttctatggcagttctgggtctcattccattagcgctgggccagtattacaaattgtaaaaccttggatagtgaagcaatgccatactggaggaaaacactgttagatggacttaattttgcctacatacattttccctttgaggttaatccaagtcttataatatatacaaatatatatatagatataaaatagcaatgcattaaattagaaagggtgagcagaatgcaggatgctgcgttcatcatatgatgctccagcttctttcctgaaggactgaagagggaagaaatgacatcagggcaatgggggaccaggccctgttgcaggcatctcccatcttaccgagcttggctctcgttgtgtgtttatgattacacgattcactggaaggcaaaggttcacagtgtctgaactgtaaggattcatgggggctgcagggtggggagacagccctgcccacaaggtgattacttctttcatggggagagttcactcagctcagttcccagattctgtgtttaaaaaacaaaaaaaagccaggcatagtgacaagaagagctttcactccagtgctggagaggcagaagctggcaatccctggcgtcagcttagccgatctggcgagttctaggcagtgagagaccctagcttgaaggaaaagaaactaaacaaggatggtaactggagaatgtcagctcaggtaaactctggggtccatgtgcatcatgaatatgcacacagggacacacacacactgaaaatgacattccctaggggcttagggtcatgatgctgttggccatggtggggctgtcctcaagtgtgttgtctgttttgtttacattgcttcccctgtagatataaagggttaaattttccagaagtatctattataggtgccttgtcttgggaagagagaagacataaataatagggccatagatagcctaatagatgtgtctgtggtatcgttagattcattgacgcctattaaagctctcccatgggcactggctctgacatacttataactgtgatccctgtctgccctcattttccacaaattatttgttaaaagatggcagatatctatctgcaatagatatggcccaacatgtacgcgggtctttggatatgaagaattagattatccaagaaaagagcaggcttgttgatgtaaactatcacttaagtaggtcaggacccgttgctgaaaactcatgggtatgtggaagaatgcgtacttgggagattccttactggctttcaagagactctcttcacttcccgtgtctattctttctagcctgtgatattctaggcatgaatcctcttattcttttttctttttgatctctcccagcctttctttttctaggtcaatctatttcttatcttcaagatagggctgatgataggcttagtggagggttgtatcaaaactgacaacctgagctccatcccagggactccatcttagttagggttttactgctgtgaacagacaccatgatcaaggcaagttttataaggacaacatttaactggggctggcttacaggttcagaggttcagtccattatcatcaaggtaggcacatggcagcatccaggcaggcatggtgcaggaggagctgagagttctacatcttcatctgaaggtagctagcagaatcctggcttctgggcagctaggatgagggtcttaaagcccatatccacagtgacatgcctactccaacaaggccacacccactccaacaaggccacaccctccagtagtgccactccctgggccaagcatatacaaaccaccattgcctctcatggtagaaggagagaactgactctgacctccacatatgttttgagcgagggagcacacacagttactgcaaataagtaactggatttaaaatattgtaagatagggcatttaaggactctgctatgtattgcctccatccaccctcttgcttttgatggtggctagacagaggctagtgctcagctttggggaataaccctacccacaatgcatgggtccagtttctatatctctcacggtgaacagtttacctctttccaaaacctcatttctatctgtgggcaagaatggtaactgagctcagagggtattgtgaaacagagcgattctgtcccatacctcagacatgtcacccacagtgacacacggcattattttgcattccctttgagcagaagccatgacggttgaagcactggacatgactcatgctaagatacagttggtatccagagctgagaaaccatggtaatgatgtaacttaatcaagagtctgttgcaggcagtgttctgttttattccttggtgggtcaggtgtttgtgaacatggtcaaatggtaatatttcaccaatggtggtaggaagaggctgcatagttcatgtgaggggatgtcaggaacagttctgtactgggatattatgggatgggagctcagacaggcaggctgtgagggtgagactggatttcagggtgcatggctcccaggctagaagggcttaattatcaaatcatgatttcccataaatctcgaggaccccggagatggttttagaatctgcttccccagaggttgatgctggatgtcttccaagctctctgagctttcagaaagcatggatggttgtttctcctcaccgatccttgtgtgacacagctggtcattctgtgggattttctgcctgtcaacacttcaccattcccgggtctttaagcaaacttaagtgtggtggattctctgtatgaataatggagtattttcatggacctcggcaatcacaaattggaaacaaacttgggccaagacccggattgttcagcgttcagtgaaatgtgcctaacaaagcagtcatctgttacagaaaaacatcgggttcacgaaaggtgtgtgagtgtgtgtgtgtgtttctgtgtgtgtgtgtctgtgtgtttaggtctctgtgtgtatctctgtgtgtctgtctgtttctgtctctctgtctcgggccctgtgtgtctctgtatgtgtacatgtgctatatgtgtatctgtctgtctgtccatccatctctgtctctgtgtgtatctgtctgtctacccatctctatgtctctctgtgtttcttctctctctctctctctctctctctctctctctctctctctctctctctctctattgtgtatgttcatccatctctctctattgtgtctctcattctctctgtgtgtgtctgtatgagtgtgtctgtctgtccatctctctgtctctgtgggtgtgtatgtgtgtctgtgtgaaaatctctctctctctctctaaggtggaggccagcagaagtcagtgtctgttcttctttaattgtgtcactggtcaggaagccccagggggactcacatctccacaagctcaggggtgggtttggggacatgtaccaccacacctggctttttatgcaagtactgagagcatccaaatgcagtcttgatgcttgcatggcaagcactctcccctcccccacacttctctatgtcaccctgaagtctttccctggaaatgtcagtaagcatctgaagtgtgaaggtttttcctttttgtttcttgaaactattttggatgatttctagtatccaaattcaatttctttttctttttttacttaaaattttttattagatattttctttatttacatttcaaatgttatcccctttcctggtttccctccaaaacccctatcccttccccgctccctctgctcaccaacctacccactcctgcttcctggccctggcattcccctacactggggcatagaaccttcacaggaccaagggcctctcctcccattcatgactgactaggccatcctctgctacatatgcagctagagacatgagtaccaccatgtgtactctttggttggtggtttagtccctgggagctctgggggtacaggttggttcatattgttcctcctatggggctgcaaaccccttcaactccttggatcctttctctagttccttcactggggaccctgtgctcagttcagtggttggctgagagcatccacttctatatttgtcaggcactggtagaacctctcaggagacagctagatcaggctcctgtcagcaagcacttgttggtatccacagtagtatctgggtttggtgactgtatatggggtggatccccaggtgggcagccaaattcaatttcttgaacatatatattcatttcgatattgtagtatacaatataatctagtgactcctttcccatttctgaactgttctttccttgactgttatcccaggaacaggaccaaaatgaagatgttcctgttgctgatattgttagtactcaagtaggattaaacacctgggtgtcaacacagcagaatctttgtcttctggggacagtttggttagaatttataggcagtttttaagatcataaaatggccttgggaggcagccagtagccacatcagactaccccaactttcctggagcaacagagcaaacacccccacacactggcacacattgatctaaagtactggcctttttatagcaatgcagaggcgtgaatattaaattactgggacgcatttttgccagattttgactgctgctgaattttgggttcagaggaaacccccatcctgccaagtcctgggactgaagggtgcaaagaatagccatatccatatctaaggctctgcagacagacagacgtctgagcaggcaggcaggcaggcaggcaggcaggcaggcaggcaggcaggatagtgggcaggcaagatggccaggtaacaggaaggcagccaggaagcagggacatcaaaagccaaggtcagtaaatctccccagggctggaggacccctgtgctcctgggccccactcagttctcatgttgcccaaccttcaggctcagttctcacctccctttgaagtgccaggactggccagtagggagaggctgatggatgtacagggctgtgtcttagggttccgacttgcaaagcaaatagtgaagctggtgtatgaggttgaactgggaacaaagttgtttgggtctgtggctggcttgtcttctagaagccaagttccgtgacacagggctcagaatctactcagctgttttttttaaaatctccctgaggcatgtgcgtatgtgtgtgttcctgtgtgtgtgtgagtgtttatatgtgtatgagtgtatgtatgcagtgtgtatctctgtgtatcatgtgtgtgtcatgcatgttgtagagtgtactgtagagtgtaagtgtgtgtgcaccagtgtgtttatgtgtgtatgtatgcagtgtgtatctttgtgtgtcatgtatgtgtcatgtatgtgtcatgaatgttgtagagtgtgtgtgctgtagagagtgtgtgtgcgtgtgagtgtttatgtgtgtatgtttgaggggcacttttggacttctatttagaacgaagtccatattttcccccctttgaagcatccatctgaaagcttcaatctttttagaacccttcctctcataaaacaaagcagcagagtggttggcttatattgctctcctcatttttatgcagtgctgacctggagaagaatgttctgaaagaagaaagggtgtacgcccttcttatcgctagcatttaaaggctttccccacttaaatcgatctcaattaactttgatttctttctttagaaaaccatgtgttgaaattctactttgccagatgtgagaggcttcctttccgatcacacacacttagctctcatttcagctgggctattcagttctcccccaccaatcctgtacctcatttatttccccaacggccttgtttacaagaatatcttactttatcttgagaataaagaaattttagttctttcgcttttgttgcttttcaagacctctttttttttttttttaatatgcagcctcccatcttgctagtcccttctgcgtaacctgtttttgccaatttctgatataaatcactatttattcatgagtcttctcatcagagagccaaaggtaacattacacagtatgttattcttcacaagccttgcttgagttcttgtacccagcaaggattgggggcagctgccagccttgctgtctgttttaagtatgcaaaccatctacatgaccatagtggggagatgggagacctgcccataaaaaaacattcaatgtgtattagctcagcttcagtagtttattgggctttaggggacctcttagatccatagctctgagattagagtccttaactcatgcatccaatggaacaggaaagactggcttataattcacactcccttacattaaggatgcccctgaaaccccagcttcctggcttgcaccttcacagcctgtgtgtgggtatggatgtgtagcataggtaggaagcccacagcactgtgtacttacttacctctggctttctggttgtcacagcacaccattgggtttctgtttaaactccagccatggtgttttccaaagtggcgcagagctgtcgcagactgaagccaagggcgagctttatctttgtgcagtatacttgctactgcattaagaggcaggcagcgagcacctttacctgcgccttaggcagtgactcagcacagtcagccaaggaagccagtgtattcaggaaacagaaattcttggtcctcagggatgaggtggagcagtgacatacacgtggaacgagccagggtggaggggaggtactcgtgagaagttgtggttttgatatgattggctggacttcatcttccatagggagctgtgtaaaactcccctgttgacagtgagcacatctactcacttcaggtccacctgaaaaatgagaacccggtgccagtgtggacacatttcccagtgagaccaagagatggcaaacaggtgtgacaacgcaccagtgcgcaccttcacaaagtccctagcttgtcctgaccagctttcccacagttagctcagctccaccgatcctggatcatgataagaaatgtttctgtggccattccgctccccccccccccattaaaaaataaatacctggggctgaggagatagctaagtggccaaagtgctattcatagactcatacagacctgacttcatatttctagcacccatgtaaaatccaggcacctataatccctgcactgtgaggcagagacaggagcattccggggtgctcactcacggaaatcaaactaactgtaagcccggggttcagaaagagtacctgcctcaaaattaagatgaagatccatttagaaagataccttccatcaacacacacacacacacacacacacacacacacacacacacacacacgcttgggaacctttgtccttctcattagttgataaccatgctgagcagacctaactatggaaacagacacagtctttacatgtggtcattatacaatgtgtcaaccaatcagttgagatttctaagccgagtctgcctttgctgatttgcgcatagtctctaagcagaatgtgggctcactacctgcttaggcagagaataatgtccccattgggacaattttctgttttcttctcacaaaataataaaaatattattggggggtgggttgtggaaagcgcacaagctagctctttacggatctagatcttttaaccatcccagtatttggaggcatctgggtagttcacagcctttttttttttttttttttttttttttgcttcatttaccatccagatgttcaccatcatggaagcgttgtttgaaaccctattcggctaataacgtagagtggaaaaaaacctcctttggtgtcgcggctcccttcactcttccgaggacctctacctcagaggctcctggagcacggggggtcccaccagatgcctaggtgtcagccttcacggttctttttctaatcccgtgattgttctgcgctcttgtctgcttgaattatagattgcatttgtcaaaaaatgacacatgcaattggatgtcttctaagacctttgaaattcaacttccttgtgttgagattaaagtgggtactctctgccccagcacagtccgggctagggtgctggaaacctgcagctaaacagttctaggttgggccactccaacttctgccgtgtgcaaggaggaaaacaaagaaactttgttttctgctttctgttgggaagtggaaaggcaggcctttgcagctatgtaaagtgtggctccctaaatgtaggaaatgactctcagcaccacgttgctgtcctctgggatgtcctgagtctgcgtttctgtttcttcgtccaggaggccttgtcagttgtgagcgaggaccagtcactatttgagtgtgcctacggaacgccacacctggctaagacagagatgaccgcatcctcttccagtgactatggccagacatccaagatgagtcccagagtccctcagcaggactggctgtctcaagccccagccagggtcaccatcaagatggagtgcaaccctagtcaggtgaatggttccaggtaagcaatgctgaccctgcctgtcctggacctctattcttcccatcggtagcttctttgctcagcttcaaggactctcagagagcaaggccagtaactgctaaaggggggcacttctaggaaaacttacactccagtggtttgggttgaagacaggctgcaaaaccagtaaagtatttaccaagaactgtctttgaagagcccactgctcaattctgtttcccaggtgtgggggctgggtgggagggggggcttggctcacatatggcagagctcatttctggggctttattgcctggaagagatggcgcggtcctatgtttctatggagacacagtatcagcgagtggccaggcagtgtagcatctgaccaagccacttgattttgcttatgggtccctcttgtatgtaaccacagcctcagcctgctatccctgctattgctgtccccttttaatgcacagcactctggtctccatttaagcatctcaaagctcccatagctgctgctgctgctgcttgagtttgccgtgggtgtgtggctggcacttgggatacttaccacagcatccttctcaattcaaagcctttcattacatagaagtttggaaagatgcgaaagggctagggagatcgctcagtgggtgaagcattggtcacttgagcacaaggacttaagttctaatcccatgaacctgcataacactaggaatagtagcatatgcctgtagtagttctcctgcagtgagaggggatgcaggcaccctggaagcctgtggtctagcttatttgagataaacattgtcaaactacaaaaaagaccctgtctcaaataagctgcaaggtaaaggtggacccttaaggttgtcctcagacttcctttatatatactgaggcataacatcctgagaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaagaggtgggtagtagcattcatttctatactattctgtatatacctaggggaatgaatgtagattccagagacaaagacaggatgatttattttaaacaacctacaatctccatttatatacaaggtcctaagaacattttccacttcttgtgcttcacgaatacaaagcccctttatacccagtagatcactgatccccggatcaccgctaaggggaatgcctgttcccatttgatggacgaggaaaccgctgagcaggcacgattggctggctagcccagacgccacttacaaggcctgggaatttggatggaaaccaagagtactgggctcgacatctcgcatgcttttcaccctgcagctatgagagggcctctttgttacacgtgtgtctcagtgctaaatatgtttaaagcctccctcgtgtttcataagtgctggaaatcattgcgtcagctgctagtgctgtgttaacacaggtgtcaatcacagcatttccaaggaactgtttagcggcatggtttctgggcttcatggggaagtgggcagtgctctactggcccgcaccttgagaaggtggtcgtctctgtgtgtctggcttcatgttttgtttgtttgcttgcttggttgctttttgtttgcagtttttttgagatccaggctgcccttggacgcaggatcttcctgcttctggattcttaaggcactgcgaatgtgggttgcaccaccacactaggaattgctggagaggatgcaggggttaggaatgcccatcatccactgagggcctccgcatttagaagctgaggactgggtgttgctcacctgcagatgagcagcaagaggagagcttagtgattggctgtgctgattccctgcatccttcaggtctgccaaggacttggcccatcaccatcagtggcttctcctaactgcctctaacctgggcttacatggcagtagtctccctatagtctctctcttcctcttcctctcttcctctccccacggagtagtcttcctgcagacacacacactatctctgtctgtctgtctgtctgtctgtacacacacacacacacacacacacacacacactttctgaagccaagttcaaaagctattgtaaatgacctgctgttgaagttgcttcatgagagatttgcattttatagccttgttctttccagagcaaggcaaacctctatccctgtggggcagagctttcttggtccgtctctatccatccattagtcactgcataggaaccagcagagtctgggcagtggtggcccaagcctttaatcccagcacttgagaggcagggggaggtgaatttctgagtttgaggccagcctggtctacagagtgagttcaaggacagccaaggctatacagaaaaactctgtcttgaagaaaaaaaaaaaaaggaaccagcagaggaagaaggaagaggaggggaggcaggagagaggggttctgctggacctcaggccctccatgctaacaagcttctgaaatgagactcaagtgtcagggtgagcagagtagccattcacatttttcctataaaacacaataaatggacggcagagagaaaggagctgttggtgtgggagccagtggggaagtccctgtgggcttggcttgtccatcaggatgctcgcagacagaagctattgttttttgagagggataatatgtcatttattcagtatagaagggtaactatgcttgtaatattacaataatatacaacaatattattattatgtttaataaagaatgagtagagaccaaagatttctaaagcaataaattggaaaatatttaagaaatgaaatatttaagaaaatggaaatactaattaccctggtacgattattgccctttatatatacatgtcacaagttatcatactgtgccccatacatgtgaataattattatgcatcaattaaaaataagagatgtctggtagttgtacaaatgtcaaccaccacgatccacacatggctgtatacatctacagctgtagatgttaaggatggaaggtgggcatcaggtgagaaaatactccatgttgacttcatacataataaatctagagtgatatttcttttttattagatattttctttatatacatttcaaatgctattccgaaagttccctataccctccccctgccctgctccactacccacccactcccacttcttgtccctggcattcccctgtactgggacatataaagtttgcaataccaaggggcctctcttctcaatgatggccgactaggccatcttctgctacatatgtagctagggaacaaaatacccatgaaaggagttacagagacaaagtttggagctaagatgaaaggatggactatccagagactaccccacccggggatccatcccataatcagccaccaaactcagatactattgcatatgccagcaagattttgctgaagggaccctgttatagctgtctcgtatgaggctatgccagtgcctagcaaatacagaagtggatgctcacagtcatctattggatggaacatggggcccccaatggagaagctagagaaagcacccaaggagctgaaggggtctgcaaccctataggtggaacaacaacagaagctaattttaagttgtcctgtagtcagtggccgtcatgacccagcctcagggtttagtgataaccctgtctctcccccttcttcactcagacctctctccgaggaacacccctggggtttgcacgacgggagtctggtggtgtacaaaactgaaacctgctgctagcactgtacacaagggaaccctggtgcaccaggctctcctgactgccagcctcccacaactccaatggcagtgggatagccatggttccctctaggctggccatggaggccagagatagtctaccctaaggcgtggccacaccaactgcctgccattgccaggtgctggggctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcgtgaaatctgtcctttctgagaaagacttgttcacttactatgattatttccaattatcttatttttctgcaaactacataattttactctttttatggattgaaaaatagcctgtgtatttatgtaccatatttcttgatgacgatccttcgtgtcttgcctaaggatccacagctactggtatttaatgagctggggtcccaagctggttgctctactcccaggtttgctctccaacctcttggagccatgaactcattaattctgtcagatgagtgtctccttgaggtggtgctctcaaagcgaggtcctgaagcaggacctgggggtcaggagctcaacctatggagatccccaggttctggtctaagtcttcacagcagttgaaggaacacggcagggcactctggttttctggtggctgagaggtagcattgggcatcgttgagggaggtgagaaacaaaaacccagtatctaggtacaggcccagtgagccgggtcagctcagcaagtagaggggggctgcgctggaggtgtgtctgtctgtctgcatggggtggcatcttctgtaactcaccccatggaccctgtgcttggcggagtcaaagaggtgaaagatgatgttccctgggccttgcctctcagtgcagcctgggaagaggaggggtgggacctgcctccctccagcctgtggttggatagtgacatgctttgggtgcaatagtttaaaatacttgtttatttaacttgataaagagttccatgtgtccaaaggcgagactgtgtggtgtcgctgagggtggacttgaactcctgctcttcctgcttctgcctttgaagaggctgggattacaggaagtgccaccacccccgatttatgaactactgggaactgaatctagcacctcaggcccgttaggcaagtaagctaccaactgagctacaccccctaccccacaatatgatacattaacagtgtgccccatgaagtgtggtgaaggtcatcgaatgaggagtgggtcacttggttggttggccctttgacctcagacatgatggtggcatacagtcactcgttcagctgagtttgttaagcacctactatatatacagtcactgttctaaaaatgtagcaatcaagattctttgctgctggctttctaaaggaagaaggtcaccatttgatcagctgacttgtcaaaatacacagcagcgcagatcagagcaaacactaaggtgaaaagtaaggcaattccaggcaagatggtccaaaaaggttacctcttagaaagtggaatttggttaaagacccaataacaaagaaagaactctctcgattacacagtggaggatatcccaggttaaaggaatgctctgtgcaaaggccctgtggtcaaccagagatattctctagggtcacaagagggcccacatgtagtgaccaggagggagggtagcagaaggtgagtttgcagaacatgcctgtgaagaccagcagcttcactgcagagccagcctggacgcttgcaggtgaaggagaactctgagttactcagagtccacaggtcttcctggtgcctgtgttgaggctgagaacctgatgcacatacagggctctggggtgtgcggtcctggggctctgcagaggagtagagtggtagaggtcagggagagacattgcgggctgtaaaaggaggtggcgtgctctgcaaccgggatgagctgtgtgaagcaggaaggaagccaggacaggatatagactacaaaccaagcacactgtggacagaccagagctcggaagcaccctgggctcacagcccaggttcctcttgggtgacagccttcacactgtgacttggctctgaccaataccagggaaaatgtcaggctctctgcctccattggtggagcagacctttacccattccaccagtgggtcatagcacagaggatttttgcaattgagagtttcctaggtatctgggaatggaggccaaaggatgctggtgtcaccaagtactgagcaagatggcattacccccttcaaaaatatctgactccacatgctcatggtgtataagtgggaccctgactttctgcaagttttgtcaacattactgttcctactggcacgaagatagagctataggagcatacagtctgtgaaggagaatgcagctcaggtggtctagaaggttgtagagtgtgggggtaaattctctctgttacttctgtctgtctgtctgtctgtctgactgactctctctatatctctgtctccctgtctgtctctgtctctgtttttctctgcctgtctctgtctctcccatgcacacagccctaagtgtgagccctacagttgcctaagaacatcaaggtggctataatcccagcactcaggaggcagaggcagttggatcaggagttcaagaccagcctaagctacatggtagagctgagatccacctgggctacatgagaccctgcctaaaacatgcagttaacaatgacaaaaaatatctccaaagattggcagcaggtgttctaaacctagagaatgcctaggacccatgatgacaaagcttaaatgtgagatctgctgcatggcattgggagagagcttagaagttattttaggatagaggatgtccagtttcctcagtaagactacaagagggcgtgattacaactagactcatgcttttctgatgaagttctttgactttctgaaggttgtatagccagcttaagctcgcctaccataggcagcttgtccccagcctcacatctccctctctgggcctcccctcatagggggacattttctttgctgccagagacatcagggtccctggagagtgttgtatgcctctcctctccctgatctcatgtcttcttgtgttggaggctaacagatgctaacaggcactgcacctaaaagtcttaaatgtgacaaggagcccccaggtgggccctttacagtggccttcagtggatactcactgaacttgaaatcaagcttcaaagtcctgtgtcaggtgcacactctttacagtttctgtgtgtcactgtgttagaatcagtgctttgtgtacctatgtgcaaccaactcttgttgaacacttgaagctatccgcaggcctggcttctctttcagcttgggtttgctattcatatgcttcttgtacttggcgagcgttgggcatgatctgggggcagtgatattcctgggcacttgctcccttctgcctcagggctccgacatgaattggcaagcaagttgcctcctaattgagctctgctgccctccagactgtggctgtgctgggagactttccaatgagtccgcttgggtgtctatgacagaaatacccaagataggttggcttataagcagcataagtatattcctcttattcccagaggttgagaaacccagcaccgggtcaccgaccgatttggtgtctggtgagcacctgcttcctgatcactgagggtagcttcctgctgcgtgcttgcatgactgaggagcaaattctatctgtctcttctgtctgtctgtctctatccctgtctcgttatctccgtgtatctctgtgtctctgtcttttttctttctgtctctgtctgtctctgcctctctctgtctgtctttctctgtctctctgtctgcctctctctgtatctctgtctctctgtctgcctctgtctttctctgtgtgcctttctctgtagctctctttctctctgtctctgtctacctctgtctctgtctctctgtctctctctctgtctctctctctgctgtttgttaggaatgccagtgtgcagtgtgtaagcaccagaggttggtatcagatgtcttcctcagttgttttcttctttatgtactaaggctgagtctctcattgaacccggaacttgccagctaactcaaccagctacctagtctaccctggcagatcccctgtctctgccacacaagctctgggattttatgtaagtggccacacctacctatcttttatgtgggtgctggggatctgaatcttcgcataacaagcattttatccactgagacggccctgaattttcttaaagacccatcctgagatgaaggctctacccttgtatcctagcattctcccaacgtctatctaatttcatcatattgggtttcttcatgttggctcagtgaggagctgccccgtgctggccatggcagggcctgataatctggctctttttactttcatggaccctatggcttggtaaaggtgagctcactgctgcaaaggtgatatatgtagacttgatgaacaaagcactgggtttggcaggacacggaggctctgctgtttctttctcacctgccttcctccattctcctcagcttcctgccatctttgttcctatgggcaccgttatgtaaaagaggggacacagggctgtgtcctcgctagggctgctgaaaggctgctgctaggggaaatgcctagctttggcatcttctgtcttgaaagtgaagtcctttcagttgatcagaatttacatattttaagatataaaaaatccaaagcttggggtgggagacagttcagaaaagtgctttggatgcagtctccagggcctgaagttggatccccagaatctctgtaaaagccgagcacacagcatagcgcacacctctaatctcatccctgggtcatgcagagacaggtaggacttgccttggtctccttagcaagatagcattgcctaatcggtgagctgtccgtcctagtgagagaccctgcctcaaaatacaagagagaagtagactgaggaatgacacccagtatcaacctctggcttccacattatgtacacacatgtacataatatcacacaaatagaaatacagaaacacaacacataaaccacacacactgcatatacatacacagaaatacacacatacacacacacagaggaatatacacagacatccatactacataaacagggagacacaggaagacacacaaacatacatacgacatacataaacacacagagacacatgtacaacatacataacacacagaggcatatacacatactcaaggaatacatacacacgcatacataccatacataacacacacagagacatacacatgtatacagggaatacacacaaacacacagacacatgcacactataaataatacatatacatacacaagaataaacacagacacactcatgcgcagacacactcacacagacacacacattcacacgcacagacacacacagatatacatacctacctacctacatacatacatatatacagacacacaatgcagacatacacacagacacatagatgcacacagacacacacagaaatacacacagatacatacagagagatgcacacatagatgcacacatgtatgcatgcacatatgcaaacacatgcaaacacgcagacatacacacagacacacacaaatgtatagacacacatgcacatgcacacacacagacatacagagatacacacaaatgtacagtcatgtgtgtacacacaaagacatatacacatacagacacacacaaatacacacatgtgtacacacatacatacacacatatgtacatacacacaaatatacatacccaaaaatggacatacacatatgtgtacgcatgcgcgcacttatacacacacacacacacacacacacagaaccccagaatgatttcagtgattactttctttcggaaaaatgtatttcaaacaaagctaaagaaactcaaaatggagatgctgtgtgtgaacttcgttgtggaactttagaagttgcattctgtagaatattctagtccccagtgagaatccctccacagagtttggatttccctctagtttccaagacccaaatgggcacagtcttgctgataaccattttcagctataaatagaggcatgtatttaaataattaaactcatcgggaaatgtcaagtcccttttgggagacaaagaatgaactgttgttgagttagcgattaattaattttgccttcagctgcttgagaaagggctaggaatagggttgttcagaagaggcagagatcccaggtgtaagagaatatttagccagagtaaaaataacacgcagctgagaagacagacatgtatagttcaggctgagcccggagtcgcacatgaatcacgccgagccccacccgctgctccgccgtgggctctgaagcagcttttccactgcatctgattcagaaataaaacaggcccacaaattacaccagagctggccagacaatccactccttgtctgaagccctaaaaataccttttgtggggacttgctttcattcacactgtgaaacctgggtagggtggtttggttgattaacagcactaggcaggggctttgggggaggttagactggattacactacagtgagatcggacctgagactcatcccagttacactccagtgggacccaggcctgagactcatcccagttacactccactgggatccggtcctgagatgcatcctcactcagcctgtcctgtttggagtaggggtgagagtggtgggccagtcatgacagtgacccttgttacctcttaggaaaaatctgaaaatcgagcttttctgtacctccatgaaactttattaaagtgtgtgggttctgaagattgaacctgggtccttgcaagcactttaccaactgaaccatctcctcagcccatcagcaccatgttcttcctatggtatcataacctaacagttgcagatggcgtttagagactgtgacatctaatagctagttataagcaggaagttgtgtgatggaaaacagaagagctactgaggtgcagtgaagaaccaggtgtcagcaacacaagcatacgtatgtacacacacatgaatacacatgtgcacacatgtatatatgcatatacacacatacatgcacacccatacatatatgcatacacatacacacgcacacatacatacatatgtacacatgtacatatgttacacatgtacacatacacatgtacatacatgtacaggtgtataaacatgtacacacacacatatatatatatattcatgtgtacacatatgcacatgcacacataacaatacacatgtacatatatatacctatatgcatgcatatacacgtatatacctgttcatgctgctgtgttaattttttacagtgtttgtcagtttttgcatttactttatatgtttcatctaagggaatcatcaccaaagcatcaaggtgatattcagtcctttttagaaatggttactcagtcaaagtcaaccacggatggtcaccactggttttctagttctcagacgagggcttcctaactttccacagttgtaagggaagcatcctggggttcacctggagagatttatcagaaattgatacagtcagtcattcaccagtttcaaagacactgagaaaatacaattctagagacggagaactggaagtgagtttggcaggttacagcagatgctaggtgaattagagcagagacttcagcactgaaggcagaggaaggagagagagcacaagaagagaagttgtaaggatgtacaatgtactcgagcatgtgtgtgcatgtgtatacatacacatgtgtgtgcgcgcacacatgtgtgcctgtgtacatgtgtgtgtgcatgcatgtatttgcatgcacatgtgcatgcatgtacatccttgtttgtgtgtgtgtgtgtgcatgtgcacatatgtgtaggacccctgcatgtaaatgcatgtcgaaaccagacatgcttcctcatgcttggacatcattctacaagcaccattcacttgattcattatttgaggcaggttgtctcactggcctggggctcacccactagcctaggctggctgagcagtgacccagggatctctccatctctacctctcctatgctggctttccacttaggttctgaggatcaagatccaattcttcatccttgtaaggcaagctctttacagactgaactatcctcagctcttagcatgtggtcattctggcatgtaaactaaaggggcttctccagtccagtctggcccactgaggacagggacactgatgtccccttgcccctgaggtgctgcctggtctggaaggctgcatgcatacttgtgggtgaaggaaagagagcagttacccagcccctgcttgctgggacagctgtggaggatacttatccctgtggctcagggaccagggcaggatggacctggcccacttgcctttgtctttgggaaggagaactctgatgtagcagcagcaaggacattttgaaagcacagctgtgggacagagaacaaagcaatggagagtctcctcactgtacagatttggtgagttgcctccacccacgaaaaacaaagatgcctcgggttcctgggttctaccttggctgacgccggactgtgtgtagggcccagtgtctcccctagctgtcccaaaggtagggtgaaccacaggatgaaggtggctagagaactcatgtttgaagacagtgacattcttgtatgaatgagggccattaacacccacagggtggtggcaggtgacacagaatggatgatggccgtgcttggtctggctcatggtcctggctctgccattttactgtgagagtgtcccatgatggaatctacccttctttaagcagacaccatgtgaggaaatagatggcagataccaaatttactttgtttttcaaataccaaaagaccttattttatatatcacagtgtgtttttctgggcttattacctcttcttaaaactctgcctcagttccacacaggtgcccccaatccagtcaacaaaataaaacgtcctgaccatcctgctcctctccaaaggggagaggttttggaaaatatccaatactggggaaagagagtctccggagaatccgcccaacagcgtctcatatgtgtggattcaccagtggagttgcggcatgtgctggtggagatcttagtttaggacctcaaataggagtttaaataacacttctaggatgggccttatagctttgggcaggtcatccagtctgtccctgctttatctgtgactctgctgtttactaggtaggttcctcagcacttggggacaggatacactcgcttggagaactgtgagactttgcttttgtgtcttagtcagggtttctattcctgcacaaacatcatgacccagaagcaggttggggaggaaagggtttattcagcttacacttccacattgctgttcatcactaaaggaagtcaggactggaactcaagcaggtcagaaagcaggagctgatgcagaggccatggagggatgttctttactggcttgcttccctggcttgctcagcctgctctcttatagaacctaagactaccaccccagagatggcaccacccacaaggggccctccccccttcatcactaattgagaaaatgccttacagctggatcgtggggcatttccccaactgaagctcctttctctgtgataactccagcttgtgtcaagttgacacacaaagccagccagtacacttttcaaaatttatttttaaatttatgtatatgtgtgtctttatgagtatgtgctttgtgtgtgtgctttgtgtgtgagtgtgtgtgtgtgtgtgtgtgtgtgtgtgtgtgtgcgtgtgcgtgctcatggaggccagaagagggtgtcaggcctccaggaactggagtaacatatgactatgatctgcctgatgcatgctacaaatgagctggggtcctctggaagaacagccaaggttcttaaccactaagccatctctcccagcgtctgtgaagtgttgaaagtaatacttactttcttgttttggtcctggtaagattactttttcttcaataaagtaatatctgaatagatgaccttgaaaaagacttcctttcttctggccctggtttgcatgtgtgcccctgttacacacagggtgtaccagggagtgatagatccctaggccagggcagcatttcaggctacagtgcaggctttaagctacaataacccgtggcccagggagttcttgttcacctcatattaagacgtttgtctttcaaagtagagtatcttcccttccccctgtgcaggtgtcccctgcaggaaaagcatatctgtgagttctggccactcaacttacattgcaacttctcctttagggcgccttcacccctcccccatcttattttatgtgtatagttattttgcactgtgtatatgcctgtgcactgcttgcgtgcccagcaccggaggaagctagtggacaccagatctcccaggactgaacttacagataacggtgagaagccgtgtatggggattgaacccggatcctatggaaaagcagccagtgtttttaacctctccagcctgtattctcttcagagtaaccttctcctctgtaagacgtcgacgatgtgtgatccgctgtagtgagggctttcccacgggtcagtgccaggtcttcctatgacatgctgtcacagacaagatgataatgagagcagacgtctccacccagtcagggtttgttgagaagccactccaggggaccacacgagaccttttctgtcagagttaagagttccattaatgaaaaacttgtaatagtcaaaatcactgcttcatcctgacttcctttgttaataactaagtgtaatagcataaaacatacatatttatttgtatctattcatatatttatatttataagataagtttgaaaatagagtctaatggcttcattttgctgtttgtttggtttttttttttatgatggaggatgggatttgaaacccattaacatgaattatgcctgcaggttataacatgaaaatcaaagcaacttagctaaaggctgcccattgctgcttgattgcttgtttcgagacacagtctcactatatagcccaggctgtcctcaaactcactatgtagctcaggctggccctcaaacttgtaatcttcctgtttcaacatctaccagccttggctttgactctgttttagttatatatagtttgggtgctgtcttagtcagggtttctattcctggacaaaacatcatgaccaagaagcaagttggggaggaaagggtttattcagcttacacttccacactgctgttatcaccaaagaacatcaagactggaactcaagcaggtcaggaagcaggagctgatgcagaagccatggagggatgttctttactggcttgcttcccctggcttgctcagcctgctctcttatagaacccaagactaccagcccagagatggtcccacccaaggggcctttcccccttgatcaataattgagaaaatgccttacagctggatctcatggaggcatttcctcaactgaagctcctttctctgtgataactccagcctgtgtcaagttgacacaaaaccagccagtacaggcacacaccagcaaatgcaacatgaggacccatctcatccagatttggtaagggggtctacttcacttcatagaaaaactcccagccgggctggtggcacatgcctttaatcccaggcaggcggatttctgagttcaaggccagccttgtctacaaagtgagttccaggacagccagggttatacagagaaaccctgtttcaaaaaaaccaaaaaaaaaaaaaaattcccataatccatggattatgcactcacacaacacacagacacagatacacacagacacacacacacatatatacagagacatgcagacacacagatatacatatatacactcacagacacagatacacacagatcattgacacagacacacagacactgacacagaaagccacacacacacacacacacacacacacacacttaggtgacaatgagaaaagaagtagtcaaacccccaaagccttatctctctgaccttcaactttcaggtgattaattcctttgctagataggaaaaaaaaactgttagtacctggtatacagtaggcactcagtaagtttcctatgtgaatgagacttcacagtcaatcccgatgccgctctcacaccctgggcaccacctactgttaaaaaagtttcctcccaaagaaccaagtccttcacttctctcccccaagaatctctctctttgagacacacaacaccaaagccttcacactgcactcggctgacagatttttccaaaggatcaggaaaccctgtctcaagtaaagatagtctgtggtttgatagtagggtgagtctcgtagagataaacattggaagccaggaaaatattatagcatcgagcagaaatcctgcatgtgtagacagctctggaaagacacaggccctgctccatgggaacatagacagtgactatctttacatcgcctctgtgttagtacagcggtgagcattctacgtgtagggctatatgttcccaggtagtggtaggacctcagccctgtgtaaccccagccattacatgctcagtagctcttgctgtcacttggcgccagcactgagctactctgtggtcctggaagcattagcaagtgatgctgggaagaagtctgtgtttcaagtccaatgggcctctctttgcagtgatgaccgactaggccatcttttgatacatatgcagctaaagacaagagctcccgggtactggttagttcatatttttgttccacctatagggttgcagttccctttagttccttgggtaatttctctagctcctccataaggggccgtgtgacccatccaatagctgactatgatcaggggaacaccagggccaaaaaggggcagtgggtgggtaggggattgggggggtgggtatgggggacctttgggatagcattgaaaatgtaaatgaggaaaatatctaataaaaaaaatgaaaaaaaaaaaaagaagtctgtgtttcaaagtacttggtgcgctaaaactcttccagggcaccgtgccctcagccagcccttcctgtccataattctgtcaaaacctatggatgagacatgaatttcaccatgccatttcagctccatcttgctcggaggatagccctgtctacctgcctaatgtggttttgctcttctcaaactcaaaggtcaagtccatagcaagcccgaagtcctgtgactctacaagttacctgccaagctgcagctaacaatgctttgagggaaacaaacaagggccctaggaaggtggaagcaaagttttcaacactggcgtgaaaacctaaagagtccatggatgtctaatgtttccaagagtgtggaaacacgtgtgttaggtagaacttgaaaagtgtttccaaaattctactacagataatgtaaccagcacacagaggtaccactgctgtggcaatccaaggttagccatctgtgtgggctagccaccaactgagaagacggcaacatatttctttgttctctgatgaagcttgattcgtctttgctaaaaaaaaaatatttatgtgttatgcatgcatgtgtatatgtgaatgcctggtctagcttttagtagtcagaaaagtgtataggatccattgaaactggagttacagatggttgtgagccaccatgtgggtggtgggagctgaacctgggttctctgcaggagcaataagggttgctaactgctgagccctctctgcatccacctaaattgttttctttacttggtgttaaactatgagacttgtatctctcaaatatcactttcatgcacacacacacacacacactttttcatagaaagatatctttgtcttattgcacatacagtggctgccttactaaagattcctgtggcctgttttcagggtcagtgggagcaactcatcccatccacaccgccattttcagtccctgtcttggttcactcaggtcgctggtctacactctttatctgcctctcttgcctcagctccacccctcaccttctctgccttcctgactgtgcccccatcaccaggagtccacagctctagatcctgtgtttggcacaagaataggaatccaatgggggactttgctggggtctccaacgcagcatccctccctgaaagcattgcttgaactgcatgagtcctagtgtctgctgctagctctgtttactgtcacccagcaagaatgaacaccagctctctgttttctgtgagtgttcacagacatctgtcacaggagtctggacatgacagtttcagaaggaattggcgagtgaaatagaagccagacagcagcttggcttcccactaagtgcttctcctaagcttggtttcagctgcagtgcaggctgttgagctgagcctgggcacagcatggtctcagatgtagtgcaggctgctggtctgggtatgggaacagcatggttttacactgtagtgcaggctgctgagctgaaacaccaggcccatgttactcatggttctgcagatgggacatccagggacaagatgctagacagctccatgtcagctaatctgctaggggctttctctttgggttgtaggtagctacatgctcacatggagggagtgaagcaagggaggagctctcttcctcttcctctttgtgtgtctcatccatgtgtgtgtgtgtgtgtgtgtgtgtgtgtgtgtgtgtgtgtgtgtgttgtacacattcgtgcatgtttctgtggatgccagaggtcagtgtctgctgcatttctcagtcactttccaccttatttttttaaggtgaggtctcttcctgaaccacagagctaactgatgggctaaagtttcttggaagctctaggaggatgggtgcacgtgctatcatgatggtttgttcatgtgcacacaccatcatgatggtctttccaggtgcacatgccatcaggctggtctttcttgatgcacacaccatcaggctggtcttacggtagattctgaggatccaactcaagtctttgtgtttgtttacataagcgatttactcactgagccaactccccagttctccatcttcctgccattactatctctaccctcatagcctgagctaaatatgattatccctctataccattatggggggcttattgcttcaacgtgaatttgggggaccacagcattctgacttttgtcctgcttcctgactttccccatgctgcctgtcattggacctctatatcacaagaccactgggccctgctctttgggcactgttctaacagaataaattgtctttttctcctgcaggaactcacctgatgagtgcagtgtgaacaaaggtgggaagatggtgggcagcccggatactgtggggatgagctacggcagctacatggaggagaagcatgtgccgcctcccaatatgaccacaaatgagcgcagagtgatcgtccctgcaggtcagaggtcttgagattttgttctggttaacaagccgtgcttcccaggaaagacagacagacagaccacttctgtcctttatgagtctctgtcagggacgatatacccagccttcctgttggagttgctctctgttctacccacatcactcagcccccatctacctcatggctctgtctcattgttttcttttcttccactccgtcttcctctcactggaacacaggtaccaaatgctctggtaaggcacacaagggccaaatgccctgaccagcccacatcagcactctctgggcgtgaaccaggggcaggtaggataaagaatgtccagctactggtcacactttttgtcagagtggtccaagttatgcatagcaaagctttcgtaagctccactgttccctgctctagataaacacatctttgtaaggagcaataatgaacgggatcaaaccccttcacctcccccaccccaacccaatagtatgatattttctcaggctgtgtcagcttctaaacaggaagttctgtgtgcagagactctggcaaaatatgggtctatcagatgtgtcggccagatggggtcccttcagggatgtcactacaagacttgatagacctcaaagatggcttgatgacatcagggcaccagggtcctcttttacagatgtgccttgttttgccacatatagcaaaacttcagaggacacaataatgacagtcccatgtaccaacaggctcaaactgctctagatatttattggaaggcatatagcatgtactcagaccacacatttggttttactcacagctgctgcactgtatactctgaggccaccttacttgccactgtgcctcagcaagggggaagttcccactgggtggaagctgaccccagtccacctttgtcattgctggctggacatgaactggaggacgtggaagcctaagggatgctgaccccagcccacctgttggccttcctctagaaaagtttcatttcttcacctgaggcaaagaaagtcttagtcatgtatgatagaggagcaagctgaacagagcctgcttgacaaacccatcttctccttgtagaatcaagatggctatcgctgctttgtagaaccgtgctgctttgggccgtcttgtatttctgaagtatcattaggatgctttaatatcatcaaagtcttcttaagagaggtcagacttgagtcttttctcagaggaaaatgaggcagagaattcgtctagtccaatcaggatgtcagcaggtcttacgcacaggcacccatccagtgctgcctggacagaccaaaggatgcatctgcagatggactccagctggcatgaggtagaggggtgtttcttcattctaaaggaagctttctttcagctgtaccctcttgggctggttgcttcatgccagggtaggcagttattcagttaatggtattggtaaaaagagagaggggtggatgattttgcaagttgtgagtttttcagttactggtcaaggtctaggtatgtgtgttcacacggatgaacacactcatgcgcatgcacgtgcacacacacacattcacacacatttgaatggtcatctggcagagccatgggatcgcaggactccaggtggtcagcagcagctgtatccatcccttcagcatcagcacaggttataacccacactccttacccagactcctttgcagtgtggagtattctactcacgttgaagccctcagaactgagtccagctggttcctggaacttggtggtggttagatgtagtgcctgcctggtaccaacagtgtggaacagaagctttagttgctctcaaggatttgctctttctgtcactacatactgaccttcatatctgagacagacagagagacagagagacagaaacagagacagacagacagagagagagtcaaaatggaggacctggtaactctatgcctaggtagaacctttggacttagagttcattttgaaaaattactccattaactttgactttgagatccaccgtcttcagttcactcagtagctaagaagcccagaaaatactcatgaggcatagtcataggcatgttcttgtgggtgtaaatgccatgttatatggatatatttacacttcttcctgtggcaacataaatttaagaaacattgtatatgtatagacatacacaaaaatgggacagcctcaacctttagagtagaggaataggtgtgtgatccaaaggaagtgcttaacagagaggaagcccagtgagtggtatgcatcataagtgtgtaaacatgaagggagcccagcatgtggtatgcatcacatgtgtgtaaacatgaagagagcccagtgtgtggtatgtgtcatacgtgtgtaagcatgaagggggaccagcacgtggtatgtgagattgtataccagtcagttcaacataaattgagatactgttagtaacaagctctcctctagtaaggatcctagtttagcctcaccaattttaagccatcttggaaaacctgcaatatcaaaatcatcaaaacaaagccctctttacaataaagtgctgaatagctcagatgatgtgttgtgtaaatcccagaatgatcatgtgtgcacaatggggaaagatcattcctcagcctcattggtgtcagctcagatttccatggtgacagatggcactgagcccaaaactagctgtgtcttcaattctgggcccctaacagcagcccaaacctagtaggtttgactcagatgtctgatctgcaaggtgttgccgagactgtgccgcagatccagatgtagaaacattggattcccagtacacatgaagccaatgttctaaccaatatcagcatcatgtgtctcacaagtgtctgccatcaaggacagtgtcctctgtgtgctggctgtgcctctctgagtctaaggctactatttagcttttggtggcatatactaaggtgtgctaatgggctgctaccaaggaaggcacacacattctccatcattttgaaaagttacaaactgatgaccaaatacaataggacttctggttttagcagttgatattatttttgaaagatttttctttttatttcctaaaaataggtgcaaaaatgttgcacttaaaaactatttcttccacattttagtttttgtttttttgtttttgtttttgttttaatttaacaatcatctcaaaccctttgatatcagcatctcagcgacctagtggccacacccgcgatcttcccttgctctgcgcattttaagcattacccaagttccatcctagtggacaaaggctcccgagagactgaattctttcttccctgcctctgattttccatggaggacatggaaaacctttgagttgtatctcagccagtccttcatgccggattacccaggaagtattcactgagcggccattgctcataggccactctcttaggagatgaccaaagaatgctgaggtcgggaagatccacccctgtgctatagatgtgtggcaggaaaacagacaaaatcttgaacttaggaatgatggacgttctgggattcctgagcaaggggggtcaaaataggtcatgaaagcttcattcatagctgctgcgatggctttccagcctgttccatctcccttggcctcctctatcttcctcagccattccctggcctctggcgtgctgctgtgtatgccctgcctgtgctgtttgggcagctgtgtatccttcctttctttgccaacaaactgtgctcccccttcaagacctctttacactgttcccgtctgcatgccgaactcggtagcaaattaatcccttttcttatgacacctgaccacctgtctcttaccccacacttatgttttactctgtattccctaaggcatgtatatgcttatttaaatagaaacaatagcatttgattctaaagcggaaatgagatgcttcgggcttgtgacccagactactggccaatcaaaactcagactgagtgaagttaaaaatacacagagaagactaaatgtatatgaggaaagagtgaacacgttccgatggcaggcttggccacaacgctgtagtcaagcctctactgtggctttgagcttcctggtagtcaagataaaaagtgtaattgggaggaaacgattaaagttgttttataggagaggtaagcttatctcagcacagaatcctaaaagcagtattcttggagactgtagagccggctgcctccctgcagccattgtggctgagcattgcaacagcacaagtcttctgacacattgtgaaaaggctgagtgagttacactagagtcagcccagggaagtcaccaacagacactggggactttggtggctacaccagacagggcttgtagttctcagagcagcagagtgctgactgataggcacctccccaaatatggcattgctgagctggctagggaaatgggcagaggaccaggagtagagtcccctattctgggctctgttagctggacagcatgttgttatcacaccagcatttgttattgatgaggctgtgtatgtgtagattacaagttgtgtgaagagcacatgataccaatgataattgccacgtagtggcaggaatcagaggatcatgggagttgcagggtgattggaaatctcagttcaatagctccctttaaacccaggaaaaaaatactcagaaagataaagacactgtcccagagtcagctgcacagctgaaaggggccagagccagtgtccagacctgcaaagaacccgcagttaagaagctataatcagtccttcacacagcactgggttagaattctggctttccacaacactttgtggagcatcttgggcaactcttggcatcaggagtcttctcggtagaatgagaacagtcagtgtttcctgcagtgtatcttggcagggacacatttcccccgaacgctgtgttctagtgcccggtcgtgcgtaagcagcagatgttagctgccatcatttgattttgtaaaacttcagtcttacatacaaccccacgtggtttcctcaaccaccatccagccataggttcacagataagatgaaccctgacttcagggtttcagttctcttgtttggtggttggcacagcaggagtccaacacaagcatacagaaacatgatgtgatgggcgaggtcaccaggagtgcttggtagggtgacaaagcaagatgaagattgtgtcagcagccattgtagcctcctaggtagggagaaggggcaaggtgagagggcagtgttaccctgtaagagaccacgttagaaaggaagctttctacataccttctgtttgagaaaaacagaactctgatgataaaacctcaaatttattttaaacaatgacaagaaataaagagaaataacattcaaatggccaacgcaggaggaggggatgaaagtaaaatgaaacagaccaatcttggggtggaacaatggctcacagcagtcgagcgcattggttgcttttggagaagacctaacctccattcccagcaccacatggcagctcacaactgcatatggctctaattccagggcagctcatgccctcttctggtctctgctagcactgcacatacccggtgatggcatatggaaggggtacctgtacacataaaatagttatgagaaaaatgaattaaattagatcctaggaaaatatgtggaaaaaagcaggcaaatcggggacaacaaaatctgaaaattagagggaatgataaaataactctcccaaagcagttatgtggtgtttataaaagcattttacacacacacacacacacacacacacacacacacacacacactctaaaataattaatagtaaacagctagaatgactatatattaatcaaaaactaataaaaatctgggaaaaaaagtaaaaataaaatattgacaaataagatttcagatagaaatcctttaggggatggcgtaagtttgtcatttaatactaaattcatataaaaggcataaggatgataaatttatattagcctagtaacatagcctcaaaaaataaataacaatgacgtaaatggtcaaatccatttcagtgagtgagtttgatttactctctctctccctccctctctccctctcccctctctctctctctctctctctctctctctgtgtgtgtgtgtgtgtgtgtgtgtgtgtgtgtgtaacaggtaatatatacttttaagcacccagagtcacatttacaaatattgccatggtctcaaaggccatcccaaaggtgagccaaccatcgtgttaaaaatcaatttataattgattgctctctagtcccaagaggacagattagagtaaaccacaaaccatcaattaaaagtttgaaagtttcagaaacatcttcgaggaagtccttctcttggagtcagaattcagtgtgtggcattgagcagttctgaagttcccgccatctcctgtgcctgctttgcaagtgggatctacccatatcaggaggccagatgttcagtcctgttttcttaggctagtcttagatacacattggctgacttgccccaggcctggctttgcgaacaaaactcttacactagtccttagatatggcctaagggtgacattttattttattgtatattccacatttttcatagccaagagtgcctttctattgggaagggacaatcattgataatttctcatcgattcaaatcaggttaatcttattcaattggaagtgtatgcccgttgaaggggctgtttcatgatagtgtatagtctgctattgacaacacagttcccttttccctaattccagtcactatctgttaatactcaactggatcagaatcttgtttcaggggactagaagggtctcccttttttatattcattaatgtattgcttagcagatggggggctctcaacagctagttgcctgaaggccagagggtgacttgaaggagtcatttctctgccagaactgtgtgggtcctggggatcaaactcggattgtcagtcttggctgccgatgtttttacccactgagtcatctaaccagatgcagcagagtgtttttatgactctctcctgcctttctcacacgcatttctcccacacatcgacattaagaataacatagcccaggaactctatatgatggtgtgcttagatgttttaatatccagttggataaagttgaggtcataaacatttggactacaagatacaggaaagagtggagagtctcgactccctctcctggtgcagctccttgctcttttgctgtccttggaaccataatgtcatgtctatttccaaaacagctctcctttccaggaggaggccgagcacatagtgtcttatcttatcaccattggctcatgttttgttgaacagaagcacctccgaaaagctcttaaaataagagataaatcaggcttttgtgtacaaaggaagaggcagccctggaaactaaatagattattcatcttagcagagttgactgtgcaaacctcttgtgcgggtgatttcttctctccggttgttactgttggccaagtgctttcacatactttatctcactaacttttcaagcccccacccccaccccgcagccgttcatttaattagccaaaggaaaataaggttaattccagagaaggtaacatttacacccagtcagagggggtagtcggagtccaaacacgcattgctccgactcccgagagagccttacactttcctcagtgagctctctgtgcttggtgtaattaaagacaccgctcaacgcctcaaaaattcctaatgactctgatattccacattgtaaagtctgacctccttactaaggtgcttactgttcccttccatgtgactccatctgccattgccgtccctcatctccattctccatctccatctaccatctccatacgccatctatatccaccgctcccatccctcgcctccatccctcacctccatcatctgccatgttcttctgcctcctccatctctatccctcacctttgtggcccatctgcgtgcccctccttcatctccagcctccatttccatcccctctttctttgggaaaacccgctgatgcttccctttgagccgaattagctctaagcagtacgtccgagtcagctatgctttatttcaaatgccctggttagtagtttgtgcaaatacggttactattttgttcttgagtgtctatgtgtgtacatatgtaggtatgtacttggaggccagagaacttctagaactcatcaaataggtcaggccaacttagcagtgagacctagggctctatcttcctctgcttctgcaactctgggcgttcacatgttccctactaggacttgatgaactcaggtcttcatgcaaagcagacactttacagactgagccatcgcctcagccctatttgtattctttttataatctataatgaacactctctcctttttttattctttgtatttattatttaattttatttttacttactcactttacatcctgctcactgcccccctcctgcccctcctgatgtcccctcccacaacccctccccctccccttttcctctgagcaggtaatattcccccaccctggcacttcaagtctctgcaaggctaggcacttcctctctcactgaggtcagacaaggcagcccggctagaagaacatatcccacatacaggaaatagcttttggagtaatcttcactctagtcattcaaggcccatacagagacaaagctgcgtatctgctacatatgtgtggggaggcttaggtccaaccctgtatgttcttaggttggtggatcagactctgagagccccaaggatccaggttaattgactctgttgttcttcctgtggagttcctactcccttcaggcctgcagtccttcctcctgttcatccataagagtccccaagctccatccactgtttggctgtgggtgtctgtatctgtctgagtcagctgctcagagcctctcagaggacaacttgcttctgtctgcaagaataacagaatatcattatcagcgttaggggttggtattggtgctcacccatgggatgggttgatgaaaagccttttaaatgttttataactttcctttatatacatggaccagtaagttttcaaggggtgacttttaatcttatacatttttttaaatgaatgaataaaagtggggaagaaaaaaaacagatgggaggagaaaaaaaacaaccaaccaacaacaacaaaacaaacaacaaaacaaacaacaaaaaaaaaaaccagatctctactagaaactgagccacagtggaagcagaccagattgtcttcaacctggatgatggagatctgtatgggcccggctcttttaggtcaccccccaggattctgtttgtcttgctgtgactcgctgagcttggcctcaggcttttgcagtctggagagggtgggggtgggaggttaggggggggtcctacgctggggctgactgggctgccctcagatttgcctttaggagttgatggcgtctgccttcctccccttttagatcctactctgtggagcacagaccatgtccgacagtggctggagtgggcggtgaaagaatatggcctcctcgatgtggacgtcttactatttcagaatatcgatgggaaggagctgtgcaagatgacaaaggatgacttccagcggctcacgccgagctacaatgccgacattcttctctcacatctccactacctcagagagagtaagtatagctgtcaccatggctgcagacccaacctcagtgggttcagacagggtggtcccgggatcctcttgtctgacctgagaggaccacacaggtcagtgtgtggaacttcatgaggtagatgaacaacgcagtctctcctgggttcctaagaccaggacgatggaacgtgggttcctaagaccaggacgatggaacatggcagagaagtggccaccttcactactttccatggtgcccaaattggaaggcagaaaggactccttcttgctggggatgtgcttagttaattctgctgagcggcacgaagcccctcctcccatccaacctgaccacagaaggggaggtttttttttccattttctatggagagaatgggtggtgcgttagtcagcagtggcgtgagcctgaaggactgctgcgtgatctaactctgacaactctgagcatggtctgaaaggatcccaactttaacagggtggcgcatctcccttgctgttgttgcctggcacccatacacttctctcctgtgtggggccatcccatttggtgtttaaggtatttcctatatcacagggtttagatggttctagcagcctcccctccccccgtgctatggcaggaggtgtatatattttcttcttttttccttttaattccattttttttttcaagacagggtttctctgtgtagccctggcagtcctggaactcactcagtagaccaggctggcctcgaactcagaaatcagcctgcctctgcctcctaagattaaaggcatgcgcgccaccactgctcggcccatttctctttctaggaagcttgttctccatctctttatctcagtgctgctctgtgtcttgttttgcagctccccttccacatctgacttccgatgacgttgataaggctttacaaaactctccacggttaatgcatgccagaaacacaggtaatgccagcccctctgatccccagggcatgcttaggttcctacctacaggtgcatgatttaaagtgaaactcacaggttaggggttagaacacagatgtgggagcgaagccattgggtacctgaacagttcccattatttccaccataaccccgtaggccgagaaaggattgtttttttaactatcattctgatcccccagcatgccccagtgcaccagcatcattgcctatggagaccaaaagctctctagtataaatggcctccagacctattgctctccattttccttcctaaagcaatgccttctgggactccttggtattttacagacagctctgggtgttggacttgccttggttttatattctgcacagatttgtatgtttgcaaagggcagtgggaggaatatatcacactttatataaacctgagggaaactcttctgccatttcggagaatacacagctggcccctggcccagcacctgccttcctgtctctaactacaggttctatctacacttgtgtctatcgtatgctcgagccttccagggctggacaaggcacttggtcctgattcaccttccctccatctctcagtgtatttggggttctctttgtataaacgtgttacctatgttccaagtacacatctacctcctgtcctgatggcctcactggtggatgcaaggccatttgctgatcacccactggattagccaaggaccacttcttgccacaccctaccagcccccagctagggatgaaagcatcaggggaggtggggaacctcttatcccttgcaagcaagcgagcccaaccactgcttgccctaactgagtaagatagccgcttaccagtcattctccttttacttttaaatgtccagcatcttatgaattgagcctcagtctgctcacttgtaataggtagctggtttaccttggtcttcagtattcaaaaccagtgtgcttttcttaaacgtgacgtgaggtgttctaagctcccccttctctatctgtatcgaacatatgaatatgctaatggtcttgtggccaaaattagcaaagaacttggtagaatcaacctgtctcaggaaacaccctagagcctcacaggctcttaacattgcatgcatttagaaattctttaacagtgactaaaaattccgcaaaagttcagagttcattgatttttaaaaaaattatagccaaatatagagacaatcaaaggacaaggatgataaatttctaaagggctgaatgtcaaagcggaaacctcctcatctggggaggtgaccattggttgaggaaaatacggagaatcgtgtatttgagtgggggggtggattgattttttaatacagtccatgtagtcttaggcaacgtgtgtacacctctttccaaaatctgttcaaatagtttgtgaatcatatacaattggcaataaatataataatatctgtgccacagataattttaaataaactaagattgccagtgggacacgggtggggctctgtcaagaagcccacaaagaaataataaataaacgcagcataatatttcgtgcatgagggagatgcactcctgtctgagcagagctcctgtttgccatgagctccactgaagtttcaaggcccccccaccccctgacatcacagggcgaggtgctgttgctcaagctgaaagtcaccacaaaggaccttcacactttgtctttccttttgtctgcagggggtgcagcttttattttcccaaatacttcagtatatcccgaagctacgcaaagaattacaactaggccaggtatgctaacaccctatgtgattgcttcattgagagactcccagatgccctgcttaggcccaggaccccagcccgtgaccccaggagcatgctctggacctgacaggcagtgcatatagccagtcttttccctggccctgtcaaagggcagttgagattcagagatgctgtattcagagtccacagcttggctcctctactgtggactatgaatacagcagaaatcagaaacagatcagggccttaagtagtagtttcaagtgtttgagccaatgcctaggataggaaccccttgcactctcagttaaggggaggattgatgagcagtctgtccttttgggtgagaaagcaattcccaaatcgctgatgactgattctcatcactacgcgagaagccatttttcagaggagaagcatctggcatataatatttacatcggcgtcatactttatgtcttttccgatgattgaattaggtaattaatctacatatcattcatgcaaaagtaaacatttacctaatgccaagcacagaattggcctctgggagtggaaagctgaaagctgaaccagactccaggcggtgtctgtctgcagaaagctcgcttgcacattccgctaggcttatgggttggttgagtgcctcgtctgggcctgacatgggggagccgcagcgagtggtaggaaggcttatcacgacattctaggagataattcagtagtattaacttggcgccagagacagccaaggacttgtcagtgtttcgtatgaagcagtaggagctggcagctgaggtccagaggcctgggtgtggacggagtcaggctcacatgaacacagtcaggaagcctctgggggactggcaagatcccagaggagaaatcaatgttttccagggagaggacactgaacagggtatatatcaccgtgacacaccatcccctcatggggaccgtgactgccctgtaggtcagaactcctcataccagcctgaacactggggaatcacagttccaggaagtgcactgcatttcccagactcctaccttggtccagcatgcatgcatgtcttccccagctgatgccacccctccttggctctttgcatggccagcttgcacgagtctaactgatctgatcccaggcttgggagctctttctttcaagggaggaagacacagtagggctaggagctggctgagtggtggccacagggtcacttcctggggctcttcatacctcacccctgctccaaagccaccagagtgatgtcaggctagtgatctcttctctgctctgagaaagctttgttcccagaaaccataagaaattgcccaaagtcctctaagtctcctctcatgttagagctcaataaagtaatggaccagacacagtctgtggcctaaactctttatcagcccccaaaacaccaccaggagctttaaggatgaggagcagaggcaccctcctgtccctgactccagggctttctgaacatgacacctacgtgtgtgtcttgtgccacatggggagcctctgaatgatggggcatgaatgatgttaggagtattttttttaaaaaaggcttctacccagagctaaaaataagtaaataaaagctccctgtggaacatttggcctttaagattaattagtcaatttagaaattacgtttgtttaaagccaccttgggaatgctgttggctgagtttcaaggccagggtgtgcgagccactgaggtaaacaggttggtgagacaggacaagggactctgtctgtagggctcacagggcggtgctgttactatcttggttcattttcttcaccaattaagaaattaaaaggcagggagcactacaggcagcagcagtgggggaagtctcccagcaaacaagaatcagcccacagagaatgacttttgtcagaggtgaggaaaaactcagcaaggcacagagagacagacagacctgctgcagagcaagcaaggaggcttcttagtctagtgacagagactggtgctcctgttccttgtgtgtcattatctgctccatctctctagcttagcactgtgcacagaggccagtaagcgcccagagctgaccctggagcaagccaggctcctaggtaattagtccatgtagactcccttccaatctcaccacagactccctgcaagaagaacccacaagacttccttacttcctgagattcaagatagccttctcatcctttctgtgggttacctctgtccacacttgccacacttggaatcttgctgccagatgcttcctcccccagtctcctgtccttctgcctcctgtcatctatttctgacatacaccccaatctttcccttttgagtgaccgacatctgcaagggattatttatccaagggctgtgtggctgtccttttggcatcagctcagggctaggcaaggctgtccagccctgtgaccttgcgggtcgtgacccatgaactcccccctcctgccttcccgccttgtccatcccttcccacacttggtactttgcttcccatggttctagagtgaggctgtagctgctgcttcttctcctctttgttgagtatcacatccttgtgctctgtggcttggttgtcattcttttaggatgttgcctgtgtttctcaggctctgtagttatcacccccaaacccttctccccaggtcctctgtacaaactattctctcctcccaagtcttcttttgaagccaccgacccttgaagtctcaggttaaagtgtcaagatcagagacaggcgctaaccacattaccttataaggcagcctatgaccttaggatatgctacccagactgtcagccctcttatgaggtggtcacaggaaatctagtctagtacctgggagacattatgcaggccattctgtccctcctccatgatagccatatagatcaatagagcctatagatcaatatacaccaagcatgttaccagaagtaatgggaacgtgtaacctctacacacagaatgtggacaaagctagtgccttttggggaattcttctgtggaaccctgaaaggtggtgctactgaacatgactgagccacgtgagcccacagctcctgcacaccccagtcaggtactatgtaaactgcaaaccttagcagttggcttgtcccaagttggagatttgtaagcatagttaaaatccccaaaccatcattgatctactaacacactctccatgtgtttgatataaagttaaagaaacattttgaatgatctggatgaagaagagaatgcagtttagttactctaaaatttcctttgtttcccagagctttatcagttggctctacactgtgactgccttcctactttgtctctttcattaacttcaagtgcatgagaggaggcctccattccttcccgttccctcccttcccccaagggatcaccaggaccaggtcctggtcctttaaaatgcaaatgactccgtggtggccactggagctggaaagacctgccagtgacctgaaccaagggagaaagtgatttagtagaacctaccccctcaccagggagagaggccaggtctggatgattctctggtgtcttaggaagagtgtgtagaaaggtctcatacagaatcagaaactggtcccagctcccagaaagttcacgaagctgttatgtgtggttgtctacaccagacgagctctgcctttgtacctccatgttgtttccattcggataatggcatataccatactcctatagccaccccaaactgcctgtgaggttgctttcatatggttcatgtttttttgtagtcattttcaacagctacaatagcagggtaaatgccagaaagtggccttcctgtgcaggaatttgtgacaaagatagctcaaaaggaatgaagtgggcattgaattgctcgccaaaattaaatgtaaactatgtaatttattaaaaaccctgtgcccttctatcaggatgagtagcaaagattcatgggtagtgatcggctaagcatccagggattgacatacgcatgtagcgctggctccgccaccaccccattgtccctcatccacagaaatgtccaaggtcagcatttcccaaggtcacctcccacaggagggggctttagtatcacagcgtgtgaccggtagctgataaggaaatgctggcatagactctcatgaaagcaaacaagaccggcgtatctaccgaggcagtgtgtttgtgaacatactaatcattgtccaggcaaacatcccaaatacttggctgaggactaggctcagtgtggtggatgtgatttccaagggagggtggaacatgattattcatctttccaaggattttatgaataaagagcttccaaacattagttctagtgtgctgtttagtgttttccccggtcacgctttatgacccatgcgtttctgggtgacagtcgacaaactcgtagctctctggttcttctgcctacgttcttccacctcaggcccagtaggtccctctagaaccttccataccagacagttacaaatttataggtatgtctacctagtctggctagcgttcctgaagtcattacctttgagatttcttatcagagtagtggaaatctttctgagatggccttttctgatggtagcatgtttgtgagtggcctgggaccctgtcaaaactcaggctttagtctctaagtccaggctaaaagcctgcattcccagccctcaagcgtgtctttagttgatgatccacagagcacactttgagaagcagggatacaggacacattcctgtgatactcccactttcatttggtaattgggcctttgctggtgtgtctatctacccctgcgccaggtaggaaacctcacctgctgacttttcctcctaaagtgatttctgtgatgaagctctggctaaccacttttgaaaaaatagatattattacactttatgtatttgggggtggataagtgtgtgtacacatggcacacaagtgcaggtcagaggacagcttagcagtgtgaccctctccttctaccattcaggtcccaggaatcaaactcaggtcataagacttggaagcaacccctttgcccactgagccatctcactgagttcttcccaacccccagttttagaaagaacactgcagcaggttgacgatctgttttcaaaaatgttcccagagatgtaagacagaatttagctgtaagttgatcacagttacagatttcattcccacatgccatcccaactctagagaagctgaaggccccagaatgcaaacaagcccccgagaggagttttaaaaaggaaaactgcctaactctccgaagcccaggagggtaggatttcacagaccacacgagttgtgatgctttcagccaaacagactgattgaattaagcctttctgtgttggatttcgtgctgtcctctttgggatgggaacattggaagggggtgcacactatgcagcaacatagtgggatcctttgaaagctgattcatcagattgcctgtttaaaataaggttaaatgatttgcttaaagagaggcccaaaataattgcacagctctgtcctccgagtgagaggtccacggccatctcccggtgtctgccatcccccggtgttggtagaagcaagcgtccttggagtgctgggctgcattggagacactgaactaagcccatcaaccaaggaagtcttgtttttaaactcatttaacattttgcttttgttctgaaaaagagtctcaccctgcagcccagactgatcttgaacatagggcaatcttcctgcctcagcctcccaagtgccagcatgcccaggtcttcttgagacagcatctcatgtaatccagaatagcctcaaatattctatgtaaccgaggaagactctgagctgattctcttgcctctacttcccaagtgttggcatcataggtgtgagccaccacgcctggatcccagttttgaaatggccctgttatagaattagacgtagcaagagcgctcatatattcatggttaataagagcgagaaagcaatgcttcagggatatatttatgaaagaagttgaagtggcgtaaatacttagttattggtgacagaacctacacagagcacagagctgcagtcactaagttttgcaaatgtgtgagagtccatagcacacgtgacagggtgcataaatacttagaaataattcatgcacttgcactcagggttgccgctgtgttataggacaaacatttcagaaagtcttggattttttatgcaattcattttagagagatactaaatcttcttagaaaatgagaaagaggggccttttgcctagaaaaacaactaggctaattaagaccgacaatataaatggatacgattatcaaggggaaatgaagagaagtccagggaagcagctcactgaaggataagaaagcagttctcatctctaagaggagtgcagaaaacaggagcatgaatgtcaccacccagttgggttggtgtgaccctaggcaagaatccatgccttcacgcccgtcatgggttctggcgtggacgagttctgaagatgctgaaagcgtagactccagtagtgagtcaggctgtgaaagaaaagctgtcctgtgatcttgatttctcgtcgtcgcaggaaaaggctttaggagagtcagcagaggggctggagagatggctcggctgctgaagtgcttgccatacaagcatggagacctgaatgatcccaagtttccatgtctgcacttggtgacacgtgcctcttcagctgagctaaatcagcgagccccagatgagccccaaatgacccagtgacaaaagcagtttcatacagcaaggtgaatggatgacagttgaggtcaatatccaatggtggcctctctagcctttacatgcatgcatagctacatatctgtaatatatgtgtaacacagacacacacatacacacacacacacaccacagaatcagcaagcaaggtctagaagaatctaccaatgagagtcttcagctaaatggaggagaggattttagaaaaatagaatatacaaatacatgaaatatgcaaattgcaatgtataggtaaaaacccaagctgatttttttattgctttttgaatttttattcagtatttattctgagaaacaaatccgtcatagaaagtaattggtttttagtccatgtatctgttttttacagatttaccttatgagcctcccaggagatcagcctggaccggccacagccacctcacccctcagtccaaaggtacaggctcagtccagccttgatctgcatgtcccaaggcaggggtcactatagccaggataaaatataatctcagtggttgatctgtggtctttccagcacatagagggctccttccattcatgatgaaacatatgcaatctttaagcatggcaagtctttttgtttgagatgcaacctacttttataaggaaaagaaatgaatgtaacggtaattctcattgtggacaaaggcggttccaggagatgtttacgtactgatgagctaattgctgatttcctttgctgtggctctgcttggctttacatcttccctggcacttccctgtacacccgtagcccatttcattctcctttgtaagctagctcaagtttctttttattatgtttagaagcaatggctacattagattgtttaaatcattggaaacattttaggatgcttatatttgatttcattagagggggcagtttcttcttactacaaatgcttcttgttgtagaataagattgctgtcttgacaattgattataaagtgaatgacatcgaagatgtgtggctcgatctgaattgctaattgtctttttttttttttttaattcttggatttttcagctgctcagccatctccctctgcagtgcccaaaactgaagaccagcgtcctcagttaggtgtgtttcagaaactgtcttgtgacacacacacacacacacacacacacacacaacggctacaggctcagacaggagtttctaaagtgtgtcccccttaaaataaacttcatatctgtcatgtatgtaaaatgaggtctagactagtagctgcttaattggaaggatttttaccaaaatcctgagattttactaaaacttctctaaagcctttaagttgaacatgggcaaaccactctttcattgaaggctgtgccctggggagctgtaaattcttttactttgactatccatggtatgcatcctaatgcctgtcaagtctgtcaagtctaaggtggaaagacagtgggatgctggctttgagcatcctggctcttatggccccaggttcaactttgccccagttagatcctgggttatagggactgtggttggtggtgggaatatcagacctcatgtttttctaccaactatgatgcttccagcaagaaactctcctgaggtcctgtgtgatatcttacctcatgcgggaggtaaaggcaggaatttgggggttaagagcatttttacctctgtgcacatagttctgtctggcaacctgactcatctttttctaccctagatccttaccagatcctgggaccgaccagtagccgccttgctaatccaggtgagttttgtggtctgctgctcgacagttacttttgaatctgggacagtttcagaaacttgtactggtgagaaacctctccaactgagaaacttggctttcagctctcatctcaccagactgttttatttgccttcatagaaagaatggatcaggttataggttaagatttgagtttaacctaattgaatttatagtgtttctctagggtcggtgcaacaaagtaacagcctgcgcttggcttagtaacttagtaactctgtgtattggctagctctggaggctggaaatctgaggccagcaggaggaggcttctgagttgtgggaaaggatctgctcacgcctttctccctggcttctggatgggcaaaagccggtgcttcctttattgtctttactctttgtgctgctatgtccagacgtgtgtgtgtctctgtgtctgtgtgtgtttgctcatgtaacccacagtccatctacaataccacactatgtatcccttttgtttataaagacaggctctctagtgcctggaattctgtagtctgagccacctgtccagtgagcccgggggacccacttgtctctgcctcatgacatgctggtgcttggctttttaaaatctaggttttgaagatcagattcagacatctcagacttttccagtcaactggaatatgggcctctttgatggaactagtctgttttggtcacctctgaaatacttgtctctaaaacaaggattcctaggagctactggagattcagctttcaatgtatgaattttaggggacaggacccaacctactaccaaggagattcaataactggtgttttaaagagataatctaatgaccatcagagtccagttgtggtctccaggaggatgtctctgagtcagatgcagggagaaaacaggctcttcgtacatacctgaccgagactcttcacctgtcctcacaaggcggtgggtgccagctagcttgctctgtgtgttagttttcagatcagaaccagctgtgctacactggcaggaatcccagggtgccgtggcatctgcttcatattctcagctgtaaatttgatgccaagatgtcacggccacgccgtaagaacaggctggaatttctgtctcacaaaccccaagccaaacagggcttggaagacagaaaacttcagatgctctcatcgtgtgcgtccccacgagagaatccacactcggagaatgtgaaataccgtcattgttgagcaaccgagcctgccatgaaattgtgattattgctgattaattcagtaaacatgttctgagcagcccggtaaatgaggaggctgttttcctacatcgctttagcccagtgcacatgctgggtaccagcaccttgttggcttgtcagttcatccctggggtgacatgatacagttcacccaggcacttgtcacctagtggagagaagggcacagcacacacaatactccacagcccgtggaatcactcagtggccaggacttccaagcagccccgctggtgcttctctcagtcgcccattggtaactgaggttgctgttctgatgcccattgtggctctgaggctctggagaccgtcccatgcacagagtgctcactgtgtgcttttaaggaccaagtttgaatccccaacactgcatcaaagataagtagaatgaatgtgtgtttcaagtcctcctggtgcaggaagggatgcagagatgggagaatccccaggagctcactaggacagcttggcataagtagctgtgaggaacagatgcctcagacaaagtgcaaggcaagatggacgcccgatatcatttctctcatttccacaggtgtgtctgcacatgtgcacatgtgagtgcacgcacatgcacacacatgaagattttgcatggctgcttttgcgtggtgataactaggctttggaaaagctggtctggcagtaacattcaggttcaattataaagacgcacttgaaggctccaggctctgggaagaccagcctaggctgtgaaatagcaaggtggaagcctccactccatgcagcaccactcagagagcatgtttatgcctgaggttccgccaggttttgcatggcccagaacattgttatttccgtcctctagaagaggagtcaggggccctgaggggtcaaggagctttccctgggtcacactccaacagaaaggagcctcagtctgggacctgtgttctcagaagtctgactttgtttcttttttctacacttctggaagatgagcttgaccaggaggagggaagctttgagaaacatgagccgtgggtacttttacttagttgtacagctgttgaggctggagggatgagcctgaggaagaggagggggaaagaggacaaggcttaagagcaagaagaggtagagaaagaaggaagaaaatcagcaagctgctttaggcaaactagaactcactgagagaatgaaaggggctggctctacatttcatggatcgatgagcaattcactaattgtaggctttttgttcactggaacctcatttcataaaacaagcactcaaagccataaatggccacatagatcctaacacagtaacagtgtaggacttccatactctgctctcgtgtttagatatttctcccaaactaaaaccaagtaaagacactgcaggattgaaatgtactaaggatgaactggagtgtgtgtgtgtgtgtgtgtgtgtgtgtgtgtgtgtgtgtgtgtaaaatagtggaaagggaacatgcatttgggttttttttcctgagaatcatatggaaacttcttcaaaaatctttttgtccatttttaatgaaaagactttcattatacaatattattttttttttaaatcctgtaagcagatgtgccatgtgaggtcatgggcaccatgtttatgtagacacccttaaaagccagaagaaggtgctcagtctccttgaactgaggttttaggtggctgtgagccatctcagcatggctgagggcgaacctgccaattcctttaactacccagtcacttaccaacacctgtcctgcatatgcatgcacaagctgatgtcagtacgtgggcatcccaacatctccactccaggtatgcatctgatgtgtgctttgaacacttagctctcctgctgagaaaggtgtgtcctggcatccctacctcatgaatcagtgaggagccactaggtcctctacattccatcagaatcgctgagctcctgggatggactccaagttccttcctgtggaacagccttccttgagttctgtccggtggccaggcattctgtaagatgcatccagctccttgcagagggacagagagccatttcagagaagatttgccagttgttaggacatgacatcttgttacgtttaggcgagtgcccagcagtttgtaagcccaagagaggatagcctaggaagaaccagcaggctgtggaggtatgtgtaggcacctggccagaagactggtctatgtcggacaaagaataccagcctgaagtttgacctttgttgaccttggcataaaggtccatccgatcccatgcccctgttttctaagcactccagtgagttaaacatgattttgcagggattaaccaccctgtcacatgtgagcattcagtcgtgcctagccccagtgaacttcagaatgaatgcccagccctgagaacaagcccggtccaagcatctacctggccagtgtggtggtcctggattgtcaactgcttctggctacttcctgcctgtcagtgagaaagactgactctgccgtcacagacaggccactgtgcttcctggtatctacatggcctcttcgaatccgaactccagtccttacatttgcaatgacaagaggttaaagccctgagctgtctcccagccacaatactgtctatttttactggtttggctggcgagcgactccccctccgaacccttagtatactttgtgtcagggttctaactctttattcccagtgcgccccaccacagcatgaacgttacagtccaggcggccgtgacaatttcataaatggcctttgaactattggcaaacagtagctcacttatcttactgattccccagtacccataccctcaaaatccttgagaactcttggctcagtgaggacatgtgtggcctcaatgacttaagagattgaccaactgctgctgtttagatagtgttttacctaagcatttgttggtttttacagcgactttcattttcacgtttggaggccagtggattttgcttttagagctcttctggggcttggcaggcttgccctgagccctgagccctgtgttttcctagctaataagtaaagtaaaacagcccagggcagtgtgagctcatctgtcctccaaactttgagctccctgccatgagtgtagggattgcatgttttctggctcttcagaagcaagggaagaagggagactccccccccctctcctgtctcccccccccccgcctccctcctacacatgctcataaggggacagactcccaaagatgatgccaatgtttgaacagataccaagtgttatttgttctgtgtatttgtacaaaatctgtagggtggctcgctcgccatgggcggaagcggacactaaatatttattttccagcaactgtccatgtttggagtgaggcatatgttagactgttaaatccaaaacccacagcttctcctattcccaggtcatctgtggaatccttttctcaagttttaatcctctggttacagtatatataccaaaaccatatggttctcttgttccgtcctttctattttccaatgcatattaatgagatgttggcggcaacagccctcgattgagaacggtttgtatgcgtagctctgcaacagcatgggccgccattccgacaagctacaagctgttaatacatcacaaatgtgtcgtttgactgaaaacaaccctttccgtaatatcatcaaaagacgctgacctttctcacggcgctgttagatgggcggatccacagacaaaacatgtccatgtagcctgcatagaaacaaggactgggcagtatacagaggggggcctggtgggaagggttcagagaaagcgaagtcataactgagttttacattccatcaattccctgaataagtggcagtcaaagttaatgtgatcattgatcatatctatcatattacttatcataacataaaagatgatcatctttctggtgatgagcccaaggcagtgtgcttccctggagtcttggaagagatctgcctcccactcactttaaaactaaaatgcatgccatataatgttgtttctcctagtacccaacatgactgtcactcagggcacaaacagtagacagaactaaagtgtccctctgtccatctggcctttagtatctggatatggagatgtgcttgtccagccaagggttgctctctggagaagtgtgaagcctggggcaaagcaaagcagcacaagagaagcctggtgcagagcctacctattccctgtacaaacccaagatcccttggaaccgtgtagcatggcggctagaatgataggcttagacttttctctgagaagacgtgagagtcagagacagggttcagtcagtcaggtgcttgtgttgcaaacactaggagctgagtttgaactccagagcctgagtcaaagagaagaaaacaaacaaaagaacaaatacaaagacgtaaccacaaagtatggttgtgaacagtgataaccctagtggtatgtgcaggcaggcaggtggatctcggcgctcaagggccaggcaacctaggctaatggtaaaccccaggccatcgagagagcctgtcttaaaaaacaaaatagggcaacataaccaaatttctttcttatctttacacgcatatatgtgtgtgcatgtacacacacacaattatacacatgtgtacacagatacacaagcacagatatccatacccacacatcaacatacatgaactagcacacatgtatatacacagacacacacccccacacactcgaacaagtatacacgtgtacacagatacacaagcacatatatccacaccttcacatcaacatacatgaactagcatacacatgtgtacacacacatacacacatacatgaacatgtatacacacttacacaagcacatatatccacacccacagacatctatgcacgtgtacacacacagagacacacattctctctctctctctctctctctctcacacacacacacacacacactgctcattctgactgagccagggtctctttgattccaaagagttccacccgtagcctgttgtcttttagaagcactgtggcacatgggtttctgtcatgttgcatttggcccaggattgggaatgggcgatcttagtttgaaacagagccagttctttttccaaacttcctcatttggagcgggttaattctgtcctaggaaaagtcctgacagagctgccatctgagcacccgccaggtcttatgttagaaacaacagtgtttacttccactctctatttgcttttccatagactcgtaggtgttcgtttcctaaatctgacttctgttatttcactttacccagccaatataaatggcggcaggccattattgccatccacagaatggccttttccacctcacaaaatggggggaaagtagctcgttcatccccctgaaaacagggtgacccaggcgctctttgaagaattccaaagtagaagaaacatgctgaactttgctctgggtgtgttctccctgtgtgtgtgtgtgcatggagaagttggttctatgaggccaatgtgtgagcaatcagggactgccatacaaggtcaagtgtcctagaagtggaggcagagataaggatccccaagtggtggctccttaagggtccattctcgggaggaagcagcactgggcaggaggaacactgaggagcctcccagccttcttgaagctgagccatcgtgtgccagcctggttcctaagcatctacggggtacaggcagcattcagaatcagcgtgtcctgtagtcccctttcgtcagtgtggcctggaatatctgggggtggagctcttcctgttcagccaaggattgctctctagataaacgaggagccaagagtcaaaagtcacaacagcccaggagcagagagatggggctggggttgaagaccagacctggtcaggaggtctatcattgaggactgaaccttctgtccttggttctgattggctttgtgtccctcctgatcattaggtagtggccagatccagctgtggcagttcctgctcgaactcctgtcagacagctccaactccaactgcatcacctgggaaggcaccaacggggagttcaagatgacagacccggacgaggtggctcggcgctggggggagaggaagagcaagcccaacatgaactatgacaagctcagccgcgccctccgctactactacgacaaaaacatcatgaccaaggtgcacgggaagcgctacgcctacaagtttgacttccacgggattgcccaggccctgcagccccaccctcctgagtcgtccctgtacaagtacccctccgacctgccatacatgggctcctatcacgcccacccccagaagatgaactttgtgtctccccaccctcccgctctcccagtcacatcttccagtttctttgcttccccgaacccatactggaattcaccgactgggggcatctacccgaacactaggctcccagccagccatatgccctctcacctgggcacctactactagagaccagatggaggcctttcccaacagtgtacaatcgcctagcagtcgccacaaactcagcgaacacaaatcaaaagtgcctcgtgaggagtggaaacggttggccagagctggggaaggaagctggggggggaaaaaaaaaccaaagactcgcaggggagggtgggtgccacccaagtattactacagaaatagaagaagctcaaaatatactgtacatggacatataacctgtggtccacccttgtcaaagacattgtatgtagaaaagcttgaccaaaaagaacaactgcccaaggaagtggccttaagtagtgtacaaactgtagagtgtgggaccttgcttgacctaccaggattgagtgaaagcaatagaacaggaacagacttggcctaacacaccatgtatgatgtcatttgaagggaaactacctgtgtttaaaaatagaaaccatgtcaaaaccaaagaagaagcagacaaaaacagagatggcgggcccctccacagaccacaatggctgtggactttcttggctggcatttgcttgttttctttgaaatcagattcgttccatttgatagagagctgccagctctgtcaaactgtgaagatgacccagggtctcatctccttttcagtattatgggaaatgtgagccatgtggtgggtgggggctgtgcatgttgttgggagtatgagattgtaggagagaagctgaaatggaggaagtagaggaagggctgggggagggagtgaaggaggagggaaaggagaagggggaaaggtggagggggagaggaatgtaatagcttcaaatcgctgacctgataccatgacctgaggacccatggcctgcagctgtggtctggaaccatggcctggagctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctgctcaagccaccacagctgaatttagggcaccttgggaccaaagggcatgagttgagagatgtttgatgctgtcagtgttgtaaggacacagatttgtggaggactgggagcagtagtattcagaaccaaaaatatgtctctttgtgaaaaggaaatcataactggaattgtctgatattttttaacaaaaattcagaacctcagcactcggtggaggcttttgtccttcccgggagcagtcgagaggtgaccttggtagccaccatggtcagagaccacacaggcattgtgggtaggtgggctccagttttccttaatgagtcgcgaacgctgtgcgttcgtcagaacgaagtctacaagtcaatgggttttttctttttatataataattatataacttatgcatttatacactacgagttgacctcggccagccaaagacacaccacacacaaacaaacacacacacacacacacacacacacacaagagacaatcaaaacatatgatgtggccttgaattttaactctgtaatgcttaatgtttacaatatgaagttactagttcttagaatgcagaatgtatgttaataaaatgagcttggcctctcacggcgaaccagaacggtggtagtctccgtttgtgcttctttgctgatgaacagttgtctagcagaaacttcgccgactcttaggggtttgtgttacagtcttagtttgtccaagaatgtgaacagatggccgtcatacagatgtactgttacccaagcacacaagcagaatgggcctcctgactcccacgagctccttgctctctcattttcacccaatatggaaagaacacaggtttctcctaagggcctccatgattgctctgagcaggtaaagagacctccacagctgaggctgtcactaaggagttctattctgcactggtcacccggcttattgtcatgatcatgcgattcttgatgagtgataaacaagccattgttaagccaaattttgtcatcatgatcggtacatcagtcgcagagaactgcagtttcttgttaaaaagcatcaggggagcccaggagatggctcagtgactgcagctcttgcttgcaagcatgaggacctgagactgatctctagacgctttgtaaaagtcaggtacagtggcccacccttgtaatcccatctcagcgaacggcagattcacagatccctggaactcactggccagttagcctagcgtgctctgtgaggttccaggacagtgggaaaccttgtctcaaaaaagttatttattctctgaccccttaggtcagacccataggcatgtgtgcacccacatacagaaatacatatacacgtgaatacacacgtgtgcacatgtgtgcatccactacatatgcacgcacgcgcacacatgcacacgctcacccacacatgcatatgcgcgtgtacacacacgcacacacatgtgtatacacacatacacacgcacacacgcacaaacacacgcatgcacagtaaagccctgaggtacagcttctgagcttaccactcctcattctgaggactcccccagcggatgctctggccttacaccctggagtcctcatttctggagtggccttcccagctctccttcatacacactttattgtctatgatctcacatcaatttttctagacatctcttgtcttcatgtcacaaaggctacccacctgggcctaggtgctatggcggtccaccttctgagagcagcaagccaaggcctgactcaagcctaagccagagtcaggtttttaaatgggctgtttcatgtcatagcagtttcaggactcggtttgcactttgtaatcccttcgctatgattcagtgcactcgccagtcccctgcgctgtgcattttggcaacagtctgtgaactccgtagggtgtgattaccaaagcttcaggcgacctcattgcaggatggagaggagtccagatgtcagtcattctgcagcagctgtgggaaggcccgttgatggtctgcatctccttaggagaaaagagagcagagcaccagtgttggctgctagggtagggatagagcagccatgtggtcctggggccaagccacgtggtcctgggatgggagagctacaggtcctggggggggggagccatttggtcctcaaggggagccatgtggtcctggggggagccatctggtggtggtgggagaagccatgtggttctgggatgggggagccacgtggtcctgaggggaaccatgtggtccttggggggaactacgtggtcctggaatggggagtcatgtggccctgggagggagtcatgtggtcgtgggagtaggagaagccatgtggttctgggatgaggaagccatatggtctagagggagccacatggtccagggggagccatgttctggggatagccatgtggtcctggggatagaggtgagatgagagatttagttttgctgtgcagagctgggagcacctacgttctttgtgtaatgtacaaattcatttgggtaatcactcaattccccacacccccttggagaccgcactgttagtgaaataatagaagcaagacacagcccttagattcaatcctaacatatgttctcagttaggtccctcacagccctcccctcagtcccctgcacacttgggctggtagcaatccccaggagtagcctgagaaactgcataattttgagataacacagtatttctggttctctggaataggtgagtcttcaacccaagttgaactaatggtcaaggtcaaggtctgggtctgtgctaatcagtctccaaggccttctatggggctttgctctatctcccctcccctcactgtctctccgtcttcttcgggatgtcccttgtatgaaggccaccttctggcaagccatgtcatcaaggacctttgggactctactggatgcgatccccagtctcaatcaagacttgactgaccctcatcccaccccatcgttgcatcttggaaggttccagatgacatcttgttgggctctgtgtccctttgagtacccatctaaatgactgacattgattcgcctaccccttggaagccagatcccaaagagcttggcctcgaggataggtgctgtgagcatggcggagttctgcaagctggggagggaactgtaaccattgaagcacagcagagctggggccaagataatgctgcagctgtgcaaagagcaaggtgagttctgtaaataccaggttagagaaataccacagactgtaagtgcggctggctggcagaggctggtcacccgggttgagggttatagtcttttcgtctggctgccatatgactgtgatggagccactatcctgctccctcactccgacaattagaatgaagccataaaacccaatccttccttccttaagctgattctgtcaagtggagccgtagctttgtggtaggacactggcctagcatgcacaggttctaggttccacacaaggctcacaggtaggtcagaaatgtgctgggatcccaccccaatacaaacacttagacatgagactagaaagcagcacatggagaggttgtgaaagacatgatgctggtaaaaactagagccagcagggaaggatccacatgtggaccagccacacagagccagcagggaacaatccacatgtggaccgggcacacagagccagcagggaaggatccacatgtggaccgggcacacagagccagcagggaacgatccacatgtggaccaggcacacagagccagcagggaacgatccacatgtggaccaggcacaaccatttctcctagtttttttatgtacttatttgtatttcatgtatatgggtgtttgcctctgtgtgtgtgtgtgtgtgtgtgtgtgtgtgtgtgtgtgtgtgtgtgtgtgtccatctgtccacagttcttgtggaagctggaaaagggttttcaatgcctggagctggagacagttgttagagactgtgtgagtaggagctgaaccctggcccttagcaagatcagggagtgctcatatcctaagctcatatatctctccacctcctctcctaattagctttagtggtgaccttgacactatctagagtcacctcagactctccagtaaaggactgcccagatcaaattagcctgtgggggtgtcttcgagaggttccttgattgttagttgatataggagagctcggaccactgtgactaccaccattcctggtcaggtggtcctgacctgtgtaagaaaaccagctaagcatgaacctacaagcaaggcagcaggcagtttggtttctgctgaactctggctatgagcgagttcccaggttgaagctgacgatgcattaagtaacaagtggtcccaacttcggttcctgcctggacttcctgccctgcccttcctggatgatgatggactgttctggaagtgtaagtcaggtaaaaccttccctccacaagctgcacttggtgagagcattgtaccagagcaacagaagggacactaaacatgtgtgtcctctgattacatgtgtgtttctaattcctatgaaacgtgcttttatgcttattgtatttgctctttttatttagaattttatgagtagtgtatctgctcaatttccactatatcctctgtccccctcatgcacacatgcacagacatatacacacacagacacacacatacacatatacacacacagacacacacatacacatagacacacacatacaggacacacacagacacacatgcacacacacagagacacatacacagacacacacagagacatacatgtgcgcgtgcgcgcacacacacacacacacacacacacacacacacgtgagcccatttacttttgttcatatgtacacgtgtttaaggctgactgcctggtcactggagaagctgaatctccccctctctcagcagccattgaccgcctgtagatgttcacctaggggtggggttttgtaaacttgctccatccctattggatgtccactggtatggtcactgtggaggtcgtgtttaggcagccatattgttgagacttcgtaggtgcagcatccctgtaatatttagaagacactctctcacagcagacattctggtcatctgtctcttacagtcttcctccacagtccctgggtgtgtgggttgtgttacagacataatcaagtgggggtagggtaggggatcatgatcagttttcctctgcgttttgattagttttagatttctatgggtggccttccatgggacaactgtgtaaaactgcttcacaggttaagccttctatctagatctcccaaggtcacagacaaactattgtatattgccaccgaacctccacactgatcaacttcatactgacctaaaaaccagtgcgaaggtcatctgggcgtgagatcacaggtgtcaaccaccctgggggctggcacagtccgtgacagtggtaacttgtgtgcgtggctgaaccaggaggcttagatattggaggcttcaggacgttcccaggtgtgtggtcagaagcaacacgtttatagggccactgtttataggacctctccctcattagaccgccaaaccttctccctcatagcaggaagcctgcctcctgtgacacccgtgcataacctcaaccattcggtgtgagggcacgggagagggaattgtcagtcacagcctgctcggcattagatatggctcagctaagagtgttagcctgcctcagggactcccagcccttctgcagactaaccgtttccacctcagagttggcagaggaggctgactgagagccagggcagccttcctatgtgggcttaggaggtggagaagagaggagtgcaggtcagaggttgtgtcctctggtatcttgacttgcaagctgtgacaggttgccaactttgtgtttcttgtatgaggtgtgtatgtgcctgtgtgcatatgcgcatgcatgtacgcatgagtgtgtgtgtgcgcgcgcgtgcgtgtgcacttgtgtgttcaggtgcatgtggagaccagatgttgatgtcaaaatgtctgtctcaatctcctctcaccttaactttttgtttgtttggttttttttttttttttttttttttttcccgagacagggtttctctgtatatccctggctgtcctggaactcactctgtagaccaggctggcctcgaactcagaaattcgcctgcctctgcctcctgagtgctgggattaaaggtgtgcacaaccacgcccggctcaccttaacttttgagacagcttattcactaaaccttttttggctagattagccagccagcatgctccaggatcgctctgcctctgcttcccagcatgcctcgccacctccacgcccccgcctctgcttccccttccctgagttacagatactctcctccatgcccagcatttcttctggctgctgggaatatgagctcaggacttatgccattgagtcatgtcttcagccctgatacaaacaacttttaagtaagtttaggtaatttctttccttcttggcagggctacagctgggaaggttggaggtgagtgggtggtaacttctaagccgtttcctgttaaggataaagggaaaagagaacgtgaggtgtccgctcctttcctgtggttccgggctctggaggttaggctgtggttctaggccatggttgcagactaaaggctcgagttcttggacaccattgcaagctatggacccaggccatggctcttagaccacagctccaggccatggttccagaccacagctgcaggccatgggtcctcaggtcatggtatcaggtcagcgatttgaagctactacatgaaaacgggttcagactgctggtactgtgggaagggctgacctatggtctaaggaatgtgagtcaggattccaggcccagaaagaaccttcttggtgggcatcatttccctcctctgaactttaagaccagttgttggtatttttttatgttaataagagagaaatggacaaaacatatatacgtgagtcttttaatttaacttgcacaataacactatgaaatattctcatctcctgtcttttatgtgtgaacttgaagctctgagactgattgttagaaatcagactacctcacatgagcaccttccgggttctgacggcctccctgggagagtcttcccaggctgtcaggctaggtgccctcccatgtcttggaattctggtcagaagcctgcctggtggtagccatcaacaggaaatgaaacacaaccctcccatttcccccatcccatcctccagtctcagcacacgacagcggctgccaggtggtgcctctgatacagagcacagagcacgctcgttgaaagcacagggttccagcagtcctagctgcttgtgcccgacatcagtgaagagactccgcacacatgggctgctcacttggtgtctccactgatctgcctttgtctctcagagatggaggccagctcccactgggaaggtcctgcctccaggtcaagctcccccactcctgtccatattcactatcaaccggggagtcagacagacaaatagacaaatacagctgcaataggagaaaccggttcacatgtagcagtgggatgatagcatcccagccctcattgatatgtttagccagacacggggcagaaagcagactcctagacagagacaggtatttcagagtaggtctcaccttctcctgtgggagaaagcctgcatgagagctttacgaaccctttctatgggaaacgtggctaatgaggattaacagttccgtacgcgacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatccccacatcccaccacatcccatccccacagcagaaaggaatgaaccagcgcacacatccctgatctcagctggctttttttttttttttttaccaaagtgtggacactttgccccttcctagaattgggaacaaaacacccatggaaggagttacagagacaaagtttggagctgagacaaaaggatggaccatctagagactgccgtatccagggatccatcccataatcagcctccaaacgatgacaccattgcatacactagcaagcatatgctgaaaggaccctgatatagctgtctcttgtgagactatacaggggcctagcaaacacagaagtggatgctcacagtcagctattggatggatcacagggcccccaatggaggagctagagaatgtatccaaggagctaaagggaactgcaaccctataggtgcaacaacattatgaactaaccagtaccccggagctcttgactctagctgcatatgtatcaaaagatggcctagtcggccatcagtggaaagagatgcccattggacatgcaaactttatatgccccagtacaggggaatgccagggccaaaaagtgggagcgggttggtaggggcatgggggggagggtatggggaacttttgggatagcattggaaatgtaattgaggaaaatacctaataaaaatatttttaaaaaaagtcaggatttacatgagtcgtcttcctgtgttttaaatgtgctatgcaaaagggattagtcaacatctctgcaaagaagcaagccctgagcagcactggccaatggcacggtggggggg

SEQ ID NO: 1124 - DNA, 1297 bp, Mus musculus
ggaggccttgtcagttgtgagcgaggaccagtcactatttgagtgtgcctacggaacgccacacctggctaagacagagatgaccgcatcctcttccagtgactatggccagacatccaagatgagtcccagagtccctcagcaggactggctgtctcaagccccagccagggtcaccatcaagatggagtgcaaccctagtcaggtgaatggttccaggaactcacctgatgagtgcagtgtgaacaaaggtgggaagatggtgggcagcccggatactgtggggatgagctacggcagctacatggaggagaagcatgtgccgcctcccaatatgaccacaaatgagcgcagagtgatcgtccctgcagatcctactctgtggagcacagaccatgtccgacagtggctggagtgggcggtgaaagaatatggcctcctcgatgtggacgtcttactatttcagaatatcgatgggaaggagctgtgcaagatgacaaaggatgacttccagcggctcacgccgagctacaatgccgacattcttctctcacatctccactacctcagagagactccccttccacatctgacttccgatgacgttgataaggctttacaaaactctccacggttaatgcatgccagaaacacagggggtgcagcttttattttcccaaatacttcagtatatcccgaagctacgcaaagaattacaactaggccagatccttaccagatcctgggaccgaccagtagccgccttgctaatccaggtagtggccagatccagctgtggcagttcctgctcgaactcctgtcagacagctccaactccaactgcatcacctgggaaggcaccaacggggagttcaagatgacagacccggacgaggtggctcggcgctggggggagaggaagagcaagcccaacatgaactatgacaagctcagccgcgccctccgctactactacgacaaaaacatcatgaccaaggtgcacgggaagcgctacgcctacaagtttgacttccacgggattgcccaggccctgcagccccaccctcctgagtcgtccctgtacaagtacccctccgacctgccatacatgggctcctatcacgcccacccccagaagatgaactttgtgtctccccaccctcccgctctcccagtcacatcttccagtttctttgcttccccgaacccatactggaattcaccgactgggggcatctacccgaacactaggctcccagccagccatatgccctctcacctgggcacctactactag

SEQ ID NO: 1125 - protein, 431 aa, Mus musculus
EALSVVSEDQSLFECAYGTPHLAKTEMTASSSSDYGQTSKMSPRVPQQDWLSQAPARVTIKMECNPSQVNGSRNSPDECSVNKGGKMVGSPDTVGMSYGSYMEEKHVPPPNMTTNERRVIVPADPTLWSTDHVRQWLEWAVKEYGLLDVDVLLFQNIDGKELCKMTKDDFQRLTPSYNADILLSHLHYLRETPLPHLTSDDVDKALQNSPRLMHARNTGGAAFIFPNTSVYPEATQRITTRPDPYQILGPTSSRLANPGSGQIQLWQFLLELLSDSSNSNCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVSPHPPALPVTSSSFFASPNPYWNSPTGGIYPNTRLPASHMPSHLGTYY

SEQ ID NO: 1126 - DNA, 212231 bp, Homo sapiens
ttaagatgttttctaatttaaaaatattttcaacggaaacagatgccatttacaatttctcatgttgtaaggattctactaaatatattatttggggattgaatattttacttggaaagttgtgtaagaaattcctgtatctaaaaaaaaaaaaaaaaaaaaaaaaaagaagagagagagggactggattttggagccgtgctacaggcatattgtaagaaagatttttttctttctatctttttagctagttagtgttctaagattttaaaaaatacagatcctcctagcatttacaaagtaaaagggttgtttcttttctgggactatgacaattgcttaattacagttctcgggatgttttctaaattctaaatcccactaccctgttctgagcagcagaaagtgctaacagaatgatctagggaagccattattaccaaagctgggggctataaggaaaagaaaacattttcaaaatattttctgtgcaaaagcatctgtgtgcttcagcatgccagttaggcttggccttgctttcactcccgatttttgcttcataatgctgggcttccctcagaggagaggaatgttgtcccctctttttttaaggggaaggatttaagttctttccccttttaggatattttaaaataatgtttaagaaataggttttgtcggtacatgtacagttgatccctggtattaatatttgaaaacaaaataaggtttaatattcttcaacttatattcaggttattccaggatctttggagacccgaggaaagccgtgttgaccaaaagcaagacaaatgactcacagagaaaaaagatggcagaaccaagggcaactaaaggtaaaatgaacagaacccaaataatcttatgctgcctagtcaggaccccttttaaaaaatgtggatatgtaaatattttgtatctttcctatttgattttcatggttccaaacctccacagaccatttctggattctttgctgtacttggatgaattatgttggttctacatgacacccttgacttccctgagataagatgccccattgcccagcactgcctgttcctggccctacagtgtggagattttagaattactgccttctcagttctatagtcttcacagcccctcttttctccatcactgtctactctcttctcccttttccagaggaaccagaagctaggtgtctacagactggtgcttttacgatatttccatttttctatcatactactacatttggcttacagtcattttgtggttatttcacctgaatgcaattgaaaccttctttcaaggggcacacccaggcagtgaatctttgtattcacaaaacatgccaaaaaataaaaataaaatccagttgaagaaggagagggtcagctccctctctctaaggcatgcccatgaggccagctggaatgctagggctcccctggagaagcaccgcagggatcaaggttatgggggtgctcacatgacactcatgcaggccgcagaatgtatgagtccctcccttgccagaatgaagccagggtcgatcagtggaaggaatagtagtccatggagcctgagacatgccttgaccagggtcagagttcagtgagaaatggtacaattaaaatggatgtggctcttgaggccatgccctgactgtgaggcctctaatctgcattagttaagtgactttcgtaagtccctccatagaggtgatttcctttcccagtgctgttgtaacaaactgccatgaactgggtagcttaaaacaacagaaattcatcatctcaccgttccggaggctggatgtccaagatcaaggtgtcagcccaagtggttccctctgagggctttgaggaaaatctgttccaggcctcttttgtcttttccctgtgtcttcacaccatcgtccttctatacaggtctgtctttaaatcttgtccctttttttgtaagtggatcagtcacattgggttaggtcactaatgacctcactttaatttgattgcctctgtaaaggccctacctctctatcatcacatcccgagggaccgggggttagtactccaatgcatgaactgggggagagaattgatacaattcaacccatagctataagtatttttattcatttggaaagatgagccatttcctactgaagaagtccattttcttatttttagataaatgtgggagatgcattcagtttctcatgctgtcttctgtctcccgctggtattccctgcttagctttggagtgcaggagccagggctggactgggttaaggtgactggggcacaggatttcgggcggtgctcccctttaggtactgatcctgcacttgcatgagcctgagagggagagcctccttaaatcatgggccctatgtttctccctgcctccttcttcctgccccataagggaggcctctgccccagtcaggggcctggtgtgcttggcaggaatcaggcctgtgcagttcttatggcagggtttgctggtgaaagactgatttgcctaatatctgctcatccaggacaagtgcacccagcgaccaatgctttcaaggaatggattcattcctatgaatactaaattgcttagagccattttgcctacaatgttttcacttaatgactagttatcttaaaactaaaaaatacatttctaaattaaggatgtttttagtcagttgacaaagggctcttatgaaaattagcaatttatttattgaggattatttttcctaaaaagttgcaacattttaattagccagccatggtagcacgtgcctgtaatcccagctgctcgggaggctgaggcaggagaatcagtggaacccgggaggtggaggttgcagtgagccaagattgcgccactgcgctccagcctgggcgacagagcaagactccgtctcaaaaaaaaaaaagttgcaacattttatacagtatcaaaatcgtccatttgaaatatttttactttcttaattataatgattaccacttgtttagtgttgattatgtgcctagccttgagagagttttctttctgaggcataatttagtttaatcctcacaaaagcctgatggtgtagacagaggagataatcaaacaatggttcaacttgcatactgaccagttagaatagatacaggccaactcttgcactgacacctttgtgaattgctgaacatcgtttggaggttttacaaattttttattcatgtttcccaacaccaaatacatcatgtcttcgccagtaccaaccagtcattcaacactgataccaactgggtgtccaacagttcaattcagttctgacactgactaccggaagttagcacatgggtttaagggctgagctccccaacaccgtcctcacttcagatgccagttacaagtattgggtccccaggttacctacactctgtctgacatggctataacattgggggttcccacaaccccccttttaggtgcaacaacttgctagaactcaggaaaacgctatgctcttatgattacagtttattattaagcatatgaatgaacaaccagatgaagaggtgcacagggcaaggtctggaaggattccaagtacaggagcctctgcccttttttttttttttttttttttgtgagatggagtctcgctctgttgcccaggctggagtgcagtggcacgatctcggctcactgcaacctcctcctcccgggttcacgccattctcctgcctcagcctcctgagcagctgggactacaggcgtccaccaccacgcccggctaatcttttgtattttcagtagagatggggtttcaccgtgttaaccaggatggtctcgatctcctgacctcgtgatccaccctcctcggcctcccaaggtgctgggattacaggcgtgagccaccgcgcctggccgcctctgtccctttagcattgggttgcaccacactcttcataccaatatgctcaccagcccagaagctgtcctaaccccgtcagggtattttatggagattttgttacataggcaggattgattaaatcactggccactggggatcaactcaatttctagctcctctcctctcctgagaggttgggaaatggggctgaaagttctgagcatctaatcaagactcactctttcttgcaattagcccccatcctgaagctatctagggactcaccaacctgctgccttcttagaacaaaagatgctcccatcacttgggaaattcccagagttttaggagctccatgccagaaacgagagacaagggcaaatggagttcttattatactacagtaatattatcctcattgtgcaaatgtgtaactaaggctcttggaggataaagtgatcatttataggtttccaaggagtaagtggcagatctgatttccatccctcatctggctctgcactgtgctcatatcgagcactgcccccagcccagcgtcctgcctatgccttctaggccccattcctgccctccccagctgaacccatccccattccaggacatgccccaggtgctggggcacccagagtgcctttccaaacttgactgagcatcttttgggctgcaccagcctgtttcctggagttcatcttcttgggaagatcttgtgtgtgtttccctgggtctgaaagatgagcagggagcattgctgaatggagtgtggccatgtggatcgggatgtccacgtgactatatgcatcccctaacccgcagaacacaattgggtttgagaagagaggaggggtagggtcgaggggtctcaaacttccatctattttcttgcaccagccctgcaaatatttaggccttctcttaaccattttgcaatactgcctccataattacaaaatgcttattttcccttctaccttgggtaccagtccatcttttttatgtggttagagcttacgtaattcaaatcaagtttgtttctatttagtaagacattggcattttgaaaacaaaaacaaagaagtgacacaagtagaattctgttattgttaaggccttttttgtttctttaagatacccaataataaaatatagctgggtcatgaaacacaaaatcatatggaagtatataccttagcaaatgagtttattgcaagaaacaagtattaaagaaatgattttcaatcaacatagagtgaagttctgcaagggttcaaaggcaggtaaaatagaaaataaaaaggttcctacagtgacatgaaactatcaccaactactaaaaatttttagtatggttttagtttgtttggttaccaactactacatatttgagaaatgaccattaggaacacaaaagtaaattagaagtactctttaaaaaatccataaaatacctctgaaatggtaaaaaagaacaggcactcaaatggctgcaaaaagagtcagagagggccaggtgtggtggctcacgcctgtaatcccagcactttgggaggccaacgtgggtggatcacgaggtcaggagatcgagaccatctggccgacacggtgaaaccccgtctctactaaaaatacaaaaaattagccgggcgtggtggctcacgcctgtaatcccagtgctttgggaggccgaggcgggtggatcaagaggtcaggagatcgataccatcctggctaacacggtgaaatcccgtctctactaaaaatacaaaaaattagccaggcgtggtggtgggcggctgtagtcccagctacttgggaggctgaggcaggagaatggtgtgaacccgggaggcagaggttgcagtgagccgagatcgtaccactgcactccagcctgggcaacagagagagactccgtctcaaaaaaaaaaaaagagtcagagatccgtgtgggttgaggaggcaggggagggtggttgagcttttattctcctggtctttaggtccgttgggttttcgctgagctggtgtggagggtggcagtgccatcacgctgcgtgctgagtgaatccctttggtgtgtgatcactctggtggtggcggtgtgagaagctcatacgcccttggtctctaatgtggcagagctgggagaaacttaggttccctgcttcatgcctttcaccctctttcctccagtcctcatgcttcttgttcatcaaggctccttggtggcaccctcttgtctctgcatgaatcagctctctctttcctctaggtatatccacacgcctcactgggcacctccactaactgcctgctctcaggactgaccgcttcatatctgtatgaaacagatctgtttcccatctcgatccctcaaggatcaggactgtgttgcatctggaatctctatctattcccttccctgtcattttatacttgatgcaacctgagtactcaaaacttccccataagaaacaagagactcaaacagttgctcatttagtttatgtcttggttggttacagaccgagtggctgctgtaacttctatgatgttgctgcggtcttggatatccaaggatgttttgatttttggaatccaggggaggctggcagggcatcatgtgaagtgagaattcagttgctcctgggaagggctctgggaatcccatggaggcttctggtggaggtttcttggttatccttcagtttccaaacccattttgagggcaggattagggtttgagatcatgtctcgtaggtgagtggaaatattatgtctctgtgttgggatgaagtggcttcctttgaaatgccctgtttgagtctccttttatcactggctagaaaaattttaacgaagatctcggtaatctgattgtacattgcaaagtgtatgtcagtaatctattgtcacaaaaatgctgtgtaacaaattccccaaatttcagtggcttcaagcagtaagcacttattcagccatgagcctgtgggttggccattctggttggacttggctagcggctggtctggttgcctccctcccatgtctggggttttggttgtctatgggatgatcaaacgtagtcttggtggggtgattggggtgggtgactctgcctcaggtacctctcatcctcccgcatgcatctggccatgttcccatgctggtggaaagttacagaaaagcaaaggggaacatgtcctgcctcctgaggcttcagctaggatctgtcatacttgtctttctgctactgcctgttggctgaagcagatcatataggccgcccaaaaataagggttgggaagtaattctacctctttaatgggaagaatcacaaagttatgtggcaaaaagcatgggtacaggaggagttgagtgttggaaccatctttgtacttatccatagtgacagtgaaacaagctatttaccctctatcttctccgtgcctctagagcacttacagggtgtttcaatgacctgtgtgtgtaataaactaccccaaatcctagcagcttagtacaacaacccatttattattggtcatgattctgtgggctgactggactcagctggaagctgcctccctgatgtcggcaggggccgtggtcatctgagagtcagttctctggactgtccaggacaactccctcccgggcctggcgttggtgctggctgccccactgggcactcggtcctctgccatgtgctgtgctgctgagggtatggggacttggtttcaggaggcaggaaggggaagctcccacttccataaaggcctgagcctgggactcctgaaaccttccctctgctgtgttctgcaggtcagaggcagccacaggtcagcctgggtttgaggggagggggacgagcttcagtccctggtgtgagcgtcagcatgtgtgtgcaggcagggaggaactgtgcggagtgaactagtccagagagaatgtccagacatacggaaatagccatgtgctccccagagcagggttgtgcagtgggacgccctccctttgtgaggatggcttgcagacgctccccttccgggctgaatgaccccaggagcagagtggtgttttcctgtggcacctgctgctcttaggataaggggagttgaggattcctatgctcccagaaaccttcagccaggccccatcctctcccagcctcttctcccacgagagcaccaggagcctggtcaccttcatctgcttcccggttcaatttcaggactgcacttcactccctctgtactttcagtaactctcatcccccagagggactttaggcctgggggtgggggtggggggaagtacatattttccaagacctagaaatttggttatagaaaaaaaatgcctaaggttcccagcatgtcatcttcttggtgagccaagctccgccaatcttgggaggcctccagggagactgaagacagatgtggagcatgcagatctggaggtagatgctcttcatgagaggcaattgggttggaatgggtgtgcctgtaccgtgagaggtcagaaaggacagatgtgaatgtggggaggactcctgtgaatgctttcacttgtcactacagtaatgcgctcagtagcaaatttgaaagacagccttcgaaaatgtctcaagttctgtaatcatattgtttatttttattttgcatttgttactgcaaagagccattgtaaaggagaaaacaaacaaaaaactacaggtgataaaaagcaagtgatggcttctaaaaatgtaaactaaaaaaggcatttttagtgccaaaaaagaactgatggcttggctgagatctgcagagcaccagagactggctggggaccaggtactggaggctggagcctggaaggaggggccccatgacgggagaggtccccctagaatccagctgcagtcagaaccataaccaagcgcccagggaggttgggcggcaggtgtcggtggtgggaaggtgaggggaagagatacccctctcctctcacccctgctctccagagggggccacgtcaaccaaccctgacaggtggccaggaggcaaggcaccctgctgagcccatctgtagaggtcagccctggggcctgtgacagcaaagggaggttggagactggctcggtggaaggggagggcacagacagtggtcagaacatgctgctttataatttgaataaaggaatatattggatgaagtatttatttctggaaaattcctggattataggcatctttaaatttaatttatttaagcggtgttttaaaatgtcccttcaaaatgtgggttgatacctgctaattaagtcaaaccaaattttttttgggctctggagtcagatagcctaatctgatttgaagtttggttctgtcgcttattaaccaggtgatcctggacaaatcagtaacctttatgagtcttgacgtccacagctggacaatgggaatgacagctctcagagtcgtggttggaatgaaatgagaaaatgtgtgtggagcccttagcgctcaaggaactggcgctgaagtactcaatgaatggtagctgtgctgtttactaagaacttaataacaaagctgaaaaggatgtgcagatcgcatgagttttggtgggatttcaaagtcctgttttctcagtatgatagagaagtatgccctgttttagtcccacgtcttcctttaatggatccctcattagatgctgcccacgtggaaggatgtgtggatgctgcatgtgatgtgggttagcttgagctagattcttctgtcctgtcggactagggttctcttgggctcattgtaagtgattttcccaatggaagggaagtgagttatctagtcacctcatggaccacacgtacctagaggatgcctttaggcaaacatgtttaatgtaaagctatgattcttttgccattggtgaattgtgtcctgtcctgctagaacataaaacacagaaatgcagttgtttattattatgtatgttgttccttttgtcttctagccgtcaggttctgaacagctggtagatgggctggcttactgaaggacatgattcagactgtcccggacccagcagctcatatcaaggtaagtcccgtcttggctgggaagccagctctgccttcctctgtgcctaggttttcatggatagcagcccacatatcagttaattaggggtcagtcaacacagcccaggagctaagaaaatggtttttacttttttaaatggttgaaaaatcaaaagaagcatatttcgtaacacatgtaaattgcatgaaatttacatttcagtgtccataaagaaagctttattggaacacagccccatgcattcatttctatatcatctgtggctgccttcactccataatggcacagttgagtaggttcgacaaagaccatatggcctgccagctgaaaatatttactgtctggaccttttcagaaaaaattttgctgagttaatatatgaaatcacatccaaattcttctaactcctgttataattccatctcctttatacttgcctggggttagcgagcaggagacaagtaggtgaatgattggatttccgatgttggaacgttgttttatctgggctcgccgacactcagcgctccatcacctcacacctgccctggctgctttctgacctgcacttcctgaggctctggaggtgagagggtgaggaagtgcgacttgtgccaagggaggtccctgagaggactctggccatttattttgacactacacatacatgtgggtaatagctacagggaggaaatgagatggtagttttcatatatttgacaaaaataaagactgcagaaaaaattggggcttaagctaccttatccaaacaggctgtctacacctgtgctggttagttcaactatatctatgctggccaaagtaattgactgcatggccagttcttcactttccccatactaattcattttccctaagtggtgtggttggttttactaatgtatattccttgcctaaaacattaattgaaaatgggaagggcttataattgaaagcaaagtttgtgatattgaaaagtgtacctttttgaataaaatataaaaagcctttcaaaatcccacacatacaattacacatggacgtacacacattttaaaacaatacatttggtgaggcattctggaccatgtgcagctcacatacacacacatttactttttttgaaaatggaattggaagtaataagagtttcaatgcattccttgagctttgtgggtgctccttcactttcagagattgtggtaactctagggatgtcgaggattctaaattttgcccaaggccatagaggagcagatgcttatggggacactataatttgatttctgtgtgatgttttgttgggctatgatggttgtgtttatcaaaaaaagtgcaagtaggaaatctcttgtggatgtgataaggtttcttcggaagtgctgggaacatatttgatcagtgtgtctgtgctacacaagtaaagtgggagaaagactttctttaatttttagtgtctgctgaccatgaagctgcatgatgcaaagaaaagctcatagggaagttgagacaataaatatcttctatagttcagattgtgagggacggcaactgaaattcattttattagcattccacaccacccctccaggcaaccagaaggaaatgatgaagtcagcaagaaagtattacaggttttaaaaagctaattcataaaggtgaaacaatcccatacaaacctgaaaacaccatctttgaaaatgtgtgttggtagaaacgttctatatttgatttcaggaatgaactatgttttcggctctgatttatcttattatctgaaggggtgaccttcccctccacaactgtgggtatttctagtcaggtgggacgagagactgagaaaagaaataagacacagagacaaagtatagagaaacaacagtgggctcaggggaccggcgctcagcataccaaggacctgcaccggcaccggcctctgagttccctcagttttaattgattattattttcattattttagcaaaaaggaatgtagtaggagagcagggtgataataaggagaaggtcagcaaaaaacatgtgagcaaaagaatctatgtcataattaagttcaagggaaggtactatgcctggatgtgcacataggccagatgtatgtttctctccacccaaacatctcagcggagtaaagaataacaaagcagcattgctgtaaacatgtctcaccttccaccatagggcggtttttctctcatctcagaattgaacaaatgtacaattgggttttatactgagacattcagttcccaggggcagacaggagacagtggccttcctctatctcaactgcaagaggctttcctcttttactaatccacctcagcacagaccctttacgggtgtcgggctgggggacagtcaggtctttctcatcccacgaggccatatttcagactatcacatgggagaaaccttggacaataccccgctttcaagggcagaggtccctgcggctttccgcagtgcattgtgcccctggtttattgaggctagagaatggcgatgacttttaccaagtatactgcttgtaaacatgttaacaaggcacgtcctgcacagccctagatcccttacacattgattttatacaacacatgtttttgtgagctccaggttgggtcaaagtggctagggcaaagtggttggggcaaagctacaaattaacaacatctcagcaaagcaattgtttaaagtacaggtctttttcaaaatggagtctcttatgtctttcctttctacatagacacagtaacagtcagatctctctttcttttccctacaattatcatcatattggttgatcgtattggttaatgtcaatatataatatcatcatcatattggttgatgtcaatatatgaaatataattttgagaaatcataactgagagtttttaaaaaataaatttcaactcacatggcttctgtgtgtttggagagatgaactggcaataagaagtgtggttgctaatagctgatgttggctgcgaggtagaattgtgttaaagatatttatttcctttataaacctatcaaaatcccaccaattagaattcgaataattatttttgtaattcttttttctgcatatgaaattggggttcttgacaacaaagttgggaggataattttcttccactgattcattaaaatgcctgatatgggagtttttgaagtaaaatttcatgtgcgagaagtttcttctggctttgggctgaggaacgctgctatgatttctgggaaggaagttctttttttttttttttttttttgatggagtctcgctttgttgcccaggctggagtgcagtggcgcgatcttggcttgctgcaacctctgcctcctgggttcccgccattctcctgcctcagcctcctgagtagctgggactacaggcacctgccaccacgcctggctaattttttgcatttttttttttttttttagtagagacggggtttcaccgtgttagccaggatggtctcaatctcctgacctcgtgatccacctgccttggcctcccaaagtgctgggattacaggcgtgagccaccgcacctggccggaaggaagttcttataaatggcacatgaatggttccttttgatgtattaacatatatagtggaagattttgtttttggttcattgctactaaaatgtttttgttatctgagaaggacttgagttttccacagaagtggcttaacactgcaggtgtgattcccgtgaagactctgtgtcatcacagtcctgtccgtaggctgtcctggaggagaggaacattcctttcatcttagagaaattcactctgcaaaatttatgatgactcttttctgccagaacaaatggcttttatccttttatatgtttaaggagctggaaacaataaaaaaaggaggggtggttgaaaactatggaatataaaatattcttgatttaaatagtgcaagaattgtggcaattcatttacaaacaaaatgagcaggctgtttattttagctgcttctctgtcagtgataatagtgactgtcttgaagcataatttgatttccctttctttgcaggccgttccaggtaccttttttaaaaattttttatttattatttatttttatttattttttttaagacatagtcttgctctgttgcccaggctggagtgcagtggtatgattatggctcactgcagcctctgcctcccaggctcaagcgatcttcctgcctcaacctcctgagtagctgggactacaggtgtgcaccgctacacccagctaatttttattttttttgtagagacaaggtctcactatcttgcccaggctggtctcaaactctgggctcaagcaatcctcccacctcagcctcccaaaatgctgggattacaggcatgaccaagtactttttttattacagaaattatactaactaccatatcatgcacatctactcttagcatgttaggtgtgtatgaagatacaactctctgaaggggtggagctgtcacaaccaaagatgcacccagatgattatcatcagccgacaaaaaaaatagcaaatccattttcttaggatcctataaatatttttgtcattaattctatttctgataaagcatttttaaattcacatgattgcatttcctaaaaagagttctgtctctataatattttcatttactaacatttgctgaagaggactaactaattgcctttgttgttcaccagctaatcatatagaataatacacattttggagccgatggaatgaggactggactgagaggggaaccatctgtatattagttctgctccgtggtcgccagctgtgaatcccagagatgctagtcatgaaaattctctgagctttgcattcttatccagtttcatgtcgtggataagaacacattctggctcaattcaaatcctgctctgatgtttactaacttggtgattttgtacaagttccttagtttctttgtgccttggtctcattttatatgaaacggaagcatctgttttgcagggttcgtgggagattaaacgagttagtacatttagaccccactgagtactaaacaattgtgagctatcactgtgatctataaaatgagggtggcgtacccatcttaaagataaaacatcatcctgtctctgatacctatggagcaacatgagcatgttttacaaaacactgagtggagtgaaaaatacagaaaacagaacgcgctttgtagcacatgctacttacatacataaaaaagttatatactcctcaagcaacatcacagggttttccagggtacatacatacctaaccatatagatcacattggagtgggtgcttgcctgtgtggcacatgctggctagttgctttgagaagtggttggggataagggaaaaaataatcatatgcaaataaaacaagttaataacagtgatgtttttatgtggcacagtgggtcctccatgctggcaggagcatgagtttgtacaagcacttttgtattggcttggtgttacctagtaaagctgaagatgtgcctagcctgtgatccagcagtctcaccctgggtctgtattcccttgtacctgagcaccaggaggtatgtatgagcaaaaacagaacaacccaagtgtccatctacagaaaagtggatacataaacctattgtactccaccaatggagtactatacagcagtgaaaaataaactccaagtgtctatctgtagccatgtatcagtgtggatggttctcatatgtgagtagaaaaaagtcacagattacatacaatatgattccacaaataaagattaaaaagaggcaacattaaaaagcatattattcagagaaacgtaatatgtgttgaaaagaaaaataaggaaaaaaaaccacataactcagcattggaattaccttgtcagggaggggagagttttaggggaaaggcataaggggcttctgaggtcctggggctgactgttgtggactagggagtacctgcaaaggtgtttgcttcttattctttaaattgcacaaatagattatatatcctgttttgtgtgtactatttgcaacaaaaataccaaaagaagagagaggaaaaattaggtggctcatagtgaagtcagtcttgagaggaaggtactttctagttgtaaaactcattgtactttagcaaatcatcacattagagatcacttggtctgatgctgttctagctgcaaggaaaggtgggagctactgctggtcaagtgacttccttgaagctcaggctgtgcctgttccaaagctgggcacgggccgtttccaagttgagtgtgtcctcctgccttggctttgtgagtttttccaccgcacccttttgcgatgaggaatgatttggagactgcttctgacttgggctcgtttattcattcaacaaacatttagcaaaccttccatgtaccccactgggggtggggggggagggagagaagggatcaaaaagacacagcatctgccactcagggcatgggtcacctgttctcaaacacttcgggcacagcgaagctgctagagagggacaggggagctgctgctggggtctgggcaggatctcaggggggctgcctgtagtctgcaccttcacctgctccactggctcaccccctatcacccctgtgtcctgccgacagcatctatgttcagcagccgctgcttctgcctgtaagcctcctggcagaggatcttcctgggatcacaccttgctgtctcttccaggtgaagcaggcaggtgaccctcgggtgcttgatgaggctgggggttcataggtccactcacctgtagcaggcgagtacagatgcctgaagttggaccctccatcgacacgtcctctgtcctccagctcatgaagggtgtccaggctcaattcagctaagctaatcactagatactgctccgtaagattttgtgtgaggatcaggcaccaacaatggatgacaggggaaacaaagtcactgttcaggtttctagttgctgttcacatgtggggaaggactaaaaacccagcttacccaggatttgtttgtaattaggattttcaccccttggcttccttttccctttggcttttatacttttgctcatttttatgagtgtgctggggccagatgatctcagtgtgaagcttggctccacctgttactagctgcctcagtttcctcagctgtaaaatgggaatgaaatagtgcatctaccccatagaatcacgaggaataaattagctaatgagtttagagcattcaaagcggtgcctggcactcagtgagacttattatcacatcacattacgtattgtcaatataataatatgcacaccatgttaattatataacattaatatttttaaacaatatagcatattattaatctataatgttgtatactagcatactggtgcatatagcagtggaaggggagatactgttacatatagcagtggaaggggagatactgttacatatagcagtggaaggagaaaagtaagaaggggaaatcttacggaaaaaattaaattgacccagggtcagtacttcccaagaagtgaactgaagcacttctttcccacattgttccacggctgccgctctggaagtaacgctaaatatttctgaccataaaagacgctaaacttaaactctgtgtctgtttcatagacggaagagtctaaaacagtttcagaagtagcagcgttctgtgcgaggtcactgtgaagcctgagagcccagcagatgagccgagctcttttcaataacacgaagcagatgcagaaagcgcccgaatctgccttgcgaggaagggattaggcgatgtctcggggctggtgatgatttatcccatcgctatggcgaagggtggatttcacgatggagcccccactggctgacaaaagactcattgagttgtaagcatttctcacagtttgcaaatctgatttatagtaactgtgcttcacaggaaggtgaaagtttatccttttgagaatatactcaaaagagacagagttcccccgcccccaaagtctgtctactatgaagctgatgtaagtctttgatatgctgcctattttttctcaataaatcagctttgatcagtttccagcctggttagcacatcccgatgagccctgtgactttgtggccgtgtatagctgctttttcgttttttgtactttcatttttctgcaggatgatggcacaattaaaatttctacaatgagtacttttataatcagaaaaataatattgctttaaaatatcaagatatttaatatggcacaataatagagaccctgcctacagatttctttatgtgcgtggtctcgagctggactgtaccttctgtttctccttctcactgggttcctgcacccctcagggtcgccatgctgggcaccctccagggccagattccaatgcggtgctcagttcctgtagcctttggaacggtgttcagcatgtgtgcagcagggtttagtgaagtagtgaagtgttccccagacatgctgcacaatcccccccccagtctggcgattcctcgttaagattcagtgaggctgacattcagtagggggcaccaacttaatcaggaagtgtaagaggggtttggaggagattcacaatcacttcccaggagaatgggtggaagttgcgcatggttagcctagaccccctctggggcagtttccctgaggagttggttaaaatgcagattcctggtatctaaagcttcttctccagtaagtttgggttggagcccaggatgctgcagttcaagcacctgaagtgtttctgcgtatcttgctcagataattgatagttatcaacaattaacctagccttagataatcgataaatatttataaaaggaaccatgttttttgtttctttgtttcttcattgaaggctgctgtcttttgcgtggcttctgtgaatatcctagtcacacctctaagggtttagagagcattatttggccttgggtttcaaaacatcagcaagtctcttcggctccactatttggtgtcatagagcccagaagagaagtgacacttgttgcttcttccaccttataggaaattaacttaggaatcggagtcaataattttgcttagggttagcccccagtagttgagtgttttagagacatcagcaaggttggcatcactgtctctgacttagccctgtctgtgcaattgggggttgaggatcattatcctcgttgtaggactcagtgtggggccactgttgtgggggaagcaggaattggagggtacagtggttcaggacactaaattagcattttcccatggggacacccaactctttcttactaatgaataggaagaagtcctacttattatgggtttttgctggtttaatcttcaccttcttttccttctgtgtcttctttaccttctgatcgcaaaatcccatggtgtattggtatgaaagaatgatcattgataccagatcacccaattctgcccatctatacttctccaggaagtatctgagagcactattttatcacattctattgtggtttttaatctttgctgatttgatgggtgacaatggagttttatagatgttagcacttggaaacttgtgagcttgatcatctcttcatactcttcacacacttatcaacaagttacgttatctcatttgtgatatttttggatccaatttcaatctaatcattcagaattgctgggctacagcatgaactgaacagatgatgtccccgcctgcatgaagcttccattcccgtggctgagatagaatgtgctcaagggaatagttacaaatcaggtggtgctggttggtattctccagaacaaagcaggagaagcaagagactgaggaagggagaggtagaattttacacgaaaggttagggaaggtcatagggaggaggtgacattcaagctgagacccgaagggagtgggagcatgagccgtatgatcacacggggaagagtattgcagagagagggaacagcatgtgcaaaggccctttggcaggagctctcctggcactttcaagtaacggcaaggagactgggggctggcgtggagtgaggttaaagctgcaggatgtgagttggaggcatgctggtgaggctgtgttgtagacttctgttaagcaaggataagggcatttccattttatttggcacactgcgggaggagaaccattggaaggttcatagcagatgtgatctgattgaattttttaaagctttcttgaagtataatttacattggttgaagttctaaaagaaccatgttggctgttgtgtggggaacagtctagagggggaccaagagttgaaacagggaagaccaattaggaggccattgccaggcaccaggcagcgaaaggggaggtagtgagaaatgatcagactggggatctactttgaaggtggaaaagacagcatttgctgatggattagatatgcagtgtaggagagtcaaggatgactttaaagattttgtttgtaactgggtatatgatggtgccacctactctaaaagggacatctgcaagaggggacagttgcaatgagcaggaagtcaaaagtggggtttggctgtgttgagttggagatgcctgttggatatccaaattgtgatgttgagaggttgatatgagtctagaggtcatgtgagagatatatttgtgattcctaagcctaaggctatctgaggctgggtgactaggtgagatcacctagggaccaagatgcagaagagcattagggttgagctttgggcccctccaatgcatacaggttggaaagaggagggggaactacagaggagctgagaagagaagccagtggaggtaggagaagggctaagaaactgctgtctcggtgagatgaggactgaggattagccacaggctttggccacctggacatcattgtgaccttcatatgagtgatttgcatgggtggacaaaagccaccttgcagtgaatatgaacaaaaaaaaagagagagagagaagaagtgcagacagcttatatgcaaacaactcttttgacatgatttagaaggtgtagtgagtttctcagcaatttgtatacattatattttaatgatagttcccctcagctatgtaatatttgttgtgcagattgtttttgatgattattctacctattaatttttatgatgttccttttccaacaccccatgagataaacatttttctttgatcacatcaattgataattctttttatttttcccttagcttttaacttagaaaattttatctattttattcttctttttacttctgtgtatttaccagtattctgtatagcttgtttaatagatataaaagaaagtacatcttatcgtaaaacccaccgacaaagtcattcagcattcacaggagataaggcttgtggcatccaattcagtttccttcatcaggatttctgggttctgtgcaaaatgaacacagcatcactttgcagcagtttttttttttctcttagtcccctctgcagggttgataataaaaatagttgataattagcatggacacagtaattggaaaggggcataaaccaatcagaaaagattacaattgggagcaacaggtgtccctgtcacgttgtacaccactctctcccgataccttactcgcgagtgaattggatttctggctccatgcctttctggccttctgaattttgcctctctgtcctcggatccttgctatttgtctccttgccattttggggaaaaaggaggcatttactatgtaaggattatctgtgtgcctgttttatatgtttgctagattataaattacttgaagtgatcacataatcatttttgcatcctgcattatacgttatgtatgtagcacatgcttcacatatacgagttgactgaattgaataagcaatggcaacaatgaaacaagagtgattcagggactttgttgtattctggggcagaattgaacatgtcggtattcacttactctttattttctctcctttctaggtatgattgtaaccatacaaccaatttatagcagagaggacgtgctctcacggaccatgtgtctgcgctttcatagatacctacagactttattttttagagcagttttaggttcacaacagacttgagcatataccacaagtgttctcatataattcctgcccctatacatacatagcttccaccactatcaacattttcccacatgggtggctgacgtgtaacaagggctgaacctacatcaacacatcattatcacccaaagtccagagttctcattagggttatactttaatataaacaccgtatacccttggtgttatatgttctgtgggtttggacaaacaggtgatgacacggatccaccattataatatcatacagattagtttcactgcccctcaaattcactgagctgtgtctgttcatccctcccgacctcctaggccctgacaaccactgatctttttacatctccatagttttgccatttccagactgtcatatggttggaatcatacactatgtagccttttcagattttcttatctggtatagtaatgtgcatttaagcttcctcctcgtcttttcatggcttagtagctcttcttaactttttaaaccataaaactcttttaaaattaggtgaatactatatattttctcccaggaataagaacaaacacgcacacttttatatgctcatggatctattgcagtcaattcagtacctcccctcaacccacctcccacactctcggtcctgcaggagctgggataccaggtcagccagtccctgcaacctcttgaagcagttgatgaaattgaaagtgaatttttctttgcacctatcttgctagaaactgtgttgctccttgagctcagtaggatagaagttctttgaacaaagacagtttaagaggtgcattatcgatttaaatgtagttcagatcacagatactcattctgtacttttgcatgcaggaggacggcttctcaaactttaatacatccataagtcacctggggaccttgctaagagcagatcctagttcagtaggtctagggcaggccttgagattgtgcgccacaaactacccccaggtgctgctggttctgctggcctgaggaccagcctctttaaagccaggctggaaagccctgttttccaaactacaggtcatgacccatttgtctaagtgagtcaaggccagtattaacaaaaggaaatgggatggagtaaagtggaaactatcagggcacatcacatacagaaagaaaaagtattatttttgaagattttgttttagttatatatgtgcgtgtatgtatgcatgtgtatatatatataatatctacacactgagttttataataatctacattagtttgtactctggatacattctgtgtagcaagaaacaagggtagatgcactacgttggtttcgttctaaataatagtgagcttgcaggcataaaattgcacatgtgtctccgtggattttgctgctcagattctggtatccagatgttgggattttaaccaaggctgtaaatagcagagaaagtttttttattattttaaagatcaaattccaaaattctggttgtgttttacttaattgagagtacatgttacttctgagaatgtactttaaaaagtaaacaaatttaactgaagcatggctattagttagtgattctttgtagattttctggaaagtcttgtttgtttgtattaaacattaactctgctgtatgctgtaaatacactgctaagatcaatattgaaaaacgaacaataataccaattcatatggaccttcaaattagtcttataaaattttatgatatggtattatccagccaactgactttgagactgacaaaatatctaactttaaccaggtgattcttgcattctttgttttaaaacctcaagtttaaaatatctttatatttacatttaattgtcattaatcaaaaatatatgcctaaagtaacagtcaaaaacaagtcaattttttctgacttgtgttgtttgaaaaagcccccagttcaaatatttactttctgttattgtttgaaaaaaaaaaaaaaaggattgtgtagaatttacccatttcattgtgtgttacaaaagtgacctagagcctgcaggtgtgacaaggggtgttgggtcatctccttacctgtccaatttcaccttcagggcacaatgtcctgcaagaattatatataaaatagacaatgttggcaatgagcaaagacatcaggaaagaaaacagaccaagagggagaagatatttttacctgtgaatcatttaaacaatatgctgctgttcctgttcctcagtcttttatgataatggaaaactaacatatatccaataaaaggatttagaaagacctgttacttgattcctcaaacctgaaattaaaaacaaacgaacaacataacccttaggttaggtaaaacataccatgtgaagaaatgtggctctgaataagaaaaaaaagacattaaaaaaaaccccacattttatagtattaaaaagtatgtgttagaaaaccttttgattgatattaatgcatgacataaatcaactgaaggacttattattcttgcatcaattaaaagcatttagacttacctgaaaatctgaaagtagcatgttacatacaaccctaattattgtgtgccctcatgtaaacagcaacatttgatgatcagttcactccatgaggaccacaatttgggaagctttctcatttcctttgaaatggctaaatagcgtcatgggtaattggaattatattaaattttattttccagaaaatgagtcttcatgtaggggcttggaaagtcactttttgctggtattggttttaggagtattgtgttagttaggttccctgggaagcagatgttgagacggaattaggaatgttagtgttttattggagggggaagggggctgtgcctgtgaaggataaaatgaggatgaagcaagactgggcagggagagcctcagaccaggtacagatttgatagtttgaccaacccaacggggaggtctggagcagagcttgcctttggaggggccccgggttgggcagaaatgaccaggctctagtaccctgctgtgtcagtgattggctcagggctgtctgggatgaggcagggcctgaggtgtgaacagctggaggttgttcagatgcatgctagattctttcttgaagggagatcctagtgggacacctctggggctgccatagcatctgtagaagcaggaaagggatgtagctggttccttctgaagctccagcagggttatcatttgcttgacattgtcaccctccttgtccttttttgttgttgttgcaaatttcccttttgcaagactactttctgctcagaactaaatgcccttcactcacaaaatctgtataattttcatgacctaaaatggcttctgtcctgagtgcttagatggggtcatttgctgttggacagtcccactactgtcaagtgccaccatgatgggaaattgtaatgttaaagaaaagatgaggccgggtgtggtgtctcacgcctataatcccagcactttgggagaccaaggtgggtggatcacctgaggtcaggagttcgaggccagcctgaccaacatggtgaaaccccatctctactaaaaatacaaaaaaattagctgggcgtggtggcgcatgcctgtaatcccagctacttgggagactgaggcaggaaatcacttgaacccgggaggcagggggtgcagtgagccaagaccgtgccatggcactccagcctgggcaacaagagcgaaactctgtctcaagaaaaaaaaatgattattaaaaaatttgttttagattaattttattgttggatgtttcttgggcttagacctttagataaaccattttgactctatttgttatattacctgcctctactgttatttaaggttgacgttaaatttctttcagtgattttgttaaagtctgtcatcagttagttagacctgaaatctaaatgactaaatcgtgctggccattatatcaacctttgtcctctaaaaatttgggtcccagagttggtctttaattctgcctggggctccatctcaaaaaaaaaaaaaaaaaaaaaaagggaaatgggatccatggagaaggatctattattttttttaccaagtccattgctgccaagtggaaagaaccccctcagaatgggtcatcagcaggcaggtgtgttccaggctctgcaattctcccactccaacctcctgcttctgacagatttaaggatttttggaccagaaaaaaaagtactttgggaggatcctcctatggatttccttgttctgctcctgatctctctgtgccagcccatcagctaggattcatggagcaaggtctgtggcttcaatgctgggtgctcttttgctttcattgtggggtactcacagacaccctccagcctgaggcaccggttctgccctgtgcatgcaaaagagactgtgtctccatatcgccatcacttcccctctcctttcttgctattgttctctttatattcaaattatgtagttggtacttttaatgttattttacatttccttgcaccttgatgaaagacattgtgtatttctcacctttttctgtgctgattttttatctgctcacaaatattgcctttatgactccatttctcttaaatgtggcttttaagtgtttttggttcatttgtggaaatcatttactcttccctcaatttgcgctgtaactgtcacctccgtgtgttaagtaaatcggggagatttctttatttctacatttggctttccttattgatacgtgataggaaagaaagtaattcccaaggaagactatcccagtattgtaggaatgttgtggcaacattaagccccactccatcttgcatttccatacttttgccatttactattcaaagatttggagactgatggaaaactatttcttgtttgaggcacacacactaatgtttgactttggatgagaaatttttgaatgtccttggaaaagtagaatgctgacaaggaccttgagagaagggactgtgattcaccctgtcttaaagaatgaaacttaaaactattaccaatataatttgtaccaataatagtactcatcttcttattactttaatctcctattcagtttaaagtttcttgctaaccccagtgttgacctgtttcaggctgggaaatctcagtttggacagaaggtgtggttggtcccctttctccatggtacatgtccatttctcctgctgtcatctccttgcctcttctgtgcccttgaaatcaatgatgagttgagtgaggttcaccagaccaggtttggggccaccctcagcagattctgccttaatagtctggtacctcttttttagaatgaggtctctgccaaaactgtaggacccccccccaaaacttagcatcctgatttagatcaaagaaaaaaagcaaaagatgataaaattaaatataaaatgccagttgccataggatatataaaatgataaaatagttccaaatcataagtaatttttaaaaagttttgttcattagttgaagtgcagggagaacactttgtacatcttcctaatctcagctaattctgcatctttaggagcaagaagaagggttaatatgcaggtgatgctggggtgcccatcttcatagaacagatgcccccaaagtcatacccagaacattctaagagtcttttgagaaatccagggaaatcatccacagaacacatggttttccccatgtggttaggattttatctttacctttaagaggttttacatctaaattgtcactcttattctcattggttaacgttctcagagtataatgccaagacgtctaaattgttaaaaacttaaccttttaaaaaaacatacacatatattagttttttttcaagctaatatatgtttgatcattgatcctcagagattcctacaaacctcaggttggtcccagaagtccgggggatgtcttctaaaagtgggtgacacaaagacttatgacttgcagcctagagaagcactgtctgagtgaagcccaggggccaactgtgtagcttctcagctgctctatgtcctggatctttccattttattctaaaatagtatattgcaatattgaaattcaatatggaaatatttccttgtggctttaaataaacttttcaggaatgcatattagcaactaaaaatagagaaagtctcaaatttctccacttttccaaagctattctggagatttaacacttttcttagcactctgaaggatagaacccatgatatcagtggcacaaggtcacagaaacatttagaactttctcttcctgagtacacatagctttggagtagctgaatacatgtgctttgtgagttcagtggagagtcccacaaaacacggtggaggtggcagaacctggaagacccagtaactctatgtgacggctactctagtggaagcctgagttctctattgggtaaccttggatgattgggttaggctctgctgagggtgctgggcagatgtgaggggctaccccagcgttaatcagggtaggctaatagctctaactctcaaatttcagtggtctaaacaaagtttatttctcactcctgtaacagtccagtatgggggtctgggtgcggtgggtctcctcagtagctctctgatgagaggagcaagagaaccctgctttcttcccatccagcctctacctagccttccccccactctgtgtcctcagaagcctttcttttcagccagtgggtgggagaagaatggaagattgcatgtagacctgtttcctaggccaggcttccatctacctttcattgaccaggaatgagtcacatgaccacacctggctgcaaaggaggctggtaaatatagtctgtctgggtaccaaggaggaaaagggatattggaaaggcttggcccaccccttttgtatccacaaaaggctgcagaaatgtgattggctcatatgccctatctcctcctatctccagagatgtgacttcttctctccttgggtgactacaaaataataatcttcttcattttttctcccatgacaaatcttgatgtcactgtgaacaacaatctaaaaaagtaaagattatatataataattatatgtaatctcaccaacccagatacaattaacattttaatcgttatatttccagtctatttttccatgaacaatattacatataattatttttgccaaaagaggtcatagtaactgctattttttcaattttttgaaactgcccttttatcatcccaaaatattgcatttctgcaatatggcatttttttttccatgtccctagaaactgtttagtgacctatgcaatttcatcctatgtatattctatacattttaagctaaatattttttgttggcttcagattcttggctgttatatacagggctatgttgaatatcctgtaactatctttgattaaatctatgataacttccttaggttctaatcatataagtagaatttctagaacaaagaatatgcaactgtccaaaatttttacatatatttccaatttcctttctgaagacttttaccagtttaagcacataccagtatatgacattacttgtttccccaatatctgccaatatttgttattgtatttttataatttgacagtacaaatagcaagaccttgataggtcacatttatttgcatttctttgattattaactttattagaagtgtactgatgatttatactttttcatgtccttagtccatttttccatgtggacttgaatttttcttctttatttcctcaaatgtgttgccagtgtcagacatagtgcatatttcaatatagatactcaataaaaacttgttaactgaacaaagaaaattatgttaaggatgtaacatataagttacatcctttatgttaaggatgttaaaactctgtcaaatgtgtttcatatattttctccagaaattgttgaaatttttctattaaataataatattgaaaatagaaaatttttgacaatggatatattatttttttactgagaaaaaaaccaaaactattttttatagtctttcaatatatagtttcttaattttttttttttgagacagagtctccctctgtcagccaggctggagtgcagtggcatgatctcagctcactgcagcctccgtctcccgggctcaagcaattctcctgcctcagcctcctgagtagctgggattacaggcgtgtgccaccatgcctggataatttttgtactttcagtagagacgaggtttcactatgttggccaggctggtctcaaactcctgacctcaggtaatccgcccgcctcagcatcccaaagtgctgggattacaggtgtgaaccactacccctggccagatttttaacatgtcatttaatttgttaacatttttttttgtgaattctttagttcatcctgacagaggctgttctcatcctaaattatataactattcatctgtattttctttctgtgttttatggtttaatttttaattaaatctaatctatttggattttttagatgtataatgtgagatagggatttagttttttttttttcctttctaacttttattttaggttcgggggtacacgtgtacgtttgttacgtgggtaaattgcatgccatgagagtttggtgtgcagattatttcataaaccatgtaataagcatagtgcccaattggtagtttttcaatcttcacccttcgtctaccctccaccctcaagcagcccctggtgtctatcattccattctttgtgtccatgtgtgctcagtgtttagctcccacttataagtgaaaacatgtggtatttggttttccgctcctgtgttaactcccttaggataatggcctccagctccattcatgttactgcaaaggacatgatttcattctattttatggctgtgtagtattctgtaatgtttgtgtaccacatttttttctttatccagtccaccactgatggacttctagattggttctatgtctttgctattgtgaataatgctgtgaataatgcaggtgtctttacagtagaacaatttatattcctttatatacccagtgatgggattattgggttgaatggtagttctattttaagttctttgggaaatctccaaactgctttccacagtgtctgaactaatttacattcacacacgcagcatataactgttcctttttctctgcagcctcaccaacatgtgttattttttgacttttaaaattgccgttctgactggtgtgtcatgatatctcatggtggttttggtttgcttttctctagtgattagtgatgttgagcgttttttcatatgcttgttggtcacacatgtcttcttttgagaagtgtcttttcatgtttttttggcccattttttttaaagaagttgttttttgcttgttaatttgcttaagtttttttttatagattctgcatattagacctttgttggatgcataatttgcaaatattttctcctattctgtacattgtctgtatactctattgatagtttcttttgctgtgcagaagctctttagtttaattaggtcccatttgtcaatttctgtttttgttgccattgcttttggagtctgtcatgaaatctttgccagggcctatgtccagaatggtatgttctaggttttcttctaggtttttatagttgtatgatttacatttaagtctttaatccatcttgagttgatttttgtatatggtaaaatgaaagagtctagtttcaatcttctgcatatggctagctagttatccaagcactatttattgaatagggaatcctttccacattgcttgttttgtctactttgttgaagattagatgactatagatgtgtgacattacttctgggttctctaatctagtccattggtttatgtgtctgtttttgtactagttctatgctgtcttggttactgtggccttatggcatagtttgaagctaggtagtgtgatacttcagctttttggtttcctagaattgctttggctatttaggctcttctgtggttccatatgaatttccaaatagttttttctaattctgtgaaaatgtaattagtaatatgatagaaatagcattgaatctataagttgctttgggaagtatggccattttaacaatattgattcttcctatccatgggcatggaatgtttttccatttctttgtgtcatctctgatttctttgatctttgttttgtaatacttgtcatagagattttcactccccagttatctgtacccttaagtattgtattttttttgttgctattttgaatggaattgcattcttgatatggctctcagcttggacattgttgatgtttagaaatgctactgatttttgtacattgattttgtatcctaaaacgttgtgaaattgtttttcagatccaggagtttttagacagatacaatgaggttttccagacataaatcacgtcctctgtgaagagagatagtttgacttcctctcttcccatttggatgtattttgtttcttttttttttttttctcttgcttgattgctctggctaggacttccagtactatattgactaagagtggtgagagtgggcatccttagcttgtttcaattctcatggggaatgcttccagcttttcctgttcagtacagtgttgctgtgggtttgtcatagatggctgttagtattttgaggtatgttctttcaatgcctagtttgtcagtgttttaaacatgaaaggatgttgaattttattggaagtcttttctgcagctattgagatgatcatgtggtttttgtgtttagttctgtttatgggatgaatcacatttattgatctgcatatgttgagccaaccttgcatcccaggaataatgtgtagttaatcatggtggattagctttttgatgtggtactggatttggtttactggtattttgttgaggatttccaaatccctgttcatcatgaatattggcctgaagtttcttttcttattgtgtctctgccaggtttctgtatcaaaatgatactggcctcataaaatgaggttaaggaggagtctttcctcctaaatcttttgtaatagtttcagtaggattggtagtagctctttgttatacatctggtagaatttggttgtgaatctctctggtctagggctttttctggttggtagtctttatattactgatttaattttgtaattcgttattggtctgttcagcgtttcaatttcagactttaaaccaacaatgatcaaaaaagacaaagaagggcattatataatgataaagggtccaattcaacaagaagacttaactgttctagatatgtatgcacccaatgctggagcactcagattcataaatcaagttttagggacctagtgagagacttagataaccatacaataatagtgggagatttcaacatctcactgacagtattagatagatcatcaaggcagaaaactaacttaacatatttgagacctaaacttgacacttgaccaaatggacctaacagacatctccagaacactgcacccaacaacgacacaatatgcattcttttcacctacacgtggcacatacttcaaaattgactacgcacttggctataaaacaatttgcaacaaatgaaaaaaaaccctgaaatcatactagccgtactttcagaccacagcacggtaaaaataaaatcaatgctaagaatatctctcaaaatcatggaaattgaacaacctgctcctgaatgacttttgggtaaacaatgaaactaagacagaaatcaataaattatttgaaacaaatgaaaacaaagatacaccataccagaatctctgggatacagttaaagcaatgttaacaggaaagtttatagcactaaacactgatatcaaaaagttggaaagatcttaaattaacagcctaatgtcacacctggaggaactagaaaaaacaagagcaaaccaaacttactgctagcagaagaaaagaaataaccaaaatcggggctgaactgaatgaaattgagatacaaaaaaaccatgcaaaagaccaacaaaaataaaagttggttttttgaaagaataaataagattgatagacaactagctagactgataaagaaaaaagagagaagatccaaataagcataatcagaaatgacaaaggggacattaccactgaacccacagaaataaaaaaaaaacctcagagactattaaaaaacatttctgtgcacaaaaattagaaaacccagaaaaaaagggataaatttatggaaacatacaacaccccaagattgaaccaggaaagaaatagttatttttcctcaataaatgattgttctgttgctattgaataacttactttccaactgatatgaaaatgttacttttatcacctcctgaattcttttgtgtacaaaggtttgcttttaaattatctattctgtttcctcaatccattaatcgtctgtcaattcctgactgctacccttgctgatttatctgccttatgtttttttgtgtgtgtgtcacaaaccttgtgtgaacccgagtcccatttgcaatgatcccatctctggctggttgtagttatagtctctgttttctcaattatctcaaagccacctgctcatacataataggctgtcttagcttgggctgctgtaacaaagtgctatacattgagtggcatataaacaacagaaacttatttctcacagttctaaaggctggaagtctgagatcagagtgtagcagggttgggttctggtgagggctctcttcctgattcatagatgtccatcttcttgctgggtcttcacactgtgacaaaagggtgagggaatctccctggggtcccttttgtaaaggtactaatgcaattcatgagacctccatccttatgacctagtcaccttccaaaggcccctcctcctcatactgctaccttgggggtaaggatttaaacccatgaattttgggggcacacacacattgcagttgacaaacacactatgtgtctgaacacatctcatgggcctccatctattactccaggaccctcagctcctgcttggtctcagtggccaccccagcagattgactccttctgggtgtgagggcttccacagctcagggccagcctgttacctgtcccaggagggctggcccttctttcctgtgactcagcaaccaggtcaaaaggtttccggatcctcttggcatttctgtacttggatgaagcaccccaccaccgggcgtagaacctgacttttggagtggtcaccttgggagcaggtgacaacccagacatgcagggtgactctgaccaatgaggaaggggatgcaggaagaatgtaggcaactaagttcctatttttcctccaccccatgggctgctgtgaggtagaatttttccgtgtaacctatcagaggcatctgcatggccaagggaaggcaggggctcagtgactggctgtctccatgtccccagaagctagtgtagtgacaatctcactcgcttcccctcactctcaccgccccaggtttgcacctctccaatggagcaatagtatttaatttttgtgtcagtctgtgttcaaagaaatctaggttaaaaaaaacactgtgtcctagacaaggaagatattcatttctgtattactgctgttttttcttttctttgtactttctctttttttcatagaaaattaatatttgcacccaaagaagcctctgtttcaaaagactcagctcccatgactttggcatgttacatacctaagaagcgtaaatgcaaaacaaataataaaccccaacaatcaggacattgtgcattactgtatatgtgtgttttactttgccaaattgcagaaaagtagattgaacatctagattagggaagccaaagctataacacgtggatagacatctttagttgtagatttcggtgaagtaagataactagctgtttagatctctccctgtccagggtgcacagctacagctagttagtgtcaggatgtgcaatagtttggggtccttattctgaacttctctatactctaggagccttcagatgatgcctttagtatgatgatttatcaccctggatgcaggaaacatctaggaagatgtttataaaaacattatacctgtgccccaatcccggagatttcactggtcaggggtgggcttgggcatggcttttttgttttgttttgttttgttgttttgttttgttttttgagacagagtcttgctctgttgcccaggctggagtgcggtggtgcgatcttggctcactgcaagctccgcctcctgggttcacgccattctcctgcctcagcctcccaagtagctgggactacaggcgcccaccaccatgcctggctaatttttttgtatttttttagtagaggcggggtttcaccatgttagccaggatggtctcgatctcccgacctcgtgatctgcccgcctcagcctcccaaagtgctgggattacaggcgtgagccactgtgcccgtcccaaagtcatgctttgcagagtttctacaaataactgttcagtttctctttagaaatcatatgactggccaggcacggtggctcacgcctgtaatctcagcactttgggaggttaaggctggcagatcatgaggtcaggagatcgagaccatcctggctaacacggtcaaacgtggtctttactaaaaatgcaaaaaaaaaaaaaaaaaaaaaaattagccgggcgtggtggcgggtgcctctagtcccagctacttgggaggctgaggcaggagaatggcgtgaacccaggaggcagagcttgcagtgagcagagatcgcaccactgcactccagcctgggcaacagagtgagcttccgtctcaaaaaaaaaaaaaaatcatatgataatggtctctgtttaagagaggaaaactataaggatcttggaatcgttgcctacattgacttagaaagctttatttttagaacataattttaaattttgaactaattatgaactattaacttatatatgatgacacaataaaataaaagctgttttgatttcttggtggtacttggtggaaagccagtttattggggcaatatactgtcctcaccctcaagtgatcacagattgctcaggggacataagaggtggggttggggagctgcaatttttgctgtcattgaacagcacaggggtacaatttgcatcttttcaggtattcctctttgctagaccttacgggctagaagaaattaaagagaatgaaatggtagagaattttttttggagaaaaatatcatcacacatattaccaatgtagaacaattatgattataccgttttaaggatctcagatattttcctgcttagagtctatgtattttcatttaattattaaaaagtacaggattatgtaattttttttgcattttatgccttgtggttagaccctaagtattaaaaattgcctctacttaacagtggtgcagtcttaaaaattctggctatggtagcaaaggttctggtgttggaatattgttggcctattagattcagggaactattttgatggttaagagtatttctgactgggctaagggcatcattttatctttctttcatacctatatgtggttataaatgcctagttattttgtctatgaaaatcaaatcagtttctacaacataaacagcaaaacaaaaagcatccatgaatcagcaaactttgaagtggaattttagcactaataaaagcccttgcctatgatcgagtcgccctctttaatgatttgcaggtcactgttcatcttttcctttccttgctttaccattaaataaatctctcccaggtgtcccagagagactccttagaggcagcgttccctcttgtcttgtgagaataagtctaagacactcttcattttggtgagttgatggtggggtttgtaaatatccatatggtcaaacacgcattggttgaggccatgcagatcttgttgagcaacacagaatgcatcttcgtaccttcttccctctccagcccaatccccaatattttggcaagaataaatccatagctgcaacatgggaagctagatattcatgccaaatcacgacatttgagatcaacaagttagaaaaaaaatccatgacttttcatgtagcactttagggtgacctggctcagaagttatctagggcagaccaggccaatggctatgggacattccctgagacatcttttggactcttccttcttccaacaccctggctcatattcccactcaaaggaaatggcaggaagtgacctacagacaggcagactgtctgcagagagcaaaaatctcctttgaggaccacttcatacacccacccacaaacatgaaataagtcataactgattcatcctgccagccaccagggatagttggattaattgaacactgttcttaagaaatattcagctgagggaggtcaacgaggagatcaacaaccaggtacaatgggaagctcagctttggtattctgtgctgcacactccacgtttacccagaagatgtgtaattgcttctgagaagctgaggccaggagcagatacctctaacaagcgtgttctgagtgttctctatgagacctgggagctggaccaggttgtttcttagcgctacctccagctctccctcattgttcttcttttgatatagacatcgtgatttggaggaggaatgccttggcagccagagtggagcagtcgaaaactgtgtatcataaaaatgaaaatgcattctcttaggtttgtgggcgcttgtgtcaaggcctgaagaatgagctcatatcacaatattgtggaaatattgtgattgtggaaaacgtattgcatagtaagtgttgcctgtgatagtatcacatgagcatacacccgcacaagaagggtgtgctggagtgggcgtgctagagtggcactgaaggaagcacagtactatcttttcgtatggcatgttggctttgtgtttgacagtaaagggaataaaataaggtcctcataattggagcacttctgtgtgagtagaggaagataaaaagaagtaaaaaaagaagatagaaaaaagtaaaaacttcaatgggattttagggggagtttgcacttatatccagcatataggaaaggctttgcagacagtgggacaagatgtgggctctgggagatggaccagggcaatgacagtaagtgctgcatacagaggagacacctaaacagctgactgggtcttgggagtctgggtatggaaagagttaaagatgactctaggctcaagcctggaagcctaaaaggtgcagacaccatttctaggaataagaagtttcatggagaaggatggagttggacccaaaggagaagagaggagaagtctgtagatttggttcgcaatctttgactttgaagagctgagaagagatgtttagtaggaaatgagttggagttaatgagacactgtggagttggagggttttgaagaccactgggcaaggggacagtttctttgggattggatgtggtcatgtcatgaaagctttttcagtggagctcagtagaagccaagttgcaagtaattgaagagaaagcaggcaaaatgccaaggcatgttgatggtctctatcatgtttatcgttgtgtctgagaattgtagcaccgtactgactcaattaacttttgttaatacaagggaaagtgagatattgaatgttagcttaagtggagtcaagagatgttttggattatttattttagggcagaagaaatttctcttgcacagggaaaatatccgtcacagagaaagggaggagatgcaggagggagaagacagcaagctgggaaatcatggcagtgtctgtctcaggggcgcagatgcagggattaaatttggaaaggagcaattatcaaccctacgttgctaaaggatttgggagcaagggagcgtttacctctgagtcaagagtgaagggggagaatacaggtgaagctattgagaaatcccaagagtgggaggtccaggttgaaagaacttacattttatggcttcgttactctaaaaaagtatatagaaaacaaggtcaacctttgtgagtaatgtgagagtagttttggggtaagaggcagcagaaaggaaggttttcagcagctgtgtagagaattatataggaagtgaattaggagtgaatgaaaagaagttaaggagtgaatgtaaattccaaatggattttaaaaattatgagatttgtggtagagacagacagtattagccgcatgctttttctccatcagtgcttagttctttggcactggggtggagaaagaagaccaagagcgggtagaagcttcctggttagtaagaggatgagcaatttcagggaactagtcagagcacagtgagctgactgtggggaggggagaagagccctgagttgataaaggtcctgggaaaataggatgagtcaaagaaggagagagcttcatgagcatccaggaaggcttcagaaagagcaagggtgaggcagagatggaaggagagaaggctgtggttagagagaggaattttcactagagattttttttccctcatcagttcaaatccagcctgggctgtgtaccttatataatcattttcatcatgttggttggcttgattttacggtttctgtgttcattagaataagatatcctgggaaaggaaatgtaaagtcgcctctcttctgccacagtaggatcacgtttgaagagtcatgtttagttccagacatttcctttaactatgtattctctgcagatcccactggtaccacctgagaaatactgaaaagagtcactccccagctccactgctctctttctggtccaagtcaccgtgatcctgtgcgtggatcatgactctgctttcctaattgtcctcgcttctctgcaagcgagggtctgttcttcacagggagccgggatgactgctagacattgtcagtccatgtggctccagcgctgccagccttcctccagggcctgagggccctaaccacctgatcccggttacttcttcagcctcatctcctaatgctttacccttggttctttctgctctgcccacacaaacattcttggtattcctcaccccagggcctttgcacttgctgctcccgcaatccggaatgttctacccatcatttatgacttagttcctcactttctttgggtcttcatcaccttcacagtaaagccttccctgaccacactattcaatagtgttccccaggccgggcttggcagctcattgctgtagtcccagcactttcggaggtcaaggcaggcagatcacttgaggtcagaagtttgagacgaccagcctggccaacatggtgaaatcctgtctctactaaaaatataaaaattagctaggcatggtggtgcatgcctgaagtcccagctacttgggaggctgaggcaggagaactgcttgaaaccaggaggtggaggttgcagtgagctgagatcgagccactgccctccagcctgggcaacagagtgagacttcatctgaaaaaaaaaaaaaaaaagtgtttctcacacatcaccctgtcttccttcccacttttatatccccttctcacaggctattaactttactcttttatttttttctttactgtacgtctcttccaatgagaagggaactccacaagagcaggggtttttattttgcttgtttgtggctccatcctcacttcccagcccatagtggatgctcaatgatgttcactgaatgaatgaatattgaattacctggctataaaagtcatatatgcccattgtagataactgggaaagcacagaaaactatataatataaagatatgtgtatatacacatatacatagctctatgtggaaataacctctgctaaaattacagtggaattgctttttttttaaaaaaaaacacacatatacatatgtagtttatgcatcagtagggatattggtaaatagaatgagattgtgggtatatgaccaaggggataaagatttaaaatcatattatctgatggactgtttttgagagatacttaacctggagatgaccaggatttggagagcataatatacattttagatatttgaagaattatggtgtctaagatgaagtatacttattctgcataattctggactagagcagaatccacactactggggaaagatccagaaagggtagtgttggctgcatagtgagattaattctctccggtgggccacccatctgtagggctaaattttgaagaacagagcttgacatccatagaagttcaaatagaaacacaatggcctcctgcgaggtatttgctgcttgatggctgtcgtctaaagaatctatggtagaaaagacacatttaaaaaacctttaaggcagttttaaacagctaacagtaaatttgatagcaaccacaggacattgcttatatgtctgtgggtattttcccttttctataaaatatcttttctatctattacagagtagtaactcacatggagtatctatttactgtttattttgtctcttatcaccccattggtcctcacagttttaagtgtcgtattatcacggaagagagtgaaaatgcatttcgttagccatgcataagacagattagaccaacaattcattttcttttaaccaatctatttctctatttttagaaatacattactccagaaacatcaggaacacattaagctccataataactgagattttaaagccatgttttgaagaccctctaaacccaactgatataaacacatttaagcctgacatggtcatgatgtcatttgtcctgtaaacatcttttagcctttggagaaattgtagcagacatatcagcaggattcataaacaagccagtggaaaatacacacagagaagttcataatttgagtaatttgtgttgaaaaatcacaggacatcttgatggatttataactgtcgtgataaaattaacagtgcataggccaggcgcggtgactcacgcctgtaatcccagcactttgggaggctgaggcgggtggatcacgaggtcaggagttcgagaccagcctggccaacacagtgaaaccccatcatctctaccaaaaatgtaaaaaaattagctgggcatggtggcacggccaagtcaggagaatcacttgaacccaggaggcagaggttgtggtaagctgagaacacgccactgcactccagcctgggcaacagagcgagactccatctcaaaaaagaaaaacaaaaacgaaaataaacaaacaaacaaaaacagtgtagagtatttttactttgaagctattggtactttccaaatatctgctttttaaaaatttaatttaattttacgttccaggatatatgtgccggatgtgcaggtttgttacacaggtaaacatgtgccatggtggttccctgcacctatcaacccatcacctagatattaggccacacatgcattagctatttatcctgatggatattttcaggatatctgtttttaagaagaataatgtgcattcatttgaattgctgaagtttcgttaaattcactacaaattatttatcctacatatattttaagtcagttttaagtaagactgtttttgaaataaatttgaggtattttagcataaatcactcacaaaataatttttaaattctgtaaaattctatttgtttgactttattgccttaagattcctgttatgattgttttttgagataaatttagcagtacatcagtcatttaaggtttattttacacttgagcaagtggcaatgtgtggcataaaacaagccctccctattgttataaatgaagtgtaatcaagtagattataataatgcaaggtgaaatgggagacaaagcagttcttagccagtgctatccaggcaactcacctttgtactccgaatttatctggattaccaagataattgaggggatttttgctcaggtaattgtagttgggtaatctggacttctcttccaatttgatttgaatgaagcctcttaagcagaaacatatgggcatggaagagcaagcatcggaactcttaaagggcaataaaaagtatcctaaggatttataattggatggcgtcttccatccagatggattccacagcattttaaggcttgtaaaggaaggccagatagacgtaccacagtgccctttccactccaagttgtggtcaagtgtagtgaaatttgcagcacacgaattcctgcttccttcccttccaccccagtgcctccccagccacccaagcgctcaaaggcagagctaaagcaaggagctccacccagagccaaagctttcctgatggattctgctgcattgctgggttgtgctggtcctcctctggtaccttcttaatctttgctaaagatgtatgcccaccattgtcacccccaaaatgtccatatactttgagcttggggttgaccagtcagctgacaggtggcacatactttatggaggcagatggaaaaattttacattcagcagaagagcctaattcctagcaaggattggattgagaaacaaggagcattagaaagctccagaaggcggggtctcaggcctgcacatctgtcaatatatgatgagtgatcgggcctatgcctgagtgtaaccctccttgaggagggggtttcattccactggagcaagagagggaggtggatgttcttatcatctcatggcctcacaggggaatcatttgatgtcaggattttaagagatattaagtaattcacttgccaggggtttgcagtttactaataattttatttaacttttaggttataactgtcagggtgagtcagttgtgtgcaaagcataggactaggaagaggggtgatgtggagtgactgccttctgagcacgtggtttccttttggggtgacaaaaatgtttggaactagacagaggtgttggttggacaacattgttaattaaatgctactgaattgttcactttaaaactgttagtttcatgttatgtgaacttcacctcaataagaaaccaaatatgtttgaatattttttttcttttaactggcacagtggctcagcctgtaatcccagcactttgggaggccaagatgggtggatcacttgaggtcgggagtttgagaccagcctggccaacattgtgaaaccccgtatctactaaaatacaaaaattagccaggcgtggtggtgtgtgcctgtaatttcagctacttgggaggctgaggtaggagaattgattgaacctgggagttggaggttgcagtgagccaagatcgtgccactgtactccagcctgggcgacagagcaagactctgtctcaaaaaaaaaaaaaaaaaaaatcacgtgttggagacgctgttttatacctctgtgatgagtcaaagaaggactgggaaaatgcttcaccctccaagacgccaacctggggtcagagcatgggtatacgtgctgtgctgactatgcttacagtcagtccctgagagccgctcctcgtctatgcacatataggagcatgacccattagcaaaacaaggtgggcagaggagccagacaggcaggggcttcaatggtaaggaatatgctcaaaatgacctcttaaaaaatacaacaatgatttgtaagtatctttaatctttaactttttcactttattcgtcgatttctgtcttctcatgcttaaaaataactcaaagttatatttatatgtctagaacagtgaacataggatgtgaatcatgtaattttacattttctagtaactacctacactaatttccatcatgtattttcttttaatacaatctcccaggatatatctgaagagtccagcatagccaaaatggaatctttttaatatgtaatcaatataaaaatgactaatgagatacttttttcatagaacatcttccaaatccagcatatattttgcacctacagcacatcttaatttggactactcacttttcaagtgatcagttgtcacaggggctagtggttgccatttagactgtgcagttctaggagttgtgatttttgttgcgtcctctctggtgtcaggagatgctcagtaactaaaacataggtgaagaatgataaacatcacattatgcattagtttacagcctcagcatcgttaaagtgccttcagctcacaatatggtgaatgacataaaagaaatagtattcttttccattttatgagtgagaaaactgagattctgagagctgacatctgctcatttattcctgcccaggaatggcttaactgctgctctggtttcctagttgtcttggacaggccctgggcagtctctgttcctggaggaaaagatttatgcactgtgaaagaaactcagtcattttttacagaagagaaaatgagtctcggagaagtacagtagctctcttggtggtcatgtgctagtcaaccatggagcttgaacaagaaccatgccaagagctcttttcaattccaggtaacaagcacaagcccacatgtcttctgtcccccagcctgctggccagtcatgtttggccatatagttgaaagcaaagggtatgtaatggaattacatgactccatttaaaacagagaagctgacagactagttcactgccttagccacttagccctgggacaaattctggctagataccaattctagaaacctggaatttcccctgacaatgcctctcccagtgcagctcagtcataaagcagggagtggctagatggaagcccattactccgtaggtcacttggtcactttggacacaattctatctccttgatccaagaactaagaaggagggagaaccaactagacccaggaatcttcttttttttttaatgagaagaaccatgtttgatttttatgactttttgttatagtaaaatatacataaaatttatcatcctaaccattttttagtgtacagttgagtggtattaaatacattcacattgtggtgcaaaactcaccatcatccatctccagaacttttttcattttcttacactgacactccaacccattaaacaatagctttccattctacccttctctcagcccctggaaaccatcattttactttctgtttctgtgaatttgactgccctaggtaactcacacaagtggaatcgtacagcatttgtccttttgtggatggcttatttctcttagcgtaagataaataagacaatctcttaactttccaaaggtccatctgtgttatagcatatgtcagaatttctctccttttctaaggctgaagatatcccatgatatgtgtatatcacattttgtttatccactcatctgtggatggacacttgggttgcctccaccttttggttattgtaaataatgctgctatgaacatggatgtgcaaatatcagttcaatttcctgctatcttcatgcggaattggtgaatcatatgttaattctatttttaatttttgaatcactagactgttttttatagtgactttcccattttactctcccaccaccagtgcataagatttgcaacttttccatatctccaccagcacttgtaattttctgattttttggtaatagtcatactaatggctacgaagtatttcattgtggatttgagttgcattttcccaatgattagtgatgttgagcataatttcatgtacttattggccattagtgttatctttggaaaaaattctgttcaagtcctttgcccatttttaaattgggttgtttttgttgttgttgttgagttgtaggttatatacatatatatatatatttttttctggatattaatcccttattagataaattattttcagatattttctcttattttataggatgtcttttgactttgttgatagcttgtttgattcacaaaagtgtttaattttagtgcaggcaaatttgtctcttttatttatgttgcctgtgcttttggtgtcatattcaagacaggcttgtgaaatccagtgttatgaagttattccctaagcattttagagttttctcataagaattttagagttttagcttttattttttggtctttgttctattttgagttaatttttgtatatagtataaggtaagagcccaacttttttcttttgcatatgtatacccagttttcccaacaccagttgttgaaaagactcctttttttctcattaaatgatctttgaaccactttcaaaagttatcagaccatatatgcaatagtttatttctgaagtctctattctattccattggcctgtatatcttagaccccagaactttcaaggacacattgaattttactttcctctcacacactaaatcttgagattttgtcagccataaatttatctatttagttcattgatatgttcttttctgttttggttatgcgaagacttaacttgcaaaaagaaatttcagtgttgaaatatttttagccaaatcaatttagcattttaaagtacagcttgattagagatttgcacaattttcactttgcattttgaaatgtaaatactgatgacagacttccattgtcttgtttgctcatgcattcattcttcccttcaacatgcactgaatacccactaggtctcgggctctgtgttgggttctacacattcaaaaccatggtctgttgcctctaagtttagtggtggatacagctgtgcaaacagttgctttaacagaggatgcataaaatgctaggggatgcagaggagacgctgacgtcccagaggagggcttcacttagaagatgaggctggatctggtatggaaggatagataggagtcctcaaggtagataaagaggagaagagtattttaaacctgggatggaatgactcttcttgaaaccacagttcttttcatgtgggctgttttcccaaatggcttgttctttgtgttactactgaccagctttccagtatagagcctaggtggagatatggcttgatgactctggtgggcttccaaagcccctaagtataagtcaggtttggttggagattacctcagtgtctacctggagagtccattaatcgatttttaggggtaacttaccagcaagatatttaatctgagtctgatggaaatcatcacatgtactccatccctaggagtagagagggggctaattgctcatggtccatggcccacataacacttgccgtcagatgtaataacccaagattgggtccagaaatggttgcttaggcagggtaaaggaggaaagaggatgagatgtgaaaaaagcaccaagaagatagtgttgattaaaaaaaattgtgttttcttattggttgaaaatatgaatttaataagaagttctttctccccctgaaatcccatagcgttttatctgtattcctcttatgaaagaagcagctgtatgataatcaagcacgttaacttttaaacacaagtgaatttgtgggatcaacatggcaaaatattagaaattgcaattgaattgaaaaatctaggaagtatagcagttttcagcagtgaacatattttactttatattactgatatttatgtccttgcaaggctttaaatatagggtacttccctaattcgtctttgggtcttccaggctgcccagcacataacctaacacattgtgggttatacatgaaggaatgaacaaataagggaaaaaaataaaggtgttttgaaaatcataaaatattcacgagtgtaagatgtacagtgggtttggtaagtgataggtgctataaaatcttttattttttaatttaatctttatttttggttgtggcaaacacataaaacataaaatctgtagtcacaaccactttacagttcagtagtgttaagtatattcacattgttggtgcagcaaatctctggaacttctttaccttgcaaaacagaaacttgatgtcaatcaacactccccgtgttctgcatgctcccaccttttggcaaccattattactactttctgaacttggactactctaggtacctcacataagtagaatcatacactgtttgtctttttgtgactggtttatttcacgcagcataatgtccttaagattcatctatggtgtatgttgggggatggtgggggtgggagagccttagggaaaatagctaatacatactgggcttaatacctaggtgatgggttgataggtgcagcaaaccaccatggcacacgtttacctatgtaacacacctgcacatcctgcacatgtccctcggaactttaaaataaaacgattaaaaaaaccactttaatttaaaaaaagattcatctatattgtacaatgtgtccaaattttcttctttttaaagactgaatgacattttattgtatgccacattttgtttattcattcatctgtggatggacgattgggttgctttgaccttttggctattgtgagtaatgctgccatgaacatggctgtacaaagaactctttgagatcctgctttaaatttttttgaatatatacccagaagtagaattgctggatcatatggtaattctatttttaattttttgaggagccaccatactgttttccatagaggctgtatcatttgatattcccaccagcagtgcacaagggttctaatttcttcatatttttgccaccattgttatttttaattttttttatatttcatagtagccatcctaataggtgtgaagtgtaaaaattattttctaagactaaagaatgaagctattgagtgtcacttgcttatcttcaagcagtcaatgcttttttaaaataattcttcaaagcagactatatgttgaagtcagaagcttctgatgtgtgactttcagggactctgaaacaggtgttcatttggcaatagaaactgatgaaacattcaaaacaactttctctcccaaaccttaaaaagaaaaattgtgacattaaaaaaaatcacaaattgtttttttcttgtcagtaatgacttactggttcatgcagaggtgaatattggtaggtaaataatcccaggactgtatgctgagaatgaagctcagagcagacccttatcagagtgtctgtcttcggaaatacttgagtcaaggagctgtccagcaggagagaggggagttataaaggctttatttgcatgtatttgcaactctttgttgcagtgtaagtataagtgaagtgtttagtataagtgaagtgaagtgtgcttctgtgtatggggagggagagaagggaggagggtgagagcacttgttccttgtataagaaaaaaaatggctctatttacatcgtaactccccatgattagtgcatgaaggaaactatatattttctgaaggcaggctattttaagaggataaaaactgtgacatcatccaggagagctaaatatcagttgagcagctagtataagaggtatatgcaatgagttatgaggctctgaaactttccacgttagtttacgccctttgcggcatgatatgaagacttttgtgtagcctaagtgttggttttaatgaggtattgcaatgtacactcaaatgaaaaacacatgatataccccaggcaagagagaagcaataactgtacatatttttgaagaagactagtcataccacaggctaccattataacagaaaaaacaacaagaattttaatacagttgtctggccaaatatattaatttaaactgaatgccttttaaaaaatattatagctgtaaggcacaacgttccattggcaagcatcttcaaaaccttcattttagaggattgaaggaaaaagtgcaagcaggccttcccggcatgtacgtttggaagatccaccaaaaagtctttgatcatttatgtgaggcttctttgagtttgacacaaagaagctaaaataaaaataaatgaatttttaaaccagttgtcgtctttgtatttacataagagaatgactgagatgccttctggaattctatggtaagaacactgggttgtgcatcagaggtcagctggtgctttgctctgtctgtgtgttgacctgagttcaaataactgagacagattttcatttacctgtgacctcatttgggtgttagccctgggttctaataattcttgtgcaaataaagtaccgtatgttgtgtgttccttaatttagaaatctgaaatctcaaagtgctttacttcattttaattcaatagtgattttactgacttcctgcttcaaggaacacagaggtgaaaaagagctagtgccctcagatggcttattacaagtagatcatttttgaccaaatgtctctaaaatcggttgagaactgatacagcactgggaagcttgttgggtcaatggacataatttttattaagggatttcgttgtatttcttttgagtccacttcacgtataaatcaccgatgagaacatcagggtggcagttacttctactatccatagagatcattgaattgcaggtatgtggagttggaaggcagctgaaaatccatgtcagactttgatcagtgtcactaaagccccattctcttgaaaatattgcaaatgatggggatgatctctttttaccttgaacacatccagacctgtgattataatcagaaatcttagcttttggctgttctcattccagttccttaaagctccttctgacacaccagcctttcacatacggcaccttctttagaatcccctgccaagaatcaagtgtttccaaactagaattgctttagatgatgggataacacaaggtgtcaaggcttcttttagttttgtgaagtaactttcgtagtgacttcagaaatgattttccatcatttgaaatggaagcctacaatcacatttccccctaaccacagtcttccagctgttaactattgtgtcttgttatgtgggtgggtgggggtggggaatcggtatatattttccttgcaactcaaaagaatccagaaattagcaccctggactcacataacagtttatcttgttgaaacccccatgtgcccaattattattggttgtctgtttgctcctgtgagtaacggaatgagggtctcaccctttgttaccttggatcgtctggctgagaactgaactttcttgttcttattctctttgtgatctactattattctggaagcagccaaggaaatactaaatcttgatttatacaccaacacaatttgactttgttttgagaggcaaaatataataatatttttctttcttctgtcagttttatttttttcttgaaatgaaccaaattgtctacacaattgcctcagttgaaagaaagactctgtgaagcttttcctggcctgggttctgtgtaacgcactgcacttgggttctgtctgaatttgactcctggagctcgccaagccctgatgtgtaattggaaacatgcacactcactcacagcagcgcttgactctgcagaatgctgcggacatttttcccatctttgttcattcttattttgtccctgtgccatgattttttaaattgaattcaaatttgcagcttctaaaagaaaaccacaagaacatgatttttaatctcttgagatttgcttgccgctgttctacatataaaatagcaatttccttaatatatctaagccagatttatgaaacaattaaaaatggcatcttatttttttttaaagtcttttaccagttaaggaagagcgtgtactaccaaagcaaaacaggttttgcctctggcgagtctgagaagtaggaatggctatttacacagacccttcttcaaagtgtgaaggagggctcaaacactgtaaatggtgattttagccttcagccagattccaaacttggaaggaaagaaaagtcctcacaaaaccatgtcgcctcatgtgaagtgatgtcatcatgttggggagaggttacctagagaagatgaagcatcttacagattactttatttgtgagctgtttctgattattccaatggagggaaggtcactttgaataatgacgccttgtcattccttctgtggggaatctacactactagtcaccagatgtgctgggtcaggcacttcaggcttcctgaccataagctccacgtgttcaggtcccctttgtgtgtgtgcccttgctggaggaaggccaacctgaagcctgctctccctgcccaccaccccaattaaggaaagctgtggtttgtgatgatttatcatcaatatctgtgtctacaggcccagtcatcttctccgagtatgaaggtttggcctgactgtagttcagcagcttcccatgtagaactttattcgtccttttgagctaactattaaatactattgagccttttctgaaatgggaattttcctctttagacatcattacaaaatcctgtgactcgacgggactttgaagatcagttgctcttgcagatctttacattttcaacgttttaaagactcttaaaaggtataaaatgagtcctattgaaatcaaattcactatgtagcacaaacttgctcatcttgatagtaagtgagccttcatgtgttggaattttcaggaaatgaagatgtcgcctaatgatgtagatggtagattgagagggatttacagttattatacttgccaattctacaccgaattgaggactctcctgtgcagaattctgccagacagttttgagaccttttcttgactttcttcccctggagaaggctttctggcctctctgtaaagttcacccaatggtcttagatccaccctctgcaacttactagaaccataggaataagtaaatccctttttcaaatggaacctttcaactatttgaagagaacacaatcatgcctcccttcaaacctcattcttgctggacgcagtggctcacttctgcaatcccggcactttgggaggccgaggcgggtggatcacttgaggtcaggagtttgaggacagcctggccaacacgatgaaaccctctctctactaaaaatgcaaaaattagctgggcatggtggtgtgcgcctatagtctcagctactcaggaggcaaaggtgggagaatcacttgaatacaggaggcggaggttgcagtgagctgagttcgcaccattgcactccagctcaggcaacagagcaagactctgtctcaaaaacaaaaacaaaactaaaaaaccaaaagtcctcgtgtcttctgttccaggacaagtccccagtttcctcaattgttctttcccatggtttttgtttatttttatttttgagacggagtttcgctcttgtcacccaggctggagtgcaatggcgtgatctcggttcactgcaacttctgcctcctgggttcaagtgattctcctacctcagcctcctgagtagctggaactacaggtgcccaccaccatgcctggctaatattttgtatttttaatacagacggggtaacaccacgttggccaggctggtctcaaactcctgacctcaggtgatcggcctgcctcagcctcccaaagtgctgggattacaggcatgagccaccgcgcctggccagccatgtgtatcttaatggaaaaaataaagacacaaatcagaacattagatattttattctaatttgatactctgttgagcctcctataggtaacgtggcttctctctaagaaaataactcatcactgctccccaaggctactccttccctagcattacccatcttagtattaataataggataaccatttactcaggggtttgtttaagcccaaatgcctagcatcattctttaatcctctttccctcatagccatccaccaacaagttctgtaggctccctcttcaaaatagatcccagtgtccagttctccacctcacttcctccaccaccagcaccttaattcacatcactagctcattctcctggagactgaagtcacccctccctcatctccctgcctctcctcttggcttcctatagactgttctccacacagaagtcagagtgttttcctcaaagtacagatcagatgagatttatgccctgctaaacaccacctcatacttccctcggcaatgtggataaaatccaagctcctgttcatgttgccaaggcccttcaagatctcacctgcctccagcaccactggctcactctgctgtggccacactggcttcttggtggttctagaatattccttattcatttctacctcagggcccgtgtgctccctgctcctgtaatataatttaaaaggttgacaatgacatcctcatttaatttctacctgaatcattgctgtgaattttatattggaaatgcagacatagtatctttttaaaaaattaatagaccattctattattaatgctaatattgtggttctctcaatgaagcttaaaaaactggctaaatcttgccagaaaggatatttaaatattaattataccaaattttaataaatagttatgtttacaaaagtttgctatgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgtagtggcgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaagtttgctatggcttcctaatgtataatactaaacaacctaatatgggttgaatcgtgtcagtaattgtgaagttctaatccaggttcaagtgattctcctgagtagctggaactacaggtgcccaccaccatgcctggctaatgttttgtatttagctggtccctcaaaatgtgaccttatttggaaatagggttattgcagatgtagtagggtgggcccctaatccagtgcttggtgtccttatgagaagaggaaatttggagacagacaggtatatgaggagaaggccatgtgaacgcaaaagcagagattgggatgatgcttctataagccaaggaacaccaaagactgcagcagcccccagaagctgggggagagagagcctagaacagatcctccctcacagcctcaaaaggaaccagccctgctgacaccttgatcttggactttcgacctcagagctgtgagaaaatacatttcggtggcggaagccgcccagggtgtggcactttgttatggcacccctgggaaacgcatacaatcttatcagaccaaactcacggaacaatctgagatccacagttgtgcctaaatcattgctgttttgaagacagccacatacagtcacatgttatcattgtcacgttagggttttaaccagggtagttgttcagtaacctctggcttcaaagcttctcagggcaaggccactcatacaattttgggttgccctttgctgtttaacaggtcctgctctcctggagaattccagctttttctttggcctccgtgtaagagagttggggggtggggctccatgcatgaggatcagaggcagaaaactgcaatcaacgcctcctcttcagacccttcctggtggtcacagccctgttcatcatcagctgcggtcaaaactctggctgagaaattgatccgctcaggaatcattcagggattatttaacccgtcattcctcagcgttcactaagcattctctctgtcctcagccagcaggaagttaccaaccacagggttttaaaaacacagattcctggtccacctcagagattctgattccacaggtccaggacgtagcacatacgtttccatttccaagcccccagctgcagctgaggctgctggtctgagaccacacttggaatagcgctggccttcaaggactagaacacattcttgccgcactccatgtcgaatcttcttctcactgtttcagtctaatattatgcccttgaatttcaccaagggctagtgtgggataggccatgtttgcagtgcctgattgttttagagaggtcagagaggtcatctcagagacttcactcattatggtgctcagtatgcgtcgtggaaaattactctcagatctgaggatgcagacgtattcagtcccttcttaggaattggtgaacatcttagtagatggtgaaagttctggaagtcatcatctttctcccattacttgcagaactgggatttttcttaattgctacagcgtttcttagacagaattctcaacatagttttttcagttcttaatataatttcctccttttgctgcttgattttgtactttcgtatgttctaataataccttcataccggtgtattttattcattttattttaaacggtaacatttttattataacgttaatccaggtggacattttagtaaatagagttagtacaaagaaaattaaaaccttcctgaccctcctcactcagaaataacatctatggacattttgggggattagccttctagttaatatatgcatgtattttaattaaattatgtgcatttatatataaatctttaagtttacttgaaaattagaatgaagataattttgctaaaattaaagacatcttactcacagttttattcattgccatatgtgtttatcagttaaatcatgagtatcgttctctatcatgatgcagtccgctgtgacatagtgtagactacaatatagtcttacagtcctgctctgactcttttaggtagtttccagttgttactacttcagacaaaattatgattaatattatagcagatacatttaattgatttagtataaaattatagaaacggactacttaggggagagagggagaggtgcaaattagagtttacatttttatcctaatccctactggatttgagttcctgtttctaaagaatttagtccactcatggattatttactccttgatgggcaatccctgtccttcagccatacccgagaaggacagagcatccctcatcctccagtggtcctcagtgcttccctcacacacagcacctgcacatgtaacagaccacgccatcacatttcttagtccctctcttcttcaaggcctcctttacaatatcatgtctttgagttcatactccccataaaggagttattcttccccaacaatagtcagaaaaagtattattattattttttttaaacggattcttaatggaccactgttaatcgtattgccttaaagaaaaacaagcttaatgttttgttcagagctctcattggcccatttggctttcagtccgtctctgcatttccacagacccacatctccaccgaaggtgtggttggtagaaggactggcaaagactttgcgacttgggcttgctttcttcctcttttctgcacattgcagtaacttggcaggagatgtctagaggttggtgctcccacagatatgcaggtgcctctcctcccccataaaaagctgacgtggttgaagtcacgtaacagcatttaggaggtaacgtgagcaggatctcgcaggaaggttgggtgggggatgaggtagagaaatgactcacaagcaactctgtgtcttggctcggtaactgagagagtggaagaagtgttggagggaaagcactgaggctcaggagagctttgcgcgtgcttctggtcatgtgctctgagagcatctggaagagatgtctggcaggcttttggatgtacaggtccgaatccagaagagggttaaagcttgagtgactgtggaaggcatcgtctgttagaggcaggaaagagcatgggcattaacatggcctttcatggagaacatgggcagggatacagaacccgagagagggtgaatgccaaaaagaggtggcaggaggggcgcggggaagatgtgaggggtgtcagctacaccacgtgtgatcttcacaccacaccagtagggaggggcttgagaatcctgttaggttgactctgctcatttccttggattatctgaaataaatttctcttttagttttaaaaattaattttcttgtctctttctgtagtcacaaatgatcttaattctgcatctacccctactctttccaatagttgcttgatgtggaagcagcacccgcttctaagatggactctcaatttgcgactgttggtctctttgtttggaattaacatgagctcttgtgttttgcccacttttgtgtttgctttaggaagtatttcaaacagagaaggctggagaattctctttcaagagcatttcagaagttatttgctcaccaatgctcaggatgaactgggtgatctctgcttacaggcttttaaacatttccagaataaaggacactgttactgtttctggctctaaaaatccttggatttctttctttctttctttttttaaacagttaaccactttctgtctttttcaccccagtaaagaaaatctaatatcttatcactgctcctgtcttttggagttttaaattacagaatgtttaattaccaaaggtccttttgcttattatattttaaacatgcaatgatgtttccaaaaatactctaaattgaagcagggaaagtcagcaacagctttattcaggtttcattggtgaacagctactggtttggatgtctgaggctgagtaatttcagtgcagatagataatttagctttatgatgattctgttgactaatagtccgaaaagatcagaaaagagtcacatataggaagatgttgactttttccacagtgagccatggttgcataacgattcctagtccagtggtcaacaagttgctgccactttgtgacagatttgaatttattctttgtttatagaaattcaagccagaaaggctcatagtgttggcagctgattaaagcaatttaagtttgatttttgacactgtaattaaatgtgagctcaagtcaaatagtgcattccataccccttccaggtgggcagggctctggagctggcagtgtgtcactgtctagcttgggtttggtctcagggattccaaagaaagctttgatttgtaaatgggtgggttgaagggtgccttccaaaatatatcttttagaggtatgaactaacaaaataaatgcaagaaaattggattaattttaataattctgctgctttgattccaaatccttgaacacctacaaaaacaaagtgtctcttaaatcgcagtcttgcctttggatcccggaactctctgtttctgtttatgagcaggaagagccagacatgtattctgagatggatggagacatacggaggagagtggaggcacctgagaagcccattcagggtaccgatgggccatcactgggcttttgcagccttcagaatgaattcctttcaaattatgttttcgaaaccagatccaggttctttctgttagtgattgttttcatatgaaataacattgaaatccagtagcaaattgggctagatgtagatgagaattccgtgtgggtaactggggttttacggagaattacaataatgagtggggtgaaactcagatattgaacattcatcaggggtgggagcttagagaagtagatcagggtgaccaccggcttcctggccaaagagatttttgtccaaccctggcccccgcctcttactcactgactttggataaaggattgagtctgttttttctaaatatttttcggggagatgttggtgatgaatactcattggaatcctcatttggaaaatggacttggtgttatataagatatatcagcaagaatgttactttctggattctacaaaaagttacaggaataacaaaatagatggcttatttgtgatagacaaccaactatttgatggttcatttaaaaaagtcgaaagctcaggcaggggctacttagaaaacacaggcaggatagaaacattaacccacgttatttttagtgtgccctttttgctacctaagtgtgttttttaagaatgatagggcatatttcagagagcaaacctggaagcattcaatccaatggcatttaataaaatgattttgactagaaaactggcctcacccagacacaatgcctcctttgagaaaccatttttcagagtctgagttgctcccactttgagaagtaactaccctagtccatatggaacaatgcatttcttccccaaacatattttatgtccaagagaaataatttcgtacagcttatacctactttgtttttgttattctgtctccatcatatggtatttaaaaagattgtcagagcaacgtcgttgttcagctttctactgaaaattcacatgagagtaacaactctgtctttggaactggcttgaaaaattctgaagtaaacaagaatttgctttttccttttatctaatctgaaattgatttatgagacaggacctctactgaactgtgttaaataccttggaaatattttgaaccaaactttcatactgtcataggaacagcagaaatatatttgcttgattaaaataaaatatttagatatgcttgatctactacactgtaagttgattaaaaatagttaaagtgttttaaccttgctaggaaagcagttatggcaatatccattttatgactttcaaatagcttttattgattataactttacacaatcatttgtcatattgcaaataaaagaatatggttaatatatggatttttaatttatggtatcctcttcttgcaataccaatataatcaatcttttcaaatgttagtaaatcaagatagaatcttttattagtaaatttatagatatgataagaaaaaggaacaaaaatgcatattttataaagaccattatttcagaagtaaatctttttttttacatttgagaaaaagtacaaatctcattttatatcttgtaatttaagtagccagatcttgtcaaaacttatatatgaaacagcttacttacagcatttcttaaaagcaatttatttttcctgggggcttactcataggaaggggaccacttacgaaaaattattgatgctactttaggtttagattaaagcaactctttctataatagaaaattctcaatttttgtatgatacagcttgtagttattgtatatgacatcagttataacccttcatactgagaactttagctgatgggaggaataattataaaatttaccaagagatatctgaatttcattcatatcatgtttttaatgtgcaagccataagttgcaaatttttggtgaagaatttcacaactaagagtgtctgaatctgcaaatgtacccaagacaccctttaatacttatctgatcaaacttacggtgatcttaattgctaagttaagtccattcagttagagttgcaagtagtatagttcctgtctcctcaggggagctttgtcaccattgtgtctaagttggcctgaaaatttctttagctgattactattttagtttccaaacttccacacttgaattatgtttttttgcaagcaaattcaatgaacttcacttgtaccaggttcctctctcattttattcacctggtgatgaaccgattatatttgtatggaggctatttttcccaatcaccctgaatattgttctaaatttaagctctatgcttctctctttgctttcatgagcttcttttgtcctagagtaacccccacattttttggaggtggcgtcacatagtgttttagatgtgaaataaggagttagaaagactttggtctgaggtctgtttgcttgctgtgactgtgggcaagagacgtaacttctctgtgcctgcctacctttagctataaaatgcagctaataatcgacatatctagtaaggttttgtgataactggaccagggcttggctccgtgtgtagtagccgcactttgagatgctgaatgttgcttgagaaaatgaagggaactgtgtggctggtcttactttaagttgtgtccatgaatctctgatgcacactcactgaagcccggaaatcctcctcctcgactctgtgctgtcggctggctcttctgtccctgctgggcttctaagtgatgggcaggctgaaggttcagctttaatcttggcttttatttgttatctcacttctccccactaagaaatgagatccaatcacatggcttaaaaaccatctataaactggtgattcccagtctcgaatcctgatatatccagctcccaactgatatctcaacatgtatatctatgagcacgtctgatataaagtacaaatcccgatctgctctccccaatcttgtattcttcaagtcttcttctctgtaaagtaaaaacactattttcgcagttgttaagccttaacattacacaacaaccacaaaccacagatcatctctgattgttcttttttcgtgctctctgcctccagtcaatcaccagtcctgataggtcttcctgcagaaactcctggaatgagtcacccgtcccctagaatgatgcggtagcgtcttagcttggttatcccagctttcctttgtgcatgttgacaaaccttttctgtacacaaaaccttcagaacgtgtcaaggagatcagacaatccctaattcatctttggccccaatggcttcccgccatgtttgggattaagttcaaactcctcagtaggatctggctcttgcccacctcatggacacagatgagattgttcagccctggcttgtgtctgttcctcggatgcccctgaacttgtgagttcaaaatcaaaaaggatatttgaggagctgatccttcagtctagagggctacttctctggatctttaagtagctggttcctatttgttgtgcaggttctaatttgatgccacttctcagtgaaggccatcccctccagctcctggctcttcccaagggacaagaagggtcttgggaagaactcctgatgcttcatatctaagctctctgttccttccttgcagtgaattgatagatgactgcaaggcaaggttatcccttctcccccgtttcatctgcctccttgcaaaagtatttcacacgtgaaaagttttgacctgctaactgaggagaaaagtaaccctggaagtttttttttgtttttgttgtgtgtgtgtgtatgtgtgtgtgtctgtatgtgtgtgtgtgtggtgacatggggatatcatacaaacagtattttatacaaaatgctttcagtgtccaagctgagtttcccttgtttggaagcatatcagatggcaaagggcttctcaactgcatctttctccctgcttctacatgtgtggttagggtctcagtcctaatctagttgtgcagccagatatagcatttaactgagagaataatactgcagtggacattcttgtaggtgacttctggtgcacatatacacacatctctattgtacatgtattaaatagtggaattacacagtctttgatgacagtagatgtgccgactttctttgtttacttctctaattcattctccatccttctctgctcctcttgtcctgggagtttgacttctgtcgactacatcaaatgggctcctttgtcctctatcttctgttgggttaagcaaatgagagtcaccacaaggaagcctgagagtaggaggagagagcttggggagtttttttctccagctttctctctttggtcatgggttggcagtgactttttccctccatggaaggccacagctcctattgtttatcctctcctgtgttcacagctaccggtgctgcgtgactgctacctcccttgcccttgtaggcctgagggtagtaatggcttcctgttcttgctagcctgggggacttcctcaccctttggtttttactaaattctacctttaccgttgtaaattctttcattaaattttgttcacttacctatttgaatatgctatatgcctcttattacagccctgatggataaataaggatgttttttaaactccagctgtgtgtgagagttcttattgctccacatcttcaccaacattgttagtctttgttttagacattctgatgtatctgtggtgttatttcattcaggttttaatttgtacttcctgctttactaatgaagtagaagaccttttaatgagcagttggatatcctcttttatgactgcctgtgcagtttcttccctgtttttccttgtgtgtattctgacttgtgtgtattcttattgattgatgggggttctttacatattctggatatgaatagtagattagatgtgttaaagatatcatcttccactccatgcattgccttttgattctcttaatagtgtcttttgatgaaaatttaagttcctaatttttttcttattttaatgcagttcaatttattagtctttcctttactcttagtgtttctgtgccttgtttttaaaatctttcccttcccaagtcaggaatatagttttctatattatgttccagaaacttcatagtttttgcttgtcatatttagatttatagtttatctgacatcaatttttgtgatgttatgagttacttctcaagtttctgtttctcatgtggatttctcattttccagcatcatttaccaacagtttctcccttttttaactactctgcccctttgtaaaaaaaaatcaactgccaccttcgtcaaaaatcaagtgtgtccatatatgtgtgaatctgtttctgaactttcctttcttttccattgtctgatttgtttctacctgcatgaacactattctgacctaattgctgtgcctttataaaaatgtttagtagagcaggttgtcctacctcactcttttttttaagatttgccttttaaaaatggatactataaatagatagatagatagatagatagatagatagatagatagatagatagatagatacacacacacacatagttatggggtacatgtgatagtttgttacatgcatagaatgtgtaatgatcaagtcagggttttggggtgtctgtcaccttgggtatttctcatttctatgtgtcaggaacattgcaagtcctcttttctagctgatttgaactatacaatacatttttgttaagtatagtcagctactctgctatacaacatcagaacttattccttctatctaactgtatgtttgtacccattatccaaactctcttcctctccactcccactctctgctcagcctctggtaaccatcattccactctctatctccatgacattaacatttttagctcccacataggagtgagaacatgtggtatttgtcctttgtgcttggcttattttacttgacataatgacctccggttccatccatgttgctgcaagtgacatgatttccttatttttatggccaaatagtattccattgtgtatatgtaccacattttgtttaccatttcatctgtggatggacatttaggttgatttcatgtctttgctatggtaaatagtgctgcggtaaacatgtgggtgcaagtatctttttgatatactgatttctttttcattagataaatacccagtagtgagatatctggattatattgagtcttatttttagttttttgagaaatctctactgttttctatagtggctgtactaatttacattcccactcacagtgtagaagagttcccttttctctgcattctggccagcatctgttattttttgtctttttaataattgccattctaactaaggtatgatgatatctcattgtggttttgatttgcatttccctgatgattagtgatattgagtattttttttcatatgcttgatggccattcctgtgtcttcttttgagaaatgtctattgacgttctttgcccactttgtaaaagttttctttttaattgttgagttgtttgagttttgtgtatattctggattttctcttactagatgaacagtttacaaatattttatcccattcaacaggttgtctcttcactctgctggttgttttctttcctttgctgtgcagaagtgttttagtttaatatagtctcatttgtctgttttctcttgcctgtgcttttgaggtcttagccatcaaatctttgcttagatcaatgtcctgaaatgttttctctattttcttttaatagttttataatttggggtcttaagtttaagtctttcatctaccttgagttgatttttatatatggcaagagatagaggtccagttttattctttcgcatatggatatccaattattccagcaccatttattgaagagggtgtctttttcccaatgtatgttactgatgcctttgttgaaagtcggttggctgtgaatatgtggatttatttctgggttatcaattctgttccattggtctatgcgtctgtttttatactagtatcatgctcttttggttactagagccttgtaatatattttgaagtcaggttatgtgatgctcccagttttgttgtttttgttcagggttcctttagctattcaggctcctttttgctttcatataaattttaggattgtttttttctattcttgtgaaaaatgacgttaatattttaacagggattgcattgaatctgtagatttatttgggtggtgtggtcattttaatgatattagttcttctgatccatgaccatgcagtgtcttttcatttgtttgtgtccttttccatttctttcattagtgttttgtagtttttttgtagagatttttcgcttccttggttaatttttttcctagatattttttccttatacctattgtaaatgggattttcttcttgatttctttctcagccagtgcattattgggtatataaatgctactgatttttttgtatcctgcaactttactgaattttttaattaaacctaagagttttttggtggagtctgtaggtttttctagatgtaagatcatgtcatctccaaagagggacaatttgacttcttttccagtttggatgacctttattgctttctcttgcctgattgctctggctaagacttccagtcctatattgaatagaagtgataaaaatgagaatccttgtcttgttccagttcttagaggagagactttccgcctttccccgttcagtataatgttagctgtgggttaatcatgtatggactttaatatattgaggtatgtttcttctgtacctagtttgttgagagcttttactatgaaacaatgttaagttttatcagatgccttttctgcatttattgatatgatcatatggtttttgtttttttctattgatgtgatgtatcatatttattgatttgtgtatgttgaaccatccttgcatctctgggatacatcccacttgaccatggtgcattatctttttgatgtgctgttggtttcaggctactaatattttgttgatagcttttgctgaacaaaatactagaaaacttatattcaccagaaatattggcctgtatccatgctgaactgaagtgatgttcatcaggaatatcagcctgtagttttcttttttgttgtgttcttgtctgattttgttatgagggtaatgttggcctcatagaatgaattaggaagaattctctcctctttaattttttgaaatggcttggtgaggattggtattagttcttctttctaagtttggtagaattagtagtgaaaccatctggtccttgacttttctttgttgggagattttttttcctatccaatcttattacttgttattggtctgtttaagttttcagtttctttctgattcaatcttggcaggttgtatgtgttcagaaatgtatccatttcctctaggttttccagtttgtaatagtctctgataatcttttgtatttctcactcttctttaagagcatcttgtctgtttttgactctgcatttccatacatattttagaatcactcaagtttcacaaaaactttgttgaaatattgaatgcatctgcattgaatctattgatcaatttgaagaaaattctacctttgattattaagtttttcaatccatgaatatatctatccatttattttggtcttcttttaataatattttgtagtttttggtgtagaggttctgcacgtattatgttagatttatgtccatattgtaaggtatttttaatgctaatgaaaacagtatcacttaaaaattttgatttctattgatgtttatgctgatatataaaactaaaattctatattgaccttgtatctagcaaacttttaaaactcatttattaattctaatgacttatttccaaattctcttggaaattctgtgtaaaaaaatgatgtcatctgtaaataaagttttatttactttttcccaatcctttaacattgcatttcatttccttgccttctttactaactaagactgccaattcaatttcagacaaatgcggtaatatgtggggcttctttgtcttttcccccaacttcaaatgattaaattttaaagttttgacatgaaaatgtgtggtttactgtaggtttcggtagattccttttatcaatttgtaggatttataaacttcctctttatttctaatttactaagaatttttaatatgaatgttgaatgttattaagtgcttttcttcttttgtttaaagttatataaattttctttacaatgtaaatttgattatttgattgaaacaagctttcattcttaaaataaatccagtttgttcacaatatatattattgtcgtatatactgttgggttttgttttctagaattttatttaggattttgcatctatgtttatgtatgaaattgacccataattttcctttttaaataattttctagctacattttggtatcaagctttcttttcttttatctgaaaagcttatgtaagagtggcatccttttttttttaaatgcatgttagaatttgctgataaatccgtctggcctggaactttctttcttttttttatttttttatttttggagttgtcctttaagaggtctgagatttttcaatcaatgtctttaataattataggagttcaggttttgtgttttttcttttgacagttttggtaaattatattttccaattatgtatttcaactaatttttcacatttattgataggaaattgatcataatattctattatccttccaatgtctacagcatctgtagtaatagccccctttttattgttgactttggttattttaaccttccctcttttctctctgtaatcaccagtgacttacacataactaatcttttcagagaaccagatttggttttgtttatcttctctaccatattatttacaattttctcaattttgttctcatttgttatttttcttcttctttctttgggtttttctaactttttgagattgatgcctttgcctctttcctatggaagctcacccacagaaacagtaacattattatgtgctccacttcatatttactcttctgttttatttgcagaaccaagccttgttcaagttagtattaaaatataaatgactcccacagccatctctttatgcagtgccataaaatgtgctctaatcagaaggattttatattacgtgtttttaattattcttgtgaatcctcaatgcccaaaatgaattggcaacaaatatttgtctgtagatgtcaagatatttcctcatactgatatacttctcagcataacctcccatttagtttctttgctccttgctcctttcatgctgaaacaaatcctttacccaatttcccctacaatctgaatattccctgtttttggggaactcaactcaaatttcttttgtcctagtttctttttttttaacaagtttcacttgttatcttactaacagtgtatttaataaagtcgatgctcaataaatactcttgtctcaatgaataagcttcaacctctttgtagctatattaatatatttatgtattctataaagtctaattggtagcctattattattatttttttttttgagacggagtcttactctgttgtcaggctcgagtgcagtggcatgatcttggctcacggcaccctccgactccctggttcaagcgattctcctgcctcagcctcctgagtagctgggattacaggcacacgccaccatgcccagctaatttttgtatttttagtagagacagggtttcaccatgttgcccagggtggtctcaatctcctgacctcatgatccgcctgcctcggcctcccaaagtgctgggattacaggcgtgagccactgcgcctggcccgtaggttttaattaatatatttaaattttcttggcatttcagtatttctatattataatgtgaattattttaaaatactttatctgattacaaaggtagcacacacttgttttatcctaaattttctcaactgtttgacttgaaaagggggcagttactccatgatccaaacctcaaaactgaaatttgtattttaagatgttttctctgcatatgctaatatacatatgtgataattttctaaaacttattatactttgaatattttctatgcagtacattaatatctatctcattcttaatactgtgtagtataattattcaatatctgattgaaagacgtacagtgtattttcatattttactgttactgagcagtgtaatagcagacatcctttgtacttataactgtctattgtgagtatttctaaaaaatagatttctagaatatcaattgcggagacaaaggataaattattttattcccattatacacgaatgtcaatgctttttcctccacattcttgccaatacttcaaaatattacattttttcattgttgttatctggctaggcccaaatattgtgtggtggtttatttatttttattttctttaatctgttttcacttttcttggatggtttacacttatggatagtaaactcctgtgatggtgactcgtggtcatccaggttcttttgcattgtgtgggttaggatgggcaggacacactcttgtatatgtaccagctgttggtttatgtgattttttcaggtcaatctatcccatctgacaatataccttccattaggctgacagtctgtcatgcacacagtgcacacacacaattatattacaaggctgataaaaccgaattgctctgttccagtggttctcaactgggacagtttttggttgcacctttagggacagttggccatgtctaaagacagttttggttgtcataattggagtctgcgaggtgttactggcatctagtgggtagaggccaggaatgctagcaaacatcctgccatgcacagggcagcccccacaacagataattaaccaacccaaaatgttgatgctgccaaggttgagaaaccctgtggtctattgctgtgacattttagtgcttctgttgtatcacaagtgtaccaatttgtgttaattttaacacatttattcttgcttaaaaattgggatgtatcttaaaattgattgattagaaagtattacggtgaattttcattggcagaattgttttttctttcctagtgatactttaaatcatgatgtgctttacatcttaccacccaaagtcttagatttgaggaaatatgatatgattgtgtcttatcttttatccctacatatgtgcagtctaatttcagtgtaggaataggaagtctcgtgtagcatgacagtgtaattgctgtatttgtaggtattaaacatcaatcaatgcctagctttgtacccataggcattccactttgtgcctgctctaaggcaaaacacaatattcaatgctggaaataatttcatatttagttttatgttaaagtagttcctcttagatttagtaaatagacaaaatattgattgaatgttcaaatgtagggtggaatgattgatttattcatttgggaggttgtgaatcattcctatatctattgattttgttcttcatttatattcattacctttaaattcaggaaggttattgaaaattcagggggaaacatttgttaggttgctaactccttcacactaaaccttctatgttttcttacatttacaagcagtctaataatccagtgaatcccttacatactgaatgttgggaaaaggtcatgacaggaatatctagttttcaaatcttggtttgttaaagatcagaaatcttccttccagatcttggtttgttaaaggtgatgatcacctaaactaaagcatactcagatgatggctgcttgatataatggagtgagcttttattcctggctcttataggagaaaatctgtaagtggtcaggggaaaatcgatttcaatgtgtactgtcaattcctttttttgcatttgtaagtgagaaaaaaattaggtggttaaaaggtggcagttttgagttattaagaatgatatggattagcctcaacttccatgggtcactacgaggtagccgctgatacttcacatctggttttggtttgcagtaactgacaaagaagcacaaggtatgtatagccctattgttagtgtcgttccactcttttaaagacaaaaagctccccactccaaaagtactgaaatattttcaactccaatttacagattaggcaaaacctcttgagttaagggtcactaaaggcagctgaaaaatttctttgcaaacttctcagtgttctggctgttaaagaaaaatagtaaaataaaaagagctccccagtgtaagaattccatgaaacagagagtgacgtgtgagacgcattaatgctttccattcctgatgaaaagctcgaacagctttaagtaatgtggaatccagtatctcaaatcctagctccgtctgggaggtgagttttgggtgtcctagctccctgggattggaagagcaacacgttgtctataggcattccatatgtgagtttaattatgataacttgacttctttaaagaagctttttagatgtttggggagaatcccactcaggactgtggtttttctttctcctgctttctttggggaaggagcacacaggaccatggttcccagaaacggagacacactctgtgaacctgtgcacgtccctgtgcccacagcgaaggcccctccagtgatcagccaggcccaccattgcagccttccagatggctctcattagagtcaaaattgactgagggaagcccctggggcgtcctggaagccttagagaccatgctagggacagagcctctgatttctaggagctaatgtttcagagaaaataataacagcaccttctaaacactagagcttttctctttagtaactcaaggtaatgaatccccaccctctccctctgcttctcatttaccacccctatttctctgcaagtcacaaaggggaaaattgaagttttctcacatctccttgggaaagtaatctgaggttgatgggctgagatgtttccagagaatgggaatggggtgccaacagcatggaggagcctggggagctgctggtatcaggcatagagtgaagaccaaagttagggatgggagaggagggtatctactctcatggggcaaagtgaccctgaggcacctctacatttaatgagcctagaaagaaaaagggtggaaaagaataggaaggaactgttgatgttcccttcttatgtcctttctgttgggtcaaaatactgttgtaattttggcatatttttctctctatccaatatgcaagttgtttgtttggctgaatactgcttcacttcttttctgcacctccagtgaccgacaatgcttagcacataggcaatgccaatcaagattgatgaatggatgaatgatcatacagaaggaatattttctgctgtagcaacgttgcaaaagtttcttcttaaggaatcttctgatggtatgccgatgcccggttgctatataacaactcactgcaggactcagtggcttaaaatcacaatgatcactttattatttagaatctctcatggttccagggcttgattgggctgagatagatattatttgcttggagtctcttataggtttgcagtcaagtgccggttggggctggagtgatcttggtttcttcatttatacctctgggggttaatgctggctgtgggctgggactgatgactggaacacctacaaatggcctcgtcacatggcttgggctttctccccgtatggtggctgaggtttaagagtggctgttcccaagaaaatcaggtggaagctctatcacctttccaaggtagccttggaagccacatagctgaacttctgctgtagtcacagcccaactcagattcaaggagtgggaacgtggacctcactttctgatggaagcaaagtcaatgtcactttatagaaggttatgcatgatgggacatcctactgggccatcttgggaaatacagttgccatggtggtatggcaaatgtctagaaatgcaatcaatataccattctaatggtttctgataagtacgtgtgaaaccaacccagttgcctaaatagtttggctggaaataattttaatcagagttactttggaaaattacaaggactaagttgtatacaaatgggagctcttattttatattgaaatccagataaatctgctgtaaaataatcatgatgccagcaaaatagaggatgtatactcatccactcatccactcattcattcattcgttcttacagccggtattttttttttattgactatccacttgcttacaggtactattagctcaattattgagacggaaatcccataagatacagatttgggaggcttcttagagaaaatttaccttcctcactgcccaatgactcaatctaagaagacagcttaaaaaagccacttccacagctcacagggcctgcagctagacttgggagagaggtggtgacagtggggagaagaggggtggggagcagatgacctcctgctctgtctctctctctcatctgttcatagatatcgataccatccattgtgtgtctgtgtttgcctgtgtgtctgtgtgtatatatgtgtgtgcatgtgtgtatatgtgtgtttatatgtgtctgtctttgtgtgcatgtgtgtttgtgtgtctctgtgtgtgtgcatgtgtgtgtgtctgtgtgtctctgtgtgtgtgcatgtgcgtgtgtgtgagagagagtgatgggggagccactggttcctcacaacttaagtcccagctgtcatcttaactttgtggatggtcagcaggcagtttaaaaacaaatgaaggcactgatgctgggcacgttctgttcagaactgagggactggctggtgctttggccacagctgggcctggccacattcctaaagaggagccacagctggctggactgaatgaaactggctgggcctgtcccagttccctcctgtcaactgctgttgagagaacctcacccatcccaggggagtcccaagttcaagtcgaactctgggctcttgaagggctctcctggactagccactgacacagccagtattgctctcccctgatactcctgggctctgtggccggcttcattcattcattcattcattcattcactcattcagtaagtgcttgttgagggccatcactgacacagtcatgagggaatcctggggttcccctcccagtgtcagcactggggctccgggaagatggctgccttccatctccaatgcattttaatttcttctttgaacaaacctgcaaagttactggttgattgaaaaaggaatattggcacaaatgaattaaatgacgcatcggggtcaccgagcagttggggatgaagccaaggtccctgttatcaggatgctgcatggactcttcccttcggagaaatatcacgaaggctccccgcctccagcgcgcgccagtggacccctcctgtgaagcagaggttagccctgcactcagggtcctcagttcctacctaagccagctcatcattagcaattcgtattgtgcatgctggcaatgcagagcccaggggcgctttttgtcgagccagcgtcttttatctgcagttgcaccccagcgaagctgggaccggaatgtacgactgttacagggtccgggcctcctcccatctagtttgcaatgcctctcacatgcaaaggttatgtttgtttccttttaaaaatagcagacgagcaggtgacacactgccttaattatccttctgtagaacacattgaaaactagcctccctgttctactggcagagcgagaggaaaatgtatcctaaaccgcagtgggtgaagcctcttcagatgtcggtcagagccttacccacacccagccccgcccgacagccgtgaacacagacaaacaactgtcacccattgacctcacgattccttggtatatgaaccaaagtggaagcggcgagaaaaggaaatactgcagatatttttaagtagaagcaaaggcaggaagaggaaagttgcaaaattggttatatttctttttgcttaagtgcataatgtttggatgaccaaaaagtcagtgtaaatgtataataagattattttcaaggaaatctgtatattaagttttaaggcctattttacttcatatatacataaagtaccatttttagaagtgctatactccatgcatattccaaaatactacacgttttttttgagaaaggaagggaccgtgaggcttttttcacatctgatatattacagtataatccatattcctcctataacacttagttctggaaaaggatctactggtgtctgagtttaggcaggcactagcactgacgtcagtattgtgtacagagaaaacaaacatactctacatttaccgaatttgatgcaactcacatttgggaacatattgaacaatctaaaattattgtaaagtggtaaatttttcaggctttaaaatcattaacagtggcataaaacaattatacaatttccatggacaaatctcacccccccagatttatgcctttaatcttatattcagatctgtgtaattcatgtttgctcctaaaacgtgtatttctttatgttctataataatgaacaatccaaatttttcaaaaaaaaaacaccatttctgcattataaatgttagatcttaattttaacaagtaaaaaatgagaccactttgtaaaataatgtcaattcaaggaatttaaatcaagaattaggcacactagtattctctctaaaggcctttttgaggggcatttagcaccctctagtgacaacaattcaagccgttcaaagggaacttccctgcacgactcatgtctggtttctagctggcaagtcaacaatgcagtgtagttctttaggcaggaggtggttgcttcctaaaatccttgaggcaggattatttttgtagctgtaaataaaggctggaataatctccaccaggcaaccgcgcagtgggaaaaccatgatttatccctatcggctataatattctttggcttatcatggccagtccactcagaaagaacatttctagtactccttgaacactgcagcctttcccaaaacatgtgctgagatctgtgtgggcatcagatgacaacaacaaatttactgatatcatcatttcagttcaggtcggtgcatttaacgggatttaacacattttcataagagtgaattggaaaagaactggcctgccttcacttcagctgcacctctgtgtcctctgcgttgcttgcagtgggagataatacagtgtggagagggtgaggtgtggagagggggcgagggatgaggagggctcaggtggagaggataccatgtggagcgtaccatgtagcagttactgcgctgagacagactcccagtgtcctgtgctcctgacttcaggcacgggtatagggcttcattgcatccgcaggtagcctggtgatactcatgcaaatataaatgaatttgtggcaaagattttttgccttcgcttcatttctgattccatttgtgatggaaataaattagtaaataaatcatcaaatgaggtgatgctgaattaaagcccacctcaaccgaaaactaaaagccaactttagaaagcagcaggaaaaattattaatgcaggcttctacatcaatttctatcaattgaatgctattatagtgccacttatgatctttctttaagaagtaatctgtattttctttaaaaataattcataaaatagtgacagattaagacaaaaataagtgatgctgtttagtatcttataggtgagattgacacacttcttaaaaaatcatttaaaactctgactagaatcaaaatcaaaattaatttcaacaacctgggataaattctcaatttggccaaggatggtgacaggggacagtacctgggaaaggatactttggatctgagtcgggggtagagtgggatgccagtcagatgcttttgtgaatcttaattatatgccctgtgggcatacgaagccttatgggcaccaatggcaacgtgatgtctgtagcatctatgctcagatatacccagttatacggacaaagaagttgaaactcatttaatggtttccaaattatatggagaagcctaataattggaacaatacatttaaaagttattttaagctaaataatggtgacaaaataattactctcctcttaggtttctttcttaaaaccacagataatacattgacctatttggagtccttgataatggttttaatattcctgcatttttaaagtcatatggagttgagtaagagcaaaattggcctaaacttgagaacgtgtgggatgcttatgaaattgtgtttattgaaatcattgctccatgggagcttatagaactgaactgacgtgtgcttcagtattaaggaaattgcaacttggtgttgagaagttgaggatttggtatgtgataacagtttccttggtttctattagttcagatcaaccaagagactgaagaatacattcaccacttagagaaagtgttgaaacaatggttatttaaattgtaattggattatttcttaatgtgctgctgggggatatggcactcccctacccccccacacacacaccctcatacacacactcacacactcatacacacatactcacatagttgtatccaatggagtgaagctgtaatcatgaagtatgctgtgaacagaaaaaccgtccttaaacagcgctgactgggtgcccttgagggctgagagtgtcttcatgccgcgtatgttctcaggcaaatcctccgactgctgcagatggaaaagttccatggagtgctggagttttccattgtgcggcagccccagatgcttgattcttatctacaatctcaggcatgttcctggcaaaaacccctgggacatcgttcttgcggggctctcatgaataatccaaacactatgcattttaaattcatgtgtcatcttaaggacaatatacagcacttttgtcctattgttttgtccttaaaaacctgcgtttcatgggtcgctcccaggctctgaagttttatgtgtgcagaatttgaggagactgagataggcttcccgaatgccgagacatgcggtgactggatagagccctgtaatcctggcttcctgagtgcccactggagttcctggcaggaaaaggccattaatatcacctgaatggattaatgccgcatagatggcctccacgaaactcttgagcgtttctgggttttcttaataaaatgaaaaaaaaaaagagctctatgcttgctgtagacatttaaaaaagaacaggcatttgggcatgctaaaaggtttgacacctacaagtattgtgggctgcactttttacagaacatgcctgtatttttcagatatttacaaaaatgaacaacattgcatgttacttacatatttttatattaggatataatttatgtttattacaaatttatgttttgaaaatataagtgaaccaaagaagaagaggggaaaaaacaaaaagcttctctgccattggtattataagatatagctgtcaatatttttactttgcctttttatttattttttattttttgactattacaaaaggttattggccgggcgtggtggctcacgcctgtaatcccagcactttgggaggctgaggcgagtggatcacaaggtcaagagatcgagaccatcctggccaacatggtgaaaacctgtctctactaaaaatacaaaaaattagccaggtgtggtggcgggcacctgtagtcccagctactcaggaggctgaggcaggagaatggcatgagcccaggaggcggagcttgcagtgagctgagatcacgccactgcactccagcctgggcgacagagtgagactcaaaaaaaaaaaaaaaaaaggttatttaacaaaaagtctaatatgaaaacatacatgacctaatttttacatatagtgaaacaggccctttggagaggggacatgggtttttctgttgaacagccattatttatactcattccaaagtttctaatatgatgatactatttccttgtattaccaccgttccaatactgttctgctgccaactagttgacatctccacacattcatctatgacaagattcataaagggatcgagtccccataatattccttggacatgtctgccaccattgcatttcatttttcaactcgggaaggttagcttcgctcatggtgtctattcctcaggttcacagatgctttggaacagaatgcacggccatccccaactgcctttttatttttaacaaaatgagtctatggatataattctcctatatactgtgattttttaactaaccaggtaaaatatcagagcagttttccatattgctaagtgttcatctacgacatcattttcctgcaatgtttttgaggaggaagggcgttccattgtagggatgtatagggcagggataaagacgtgaatgagtcatgagtgaatcttctgttgtgtccccacagatgtggaggttcagacggatctcctctctttgctctgcgcatgtattacattgagaaccatgtggctgtcattcagagtgttcttagctcctaaccttcctccccatattccatacagagaagttagtaagggaacaagaatgagaacttgttcgatctttagaaaatgggaagaaatgattttaggataaataaatactagtgtttcttttattgtgacagtgaatttatggtatatttatgttatattattttgtttctttctttggagtaaaatgtgaggagactagtggaaggttttggcagattcacaggggatgggtttgtggcagagaagcatgcaagggaaatgtgtgctttattcataggttctgctgtccacagctactgtatgggctgtgctggtctagtgtggtgattactgcatctcaaggagagtgaaaaaggaccctgccctgataggctcatggcaggacgggcctcaggtaggggccgtgtgccagattgccccctaacttggtccgcgtggtggcttggagggcatatttccctagggagaggaggtatcaggtgggaaaggcagcctggttcttaggctgctgggtggtgtagggatgaggccatttaataacatagacttggggtacaagtgaggaaagctagagtgatatctatatcttcagataatttccccataggataatatttgggaaacggtttctgcactgctatattctagttaatagatgtgccttggccgggcgtggtggttcacgtctttaatcccagcactttgggaggctgaggcgggtggatcatgaagtcaggagatcgagaccatcctggctaacatggtgaaaccccgtctctactaaaaatacaaaaaaaattagccaggtgtggtggcgggcgcctgcagtcccagctactcgggaggctgaggcaggagaatggcgtgaagctgggaggcggagcttgcagtgagccgagatcgcgccactgcactccagcctgggcgacagcaagattccgtcccaaaaaaaaaaaaaaaaaaaaaaaagatgtgccttgtcctatcaagagccaaagatttttttaaaacactttacattaaatagtcagagattaccaggcttggatgctatgatgccatttgaaacatcaagaattattctctttgaagacaacaggaatcaatcaaacattttgtcattagaaatgaggaggagtttcctttgtaaaattttggaacagaatttaccactcagtatccccaaattaactttttattagatcactttttatgtttgtatgcatttccaaaattagacgcagtaaaacttatggatcgaatattgatcaaataatagcatctgtttttctcttttttagtatccaataaataaatttgtctcttataaaacaatatttttattagttagaaaatgatggatatatgcatgcatgtatgttatacataaataaatatgggagagagagacagagattgagagagagagagcatgtgtgagagaaagcagagaaaatgatgtacattggcaccagtagacaatcagagttaaccaggcaaagggtattaggagtttggtgtattatcttgtggcttttctgtaagttggaaattatttcaaaatagagaggtaagaaatcccactcttcacagtttgatttgcattaggcaagaaccagggagttaaggccaaatcatcactgaagcattaggtcccagtagaaatgctgatctttcctgctgcagggaacaactgagggctggattagcaaccacgaggcgtgggtgaggcgggaccacacaggattttcttccgtggctatttcattagcaaagcgttcatcttatttaaagctggtgtttggtaaaggcataatcaggtgccatgtgttgtggaggccacagttaacattttacattgatgcttcttaggagagaacaaaaagcaaggacactcagggaagctgagagagcttttctcctccgcactccagaattctagtggaagctgcccagataaaacagctcaggactttgaaattttcggggaaacagaattttaatcagcctgccatcttattcattgttcagagatgaaaagagcggaaatcaacaccccctcataatgtaggtgctgagaacttaggttctgatttccacagaatgattttcttacaatatactctctttcttttcttttccttctttctttccctccctccctccctttctccttccttcctccctccttcctcccatcctccttcctttctctctctcttctgtccttcctttctccttctccattttttctcgccctcttccctccctcctcctcctcctctccttcctctccctttccccccttatctttctccttctcctccttcttttgtcctaacatgaggtgataaatcagaggtatataataaaagccagaatgacctgggctggtggacagaactctgacacatgccggcctaaagtctgagtgaaatccatttactgaacgtccagctctgcaaccaggaattgtcagatgactcaggatttagtctattgtgttcttggggtcgcctattgagaccacacctctttatgggtcctgcgttcctgtagctagattcaaagcaaaatgtttcttccaagcaatttcctgaaaatgagtaattaaagtcctgaaaccctctaaggaatgttcaggcctgcattcgctgtacttccttcgaggagaaaacagacctgtgaccctgaacttatagcttggattttagacatgtaatggggccctcacatggcatctctgggtagccaaaagttctatgaggatctgttgtctgcaacatggatgtctgtcagagtgagaccagctcactgatattccgggacatttgtagtcacttcagttatttgggttttaataaatacttgaaaacaagacttaggaaggtttatttttcctctttattttttgtgtttactgtaagcctagagtccttgcgttttcaacaactttgttgtagagcaaataaaaagtgcaggtatttggaaggagaaaatgaaactgttctggaacacttatatgaaatgttgaataaatataggttgttaaaaatcagccaggcaatggctgttactgaacatggccatctattaacatgaaataaactccacctgcaaagtttccttttaggagaaaggagctcaagtcctctgtcctagtaattctgcgaagaattgggctgcgaagggctgacacccagggcagtggggtgccctcaacgccttggctccaaggtgcttgcagcccgtgtgaagccatgcggagtcccatcacatctgcatcctgccttggtctcagtgcagtgtgtcacacggcggcacaccggtcacacctgctgtggcagtccccatcccaattgatgccttttctttttttaattaaaaaaaaaaaatctcctggctgcatatcatcaagaaaaacaacattgttttcagggtctcttatctctccactcccaaatatcctgtttctttgggctggacagccaggaccaatagaaacctcttcctgccattggctgacttcatttcccagacttagcacaatctcatccgctctaaacaacctcatcaaaactactttctggtcagagagaagcaataattattattaacatttattaacgatcaataaacttgatcgcattatggccagcactattaaggtaaggaaagggttccttttaatttgacaaaatcttgttcttgttactcttttctttggtttcctttatcaaggcagataagttagggttgggcaacacccccactgccacaatagaggacaacaagatttcctttgcactgcctagtaaatttcctttttcctactccaaccatccgcaaggcttaaaaacttcaaactcagaaaaaaattggggtttctaaattcactgttgagtgctgtggattacttttggaaaggcttttcggagcgcttctgaattttcagattctctaactatccctaacggtgcctggatgtgtgtctgagaaaaggcagcagactcggagaggttgaagggtcgggtcaaagcaaaagatgcgtttgtgaatgtcagacatttggaggctcttcagtggctccttagcatcagggatgccaggcagtcccagtggaagcgaagagatactcggcaagtggctgctggtaatgggacgcaaatgttgacttgatttgtgggacatccacgctgagaactgagtgctcacgtaactcaaatgggggtaatttggtttgttccactatatgtttatcttcaataaaatacctactgtctgtgcactgtgagtaagatttcttccagcaatggttaggtttgcggagattggaaagcaatggccggtcggttctctgtgctgtggggtgtttggtctgatgcatttccttgcctaagtttttagtagatagcatgtagagattaatgtggaggtaaatctgcacaggtacaatcctaaatatggcctgattcctggaaatgaagccaatttaatggtgactacaagtcaaggggcatgcagtcttgaatgggggtccgttcagttgttttaaaggccaccatgccttcgtgacatttgtagaaatgtgaaaaatcagcaacaaaagcagatgctgagtggagggaaaagaaaattgtgtttgttgcatgtctttagttttgctgcacggaggtgagaagcatttggtggtgttttcataaggcttttagtttgttggaaagtgcataagaaaatggaagtttgcccagaattgggccaagccattttcaaaaatactctttggtttggtattttcataatttgaaatgtttgtattagaagatttgactcatatgtaccatagaaactgtgtttgagaagttcagcttttatttctcaaggtgtgttcaataatatattaaaaatctgtgtaccaagaactttcaccttatacttttctttctttggcttcaaggattggaatctgctgaaatatggctcctatagacaggaattataaaattgagagttaatgtgccctacttgtagctacatgaatagaaattacttgattttgtgacccaaaatgttatttttttgttcttattttcatccttattcatatgcatgttaaatcaaatattctgtgtaaatcttgaatagcttgggtacgatcttatgtggttttttttcccaaaaaactcagtgcattaaaaaggacattgaaataacagaccatcctttagaaggtaggtacattttgcaaaacatccaaatgtgttatactgtttaatttgaagtatacatttatgaatacatgaagctattttgaaagtttgaatattttgtgattttctgaacacttttttggaaataatagtttacacttgtctaaggtactatgcttgatttaacattttattacattgcattatgtgtttattgtatgtacccaagtgaacccttagaatgactacaggtgaatttttttttaatcttctgttaaaataggccctctttataggtgacttcctttaagacatgtttctgttagatttcctgggtaaagtaatgagatgattttacagccttgtttatagagtggaaaaaggaggtcctgagtctgttgactacagtttcaattacgttagcgcaaagcccaagttagcatagggaaaatgatggctgtccactggaattaggaaacagccccccatagaggcaatttccagtctcaatgcactctgtttttttgttgtttcagtaaataaatcaattagtcgattaggtatcagatgctctgaattttttaagttggttttctgcatttgagtggagtttttatttttttgcattaacatttgtaagaccctatgagacactatgaaaagctaaatattcgtatccagtctttgtgattcttaccatcattttcccttggtaacttgaaattgggaacaaaatgtttcaattggaagaagtaaaggaattttgggaacttatgtgagagtgttcatttatctctaagtgtctgtgaattttaagatcagcttaagagttctagtaaagacttggaagcaacaaagctgatggtttgcagacaattcactgattggttttggtgcttcccttgggcattggtgacatctgacaatattgagaggtgctgaacctcaccggccccactgtccccacaaacatctcagtgtttgctacagactgcagggatcctgctgttgcactgaaaactcgattgtgcttcagttaggagttttagcctaatttcccaaagactttcctgattcctttttttttaatgccatctgcaatttgggaagtctagtgaagcctacagtcctttctcagaataatactttctggtgcctaaaaagaaatacatagaattacaacagaaatacagtcctctccccggaccttttaaggagaacatgaaccccaggttgcaagttctgatcctagaaagatacttaatgtgtaaaaagggaatgtgggggattttccatcatcacagagatctgacattgaaggatgtggagagagccagcagccggcagcagcatcaggggaaagcatcttaaaaatcagacaggacatggaaagttactaacaaggcttggtggagacctgagggcaccctagtgctatttccatgacttgcctaaagaagttacttttttttgaattaacagaggttggaaggtttgatggtaattgaaacacgacctgataggactcaattttattaatttaaagacataaagcttgcattatatacgccacgtctgcacatttgcacttcttgaacgtttgctatcacatgtgagggaaacttaattaagactaagagttatatgaagaaagttaactcctcacagaattttgatggatgtgattaatgagtttaatagctacagatttatgatttttcatcaacctgttggctaagtgaaatacgaattgcgtcagtccttgttactttagggggattccgggagaatggaaggaaggccaggggcaaaatgccgctgccctgctgtgcataagtcatttcagagcatgctctgagtgtttgtccttgccgaaaagtggctttacaggcaactactttaaaacaacttgctgcttccgttcttggtcagctctgtgatccaggctgccctctgtggacacagcacagttctccctggccctctgcctgtgtgtgcatgcacccatgcatgccaggcaccctgactcagtgaccctggaaagcaggattgagaatggctccatctgtgggcttttcttcccccatgaaatacagtgcaggactgcaatgctctcagacaatgtgctgagcctgaaccatttcttaattatctacgtttataagtgattatctcataaagtttttgttttgcaaaacagatctttatttaaacacaaacacaggttaacaactcttgaaaaagcatacataaaaataagtaaatgaaacaaccatttctgttgtcttcaggaaaatatgactgatacatttagaactttagaataagattccctctgtgggagtggagacccaaagccattataggcatcccaacaatttggcggatttattggtttaacagctgatacataagagaatcacagagtaagggccatggggaagccagacggatgagagtttctctgaaatgagaaacctcagagaagagacagggacagtctccaggctgttccagcgtttggtagcacactgtgctctggcggggtcttttctttggagctacctcaaggagagccttcttgtcccctcctttgaccccacaggatagaggacaactgctccctggcctggggattctgtcagaccacccctgatagcgcttctctcaccttacgtggccgcagacacacttgcatttgcttccttcctgttgtgaccctgggcaaggtagctagcctgtctgatctcagtttcgtcacctgtaaaatgggatcataatggctaccctgtctcgcacccatcctcaataaatggcagatgccatcagacgcccccccgcggatgtaaccttttctaccgtattgtctttcaggctctgcactcactcgtctcaacatttcccacggcccagcttcagctgtgaagcccacagccatagactgctctgatgtgcggcctcccacacccaggcagggtacatctgggtctgggcagccacaggacagggaaggaaggaggagggagcttgcaggggtgcttgttaaaggtgtagcagggcaggtaccacacacaggggcaggtggagcgtccaggggtcgcccgaggtggtgctggtcagagagggttggcttcgtcctgttctgagccgaggctgctggaggagggcagaggcctatgactgcatcgtgctcctggttagggcaggaacagcaccctggaataccccactctcctctttactcctgaattacaaaaaatacatcttgttctttagcataaattataaacataaaaaattcttatggtagagaaaacgtttaaaagtcatcacaaagtcaatataaattgttcagatcctaaccaaccacagcaaattcctaacaattgggatatgtctctccaccgtgtgtatctgtttggccttgtatctacctacctgtcctgctcttctcagttagcattgttttacaagcattttcccatgttactaacattttttgataagcaaaatttttgtttcattatattctatctaaaatatgtattaccattttataaccaatatcctagtgtataaagtgatgctgcttgcgatgtttcactcattatattgcagtacaccatctatttaattttttgaatactttttattagtattggtgcctagaaaggaattattgagccaatgggtatatatattttttaagtctttgccaaatttaaatatttgccaatttaaaaaataattaccagattattctctggaaggattataccagttctccctttttctagccacatatgagaccagttccacactacacccataacaactctgaatattttactctttgaatctttgccattctgacagataagaacagaatctcatttttatttgtacttctttaattttagtatttcattacatttttttgtttgtttgctgtgaacccattttggctagtggtccactgtgacctctggattttttttcttatttatacttttattctctgtttggtctagcttactttccacatatttcccctactgagcttggccaagacatgttttataaaatttcacatcgattcccatctgtccactctcccactcttcattttctttcctgtcagcacattctcccagctttgcttgtgtttgttgttgagtgtgaataatttatgtatacccactgatatcgcagaagctgtttttagtgatatcttatccatttcttctgtgtcctcaacagtgactggcaaagagtagaggttcaataagcacttgttgaaaacataaacttaaattttaattatttgaaatcataaagaggaagttaagatatcagagtaatgtaattatcattgtagacttcaaatagaattcttatgtttttagagacatttctcctagtaaaataacgttaattaaaattgacttaaattgatgtttaagaaagtataaaaaatgtagctgtagtatcttgaattcataatccaaactaacatcatcctaataactgcttgttatgtgccaagtcctgtgctaaactctcataatgtctcatgtgatcctcacagcagcctgggtactgctgctttcttacagataaggacaaaggattagagaggcgaagtatcttatacaagtcacacaaatctgtctcccttctctttatcatctgatctcttttttcctgctattcaccctagctgtacatagtgaattactgtgcagagaaacatgatgtattaagtgttatggagacacatgaaataattggataatgaaaattattatcgctggttactttatgttatctactcttctgggaaaaatcccataggcagcaattcttatactctaggtggctaatcaaaacaaagttctagaaaattcaagaggtaaaactctagcactgaattctatatttgctcagtgacaagaattctttccatatttggcgagatccaaggggcagtgcttccagattccagatcagctgctgatttaaatttcctcatcccaagtatcaacttccttgcactcgtcttgggcgtcaataatgaacacgcaggtcagagttttccataaggccttaacaagtctttcagcagggtgttcatggaattaaactctgggaagaacggtaatctgctgttgtacacagataagtacagagacattttgaaaagaaatgctaaggccaagcaaaatgatttatttttaaagtgccacatcagaatccaatcataacattaacctcagggctgttactttaaacacgtttggtaaaaacaatgcttgtcgaatttttgaaaatataataactttatgcaaagatcccgcactcttgcatttaacacattccactttttaaatccttctgccttgatgatttaaaatctcccttgctggtttttttgttttttaaatttaccaagtattgatacagaatcagcactgaagacaggacccttctgctacctccacattcacattccccccaaggccattcattcagatcgtcagccagcagtgagtttctcatctccatgctctttgggtttcatcgggttttattgggtctttttttttttttttttaattttgacagtgtgcacatgatgctcacctttgaggaagaagaaactgttgaaacaacactttagaatctgtcaacacaattagtttgtgtctcaatttgaggtagatgtcccaagacattgctccaagttaaaaagaaaaaaaaagtatgtggttttgcattgcgtagtcctctttggatccatacgatatgtgtgccttccctgaccttccagagagcatcaaaaacatgaaggttgaatccagagagcacagcccacttttatctttggcccagggaggcacttggtactctgtatttcttcgtggcatccttaaaatagcctctgtggaaaagggattggccttatcttccgtgcaacggatgggaggcatagatatagctgctggcaaggggaagtggaaagaggcccatctgggagagggtggcccggagctttagtttgatgctgcaggacttccccaggtgaacgcacctctcctggccctagctcccttataggaaaatggaggtggtcagctccgccttctccacagtgaccatctgctgactgtgctgctgccaggacgcagggggagctaacagcagtgcccctatcggatcttcaaaccggggaggggtctcgtgcagtgggcaggggaaatgggctcccacctggcttttggggttcactccctggctgttctacttcctggccatttcacctttggcaagccacagcctcacaggagataggcttttccatcggtgaaatgggtagagtgatagttcctacttcacagggttatagtgagattcaccaagtcgcaagagcccagaactgtatatggcacacataagctcctcaatcaaagttagttaattttactattcattcaagccaaatacatttttcttctaagactaaaatcagggaatctatgaaaagcatttccccctaccttttttttttcaatttctacaacagtttgtgaattgaattttgttttcaattagccaatttgtccattttcctgtgatgaacatgtttttatctcttcattataaagtaagaactctgacagacacagtgagctcccaattattcacgagcacctgatctgcattggagattgcttaaaacagggctgggaaatgcttgctggtgagttcaccggacactgcacagcaggtcctggaaggagacattcagggcgttgttaacttctgtgtctccctattcttcttattctccttccatactctttctctctcattgcaatcgctatccacctggaaggcggcttgaaaaacacaaaagacaacaaggatgatgagggggacccctcctgagcctcttaaatgctgagggatccttcctggacctgtttttattcattccaagctgcctctcctagacaatcacttctcttaccccaggaaatctgggacggtgcaggtttgcaagcttgatctggaataaagaaacaaaggaaaagacggaccaggaggcttggcctacgccaggcaaaagtcagcaaaagcagccactacacatctccttttgagttctaacttttcactttgtcttgtgtgaactcctaaactggaagcatatttatagtcacgtaaaaataagaatattgtccaaggccaaatgtaagtgacttttatgagttattggactttgtgaattactcattctaccaacctgaattaacatagatagttttgttgactttaccttctttgtaagccaaacagtatgaactcggttaagccggtcttaggagaaaagacataaaatgtgtgttgctaggatagcattctagtgaaggaagccacttctttgtttcttgtgcatccctgtgagggtacctctgtccatcccaagagctgttttcatggactcactgttgaaagcccaagcctattgtaaccaattttgataagctggttacaaaataagcacatgtatacattttttaaagccttgttcttctggagatggaaaacatctttttttagatcacatgtttactgctttggtaaacagtaaaatgctgctacagcaattaccttgaggataaagggtttgtagacagatacttcctgcgttcacttcctacacagatagccagcccaaccagagacgcactgatgcaggaagggctcccagtggaaacttcctctctccgaatgcgtggtccattattcgttatctcctctccaaggggaataagcttgttgctccagattttctaggagaattctgtcttgaaacaggtaaaaatataaagtttctaaagtaatgattacagtacctcgttctcatcctcggtgtcatctactcggtgatttttaaggggacgtgattagactagaatagacttgtctatgagtaacatgccccgtaggcacctctgtctcctttgaatcatggaaaatgatgcataattcgaatgtttttatatttggtagaaaaataagtctctttgagattcaatggaaggccttttctatggttagttgaaaggtcattttagattttgctttctttagtcaagcagagattaccagatttgggtacaaaaaatatcagctcacagattgttctctgtgctgattttacagcagttactaaattccaacgaatgcattgtttaggccctttgaaccgaagcaaataaaaccacagtgcacacacactaaacaatagggcatcatcaattagccatctacaggatgtgtccttgcagactggcccctttgtaggagaaaaaaaaatagatcaagtcaacaaacaataacactgaacaataaactaaacaaaataaatagcacctgggagccccttaagcactggcgaagcaccaaagggtgatgtttacacactgtacacacggaaacccacagctccacccagatctcctgcaggtccctaaaatactcaaagaactcagcagccaatcattgctgggtcacctcatgttgaagggtaccccctttggcgatcagaaaatgctgagcctcttaaatgctgttttcattcactccaagctagctctcatagacaatcacttctctcaccccaggaagtctgggacagtgcattgcgaagggaagaaggcagtatctaacagagccttctgcctggcctattccataagtgccgatgactgccaggtggggggcagagattgcatttgaccccgagagactgccagacatggtgagatgctgtcatgtctcacgtagatgttattgcacgaatatattctagtgattttatccacatattcaatatatgtattttgtatttaacatgaaattgaattgaagtgaaattgcccaaagagatattttcctttagggactcatttcttcacatacttttgcttatcttgttggaagacacactatgtcaatctcagtatcctgtttgaatgaagactgctttcctcctatgtatctgttgcccctagacagtcattgtgcagcttgttacctttctgtgaaactccatgagacagctccagcattcatccttacaggtgctacctcctgacacttctgcttctttgcaaaatgacttccctgatctcctgagtctgtattgtttccagtgctgcctgaaccacatttgggtgatgctacaggaccagacagcagacagatttgtcatggatgcctgatgggataggaccctgttggcatcctctctgaaaatctcccttgcctggctagggattgttttattttattttctttagcctgtagcaaatacaggttcagtatctccattgaataatatattgtagaaagaaaggcagtaataaaaacttcgttctttttccccatttgaaaaacaattattataggagtttagaaaataaaaattttaaaaacaaaattaaaataattgatgttacaccatcaagggtctttgaatactcgattcttttttgattttttttgtctttactcctgtaccaatgtatcctttttaaagaataataaaatttgagaaattaaactcattgttattagtacctttctatccacttcttttttttttccaggatagtgaaaaaaaaaaaaaaaagaggagtgagggctgaacttgttacgatttagaaattaaggcccattttccttcttaagaacccagtttctctatatgaagcagatccagaccgcaggtccctgtcccaccacgcctttcacttccctgtgcctcgtttcctcatctgtagaagagagtcagtcatgataataactcctacttcttggtagtgttgcaaggattaagcagcttaatacttgtatgtgctttgaacagtaacgtgctgtagtgtacaaaagatgtaaattgcagaccaggcatgctggcagctgcctgtagtttcagcttctcgggaagccaaagcaaaggatctcttgagcctcagtatctgaggtcagcctgggcaacctggcaaaatacctcatctcataataataacaacaataataataatgttagctgttatgggctgttattggttacttatcctagtcacagtcttcttatttaatttactctcatatctcaattgtttttttgaagtaatcaattatcttccttgattgtgtttgtttccagtatttgtctttggaaaggaatcctgcatttatacctggttatttatagcttcttctaaaggggtgaaagtatttccctacacagtcatgcatcaccatgcccggtcagttctgagaaatgagttgttagatgatttcatcgtgcaaacatcacaaagagcacttacacaaatgtacatggcatagccggctgcacacgtaggctacaggctataagtgtagcctgtgctcctaggctacaaacctgtgcagcatgtgaccaggctgaatactgtaggcaattgtgacacttaacacaatggtttttatgtatcaaaatgtgggaaaggtatagtaataatgcagtagaggccaggtgcggtggctcacacctgtaatcccagcactttgggaggctgaggcgggcagatcacgaggtcaggagatggagaccatcctggctaacacagtgaaatcccgtctctactaaaaatataaaaaattagccaggcatggtggcacgcacctgtagtcccagctactcaggaggctgaggcaggagaattgcttgaacctgggaggcaaaggttgctgtgagctgagatcatgcctctgcactccagcctgggctacagagcgagaccccatctcaaaataataataattattattattaagaagggaaaaaaatgatacacctgtacacctgtataaggcacttaccatgaatggagcttgcaggatggaaagtggctgtggatctgggtgaatcagtgagtggttagtgaatgtgaaagcctaggacatcactatctactactgtagacttataaacactgtatattggccaggcgcggtggctcatgcctgtaatcccagcactttgggaggccgaggtgggcggatcacgaggtcaggagatcgagaccatcctggccaacatagtgaaaccccatctctactaaaaatacaaaaattagccgggcatggtggcgcatgcctgtaatcccagctacttgggaggcggagggaggagaatcccttgaaccagggagttggaggttgcagtgagctgagattgcgccacagcactctagtctggtgacacagcgagactccatctcaaaaaaaaaaaaaaaaagactgtatatttacactaaatttattaaaacatttcttcaatagtaaattcatattagattactataactttttttacttattaattttttaaactttttgactcttttgtactcacttagcttgaaacacaaatacgtggttcagttgtacagaaatattttcattctttatatccttactcaataagctttgttctattttttttttaactttctaaactttttattaaaaactaagacacaaacacatacattagcgtaggtctacacagggtcaggatcatcaatatcactgtttttcatctctacatcttgtccctgtgccactggaaggtctgcagggacaataatctgtgtggagctgtcatctcctacgataacagtgccttattgtggaatccttcttgaaggacctgcctgaggctgttttacaattaactttttttttttttggaaatagaaaaagtacactctaaaataatgatgaaaagtatggtatagtaaatatgtaaaccaataacatagtcaactattatcattatcaactattatgtactgtacagaattgtatgtgctatactttatacaactggcaacacagtaggtttgtacaccagcaccaccaaaaacatgtgagaaatgcattgtgctacagtgttactacagctgtatgtcactaggccatagagatttttcagctccattataatcttatggtaccctcgtcctatctgcagtctgtcattgtccaaaacatcattatgcaactcctgaatgtatgctaattgctttgttctcatgctattcctttgaggacagtagagaaaacataagagagttacaactgttattccatttggtggctcaactgacatgttaaccaaactttcaacagctgaactcaactgcatttttgtgagcccagaaaatcagtagttttgataatttaaagttggagaaatgaaggacgttcattgtttcctcccattcttatgctttgggtgatgctgttaaataaatgaatgtgtttgtgcaatggggagagaccactgttctctggagtggatctagaggttaaaaagtcaagctattttgaaccaactacttagagtggcacattctttaggggaggtgagcagggatctattgaattatcatattgctggttaatcatgattaagaatctatagaaccccgaccgggcgcggtggctcacacatgtaattgcagcactttgggaggttgaggcgggtggattgtctgagctcaggagttcacgaccagcctgggcaacacagtgaaaccccatctctactaaaatacaaaaaattagccaggcgtcaagaccagtaactcaaaacgtgtgttgttaaagttctatgccttaagttctgtggctgttgtcatgtaacctttcagtcatgctgatggtgcctattaaaaagcaggctatcagtaaatgtccatttcataaatgaataaataacttcctgcatgacaaatgcatgagtgagtgcatgaatcagtgatgtggctggcaccctatattaaaatcacaaagaattgctgttttttaaaaattttttatttttttgagacagagtctcactctgtcgcccaggctggaatgctgtggtgcaatcttggctcactgcaacctccaccctctcccggggttcaagagattcccctgcctcagcctcccgagtagctgggactacagacgtgtgccaccatgcccggctattttttgtttgtttgtttgtttgtatttttagtagagacggggtttcaccgtgttagccaggatggtctcaatctcctgacctcgtgatccacctgcctcagcctcccaaagtgctgggattataggcgtgagccaccatgcctggccgagaattgctttttatatcatgaaagatggagtccattttccccagatgcatatacaattgttatataccacttatattaacaaatccatacttttccaaaagagtggtttgaactatgactttttgatttattttttaaaagttttattttatatatttaaggtgtacaacatgatgttttgatatacatgaagatggtgataaggttctgatagtgaaggcaaattaacatatccatcatcttacatggttacacattctttttttgtggggcaagagcacctaaaatctactcttaaagcaaaaatcccaagtacagcacagcacggtattattaagcatatcccttatggtgtacgttagatctctagacttgttcaccctgcatatttgctactttatattctttgacctacatctccccatttccccattgagtctttgtttgtttgtttgttatagattttacatataagtgagatcatgcagtatttgtctttctgtgtgtggcttatttcacttagcataacgtcctccagattcatccataatgtggcaattggcagaatctctttttgaaagctaaatgggccgggcatggtggctacgcttgtaatcccaacactttgtgaggccacggtaggtggatcacttgaggccaggagttcgagaccagcctggccaacatggtgaaagcccgtctctactaaaaatttaataattagtggggtgtggtcgtgggtgcctgtaatcctagctatgtgggaggctaagacaggagaatcacttgaacctgggaggcagaggttgcagtcagtcgagatcatgccactgcactccagcctgggcaacagactgagattccatctcaaaaaaaaaaaaggctaaatgatattccgttgtatatatccaccacaatttattttatgtattcatccattgatggacactttggttcctttcatatcttggctattgtgagtaatgctgcaatgaatatggcactgcgggtatctttacgagatagtgattacatttctttgggaaagtacccagaaaagggattgctgggtcatatggtaggtctatttttaatttctttaggaacctccatacttttttccacagtgtctgcaacattccatgttcccaccaacagtctgcaaggattcccttttctcacattctcgccaacacttactatttcttgtctttttgaccatagccatctgaacaggcgtgaggtgatacctcattgtgtctttgatttgcattttcctgatgattagtgatattgggcaccttgtcgtatacccattgttcattattatgtctttttgggaaaatgtctatccacgtcctttccctatgtttgggaaggtcagatgaccgggggctgcccagaatctaatgagtgctgccgagtacatgatggtcccttccaggccatggatgggaatgtttcacttgtaaattaaaagcaggaatacagtttccaggcaacccatagcctgcattttgctacatgacacttgccttgatgagcaaaaccaaacaccactttcatttttattgagcagcaacacctaccagcatttatccaggatttgcattgggtcattgaaatattcgactttgacaatctattatataataagtctttctggacatgaactagtgacaagttgtattaatgtgctatgatagggactattcatttttcttcttttgttactacagtcacctctttgaaatgtcagtgaaactgtagcaatcttttaaatatgtctgctggtgtctagtatattgattcacactgagggtttctgtattcattggaatcaggcaaattacaacacagtacttattatataaataacatctctaatggatatgagatagcataacattttcaataatagctacgtttgtttttgtattcagtttcaagatgatctgctttataataaagattaattttagcaagtaactaccagcttatctaagccaaatagtaaaactgaaaacccttctgtaaatttaagattatccagcatattatttaacttagtgagccttactggttaaaacattatatataggccaatgaaaatgtaatctttcataaaatctgaagtattctattatcttgataagatttttagtggactgtttctttaatcatttaagaattcatatcaccattgtttccacagcgtccgcatgtaaagtgctactctgtttcctgaatgaatgaatgcatgaataaatgatgcatattgaaatctttccctgagtaaagcatgcatttggcaatgtatgtgattaaaagaaatctgacttggttcctctcctagaagaactataatctagtttttaaggagtcaaataaaaggaaatgacctttatttgagaattaaaatgttggaaaaaacttgattggtcatttaggagttcattgtttctcaacctaattatattttggctcagtatactcttaactgtttttaggataattaaaaggaactcctaagagagctaggatgctgttggaggagtaagtatgcatgaaacaatcataatttaactaatttgcccacaaatgttagcaggaaaatataccaaaaattagattttgttttccattcgttatttttcttaatttctaacataatttttaaacaaaactgagagatgtttgtcaaaacacctcccaagtgatgatttccattagaatatgaactagacacttttcctccagtgggataagagccagattttcctaatcacaaaaattagggcatggtcaggcaaaggagtttacatgaaaagttttgcaaaattagtattactttgaaaatttcaggctatttggccactgcaaccagggagtcacttaattcttggcataaactccagcacttttggaaattgacctaactctataaggcaaaaaaaaaaaaaaaaaaaaaaaggccatatagtgccctaaagtggcaaaatttttgttaaaaacagcatccacaagtactgttaccagtttctcaggatagctgtgacaaattattacaacctagtggcttaaagcaagagaaatttattctgttatagcttgggagtccagaaatccaaaatcgaggtgttggctgggttggtcccttctggaggctgtgaggaaggatgcatctggtgcctcctccagctccgggggttgcctgcaagccctgtgttccttggcttggacagtagtcctctcttatccgcgattccactttccatggtttctggcagtttcatctgctgtctgaagatattagatggccatttctagaaataaatgaatcatacgtcttaaattgttcaccatgctaagtagcatgatgaagtcttgtaccatcctgccctgctccacccaggacatgaattccccttttgtccaccgtatccatgctacagatgctacctgcctgttagtcaccgagtagccctcttggttatgggatcgactgtcacggtatcacagtgcttatgtgtaggtagcccttcttttattcagtagtagccccaaggcacaagaggactgatcctggcaattccgggtatgttaaagagaagccgtaaagtgctttctttcagtgaaaaggtgaaagttctgtacttacaaggaaaaagatcatatgctgtggttgctaagatgtacagtaagaatgaatcttctgtctttgaagtttgaagaaataaaaagaaatctgtgcttgttttgccgttgcacctcaaactgcaaaactgatgaccacagtggatagtaagtgcttagttaagatggaaaaggtattgcatttgtggatggaacagaaagtgttccagttaatggcagttgggttcagtcctgtctgaggtttcagacatcccctgggggtcttgtagtgtgtcccccgtggataaggggagactgctgtagatgcatcccttccgtctctgcttttgtcatcccacgaccttcttctttatgtttctgtgtgtcctgctcagcctcttatgaggatgctctcactggatttagaacctaccctaatctatgatctcattttaatcattaattacatctgcaaagatcctacttctaaataaggtcatattctgaggttccaggtggacgtgaattgtggggagacactacttagccagctacaggtgggaaggagaccaggcaggtctcaagggtggcagcttcaccaacaaacaacggttgcccattggaagagccaggctccattcactgatatctcccaacagaccaggtcctgatggcaagattgttacactcatacttaagtataaatcatttatgtgcaaacaacattttgaaagtgccaatgcaattagttttgttgatgaaaaaataaaactttatagcatggatattaaccattatattgttaaatccagcataatagtcaaaataaaatcactgtaaggcaaagtgtttactctgcaaccatttcagtttcacaagatactgagtatgatgttgtggttttccttatctcatcattttacttggtaagtgtcgagacatgcaaaagcttagggcagcccacacagttcgtcagaagcacacgtggggagtttgttacttaggcagccagtcacccccattctatgtgtcaagcctggactaatggatgacagtggtgattacatcctatgaaaaatgattcatgtggctgtcttcaggaaagtcttcacgttgcacctacacagtcctaagactgaactcataaaacggcatcctatactaatattattgtcaaacactatgatttctttttgtcttctgtctttgatatctgcacctaaatattcaggtgttactcattcttatgaaatgggtcagattccaaataaaaattgaagttcctcttatcactgaccatgagggctctgcaagattgtcttgggaaagaagatttacattaggagctaggtcatggattcttgtcatgtctgtgtgtgcccttgtctacgtccaatgcacacaggatgaaaaactggtcagctcacgtgcccatagcccatcttcacctcacctcaagctaagacaccaagaaactcccagtgttcctgggagaaccaggccagtggaatcctgggcttgcatctaatttggctgcaaaaatggagatggtgcatatccctgcaatgtgagagtcagtcccacttgctctattttcacagttccttctctgtacagtaaggattttcttagtcttacaaaggcaggaaaaggaacagttaagcatgtaaatgcaaaccatgaaaacaagacctgttgccaggatatcttgtcccagggtacagtagtacttcccatgtaacacacatcctctaccatgccactctccaaaactgttattggggccggtctggagtccagcatgagtgagatatgtcatccttataagtgagataggctcagcctcgttgtgtgcaaacacgtctctgaggcctggagtattatgacttacctactggaaaaagagaaactgggttcaagggagagataagatcgaatgttaggatggactattttgatagctatctcaggtcatcatgaagattgcactaaaaccttggggagataaatttgtttaggacatgctaaatatatgttttccttttttctttctatttaaaaaaatctgagttgcagtcacattaacaggtcagtaacatagaggtttggttccctcatatgactttctgcatgtactttacatttttttcttgtttaaatgctaggcatattgtgtaccccacattggtttgtagccagctctatgtcatagggcccttaccctttacctatttattgttagtatcatgtccataaacaagccaatggctcagcatgaactgatgctaaagaaagctcatgcctgagtgataaattaagtgacctcagctatttctcttcagtgttgtgaaagttatttttaacagtaggtttcctggtagattctctaaccactcggtatttcacatggcccaacttggttaactcgactggttacggcaaatgctgataaaggcaagatcacaggtttgctccccatgaaaaccaataacttctcggagattaaaaaaaaaatctcccttctgtgaccacaagcagcatcactcatgcaaatgtcggaagagaggaattgggagtgagtgagagtctagcccagtgcaaatatttctactgttgaaaaaagaagtccaggcgcagtgactcacgcctgtcatcccaacattttgggaggccaaggtgggtggatcgcttgagcgagaccaacctagccaacatggtgaaaccttgtctctacaaaaaacagaaaaattagtggggcatggtggccttcgcctgcggtcccagctacttgggaggtggaggtaggaggattacctgagcctggggaggtcaaggttgcagtgagccatgagcgcaccagtgcaatccagcctgggcgacagagtgagactctgtctcaaaaaaaaaaaaaaaaaaaaaaaggaaagaaagaaaagaaaaaagaatctctcaagcatcaagttgtgttcctataggacacatgggtttctgcatgaaagcaactatgtccagtcccctaaacctggtgattttattggaaatacctccagttaatttttacgctaataacctcagcccactcacaccaaggccaaaagttaccagagttatgaacagagccattgcccaccttttccccctaaacgttgttgttggtgcacatctgcagaaagaggccgtttacgtggaatttcaaatctggttgtttagtctacaaggaggggggaaggattctgtctctttaatgtttataacggttggacagagcttgtcgggtgaaggttaattgctctccagtttaagcagttctgtgcccagatgggttatcagggctgaacactcgttacaagactaatctcatttccgacaagacttccctttccttcaactgatttttgcatggccattggagccgtcatcagccgttaagaggagggtggattactctgggatattaatgctggtatgtggtgaaacaatgcggagtggtgttgtatctcagggaacatctttaggagaacatgtttcgctggtgttacgaagagccaggctcctaaacctaaacgtggagacaatgggacccctgaagcgaggcacttggtgaaaggtgtaggggcgattgcagcccgcctctctctgaggaggaccctgccctgataatacacagcgacacttagggctttgtttgcttttgaagatttttttttttaacgtactacgttcagattttcattcctaaggactacacctaagcagcgaggagttctgtttgctgctgccacacggagccctgtggcagggagcacctgtgatgcagcaacttcatttaattcctgtgaaacgtcaggcttctctttaatttcagagatttcatagatgtcatcatgacatatttgcctgaaaatagtaggcagatttttaaaaatttaataacaagtagcttcctttctttagtttgtctcaaaaaattcttccaagaaatggcagaaaggcaatgtctttttatccctttgggatttggtgtgtggaaattgactcattcatttactcactaaggatttactgggcacccactaggctcatgggtgctgaggggcatgagcagcaggacagctgggctcactcagtgctgtcaatcagggggatgcagatgggggagactgacaaatagatcacagctcaacgaagacagagtgtggcaggaagtcaggagccttaggagggaaggtagggaacatgatagagccaggtggccggggggcgggacctctagtttagagaacatgatcaggcaaggcctgtcagacagagacccaaagaaaaggtgagaacaaggtttgcaaatgcctcggaggagtgatgcggaccaggggaatggcaaaggcaaggaccccaaggcggggacaggcagagggtgtctgagagcagcacatcctcttataatctagtttcacagaggaggctgtcagaagaacagccctaccctaaggaagggtccatctgctttgattgtaatcgggcacagtcctggacaccgagtccctttctgtcaggtgcgaaaagcttggggaatgcatcttggtcatgggttgctactaaaatgagcgtgtcatcttcaggggacaggaattaaaggcacagagaaaaactgaaattatttagcttcccttcccttctcccttcttcccatctcccatcccttgccactgattatggtggggctggctttatatattctctagtttctcatatgttgacttatttttgcagtcgtttcagttctaggccatttggtgcattatgttccgcgtttatgggcatgcgctttggaaccaggcagctggcttagaattctggtgcattaactggcaagatgctctaggcaacttatttaatttttggagtctcagttttcctcatctttaaaatgggcataatggtagctagtgtgcaggttagatgcattaattcacatgtgcatgtcttttagagccgccacgctgtgatcacgttattaaatgttagatgttatcaggaaggtcctatattgtctacgatgcttcactttctttgattcatctgtttcactgagaaaagtgagataaattatcattaatctagagacatttttgtaggctaaaggcttcttatcacaacgttttctccaaaaaataacgaacagacaaaaaaaaaaaaatggagccaagtctttcaccgtatttgtttgtttatacaagggctatatagtcaccaccttccatacaggtaggagtctcatgactttttggtgaccctttcagagcaagggttatttctgccccacaggcatcatttgacttagtgagattttcaacacaccctcaaagcacatgttttttagggcaaagagttgaggagaagagaggcagggtgaaagtctgagcctttggtgcagcacctctgctggcttctgagactctgtgtcacccaggggtgggaggacagttctctccagggcactcatcaggaccctgctgcctgtggtcatgagacaaggagatcatgtgtcacaaaggcactcaacatgcagaggcggtgtcgcctgtcacctggaggggctgcacgcaatgaacttccagtctccatgtgacctcccacttcttggctttcctactgaggaatttgccatttcctgtcgagaagtccagggtatacaggagcagtaaatgccgtggagagggtgggggcgggagaaccacaggaagtcctcagatatgaccatttgggttggtggagtcgggaccaacaatgggttttacctctcacagttaaactccattgatgatgcacagttgacaagaattgcccctccaagatctcattgctgtttctgggaagtaaacgctccttaaaagatttacttgtgagtaaacttctaaccactcttctttagctgtctaaggaaaaaaaagtcagttggctcatgttttccaacttacttcctattatatacacacatacatatacacacacatacacacatatacaacacttacacacacatacgctcacacatacacatgcatacatacgcaaacatgtacacatacacatgcatacgtacgcaaacatgtacacatacacacacacacacatatatatatttatgcctgtttagatccaaaatcacacactttatatagataaaacttaagtgaactttaatatctgtaccatacatttaacttcatttcacaaaatagtaatatgtccaaaccacgtctttcaaaaaaaattttccctctctcaattattttctctgagattacaaaggatatcttctcctaggatttgtaaatgcatcttaatttttgatgctcccagatttgagtcaatttcccctacgtgaagtgaggattaagtttgaatcattattatttcaccactctctggtatctaaaataattatttttttcttatttaaaattgtctttaaaaaacagctttgtatatatatatatatgtatatatataattgaatgcaaggtcatattaagatttaaaaccatgggctcagtttctgaaagagcaatgaaaagctggacaagataaaggaaagaattcactaaagatagaggatcccacggaagcttcgcctgcctaggcagagtgtgggtaatatccagatgaggctgaagtgatgtgagtcaaatttgggaatttatttgacctggctgagctcctgtgcccttttgacgtgtctctaagcctttttttttttttttttttgagcgcatcctccatttcattttgaagtatgtatttgtagacggttttatgctgtgaaaatgaaaacttgctacacctcagaactacgtctcagaaggcagcggactggtcttgcaggtcccggaagttctgccccgcagtgcctgctgcctgcctcatgccgggtctgcaggcggggagccgaggtcagccgaggagccaagctcaagggccgagatgggctgcaaaactcatttcctccaggccctgctggggctccttgaaatggaaaaataaaaaagtcaggcccagcatgcaccaagacagggcagacaaacgacaagactgcaggtctgagctccaagcgcacgaattgcccacgtgcagccattttctgctttgagcgtcatggaaaagagaaacttagtagctgagacacgtttcttccccttctcctgtgatttgggaatgcccttttccaaacgttcattttcttttttctccctcctgactctcagggcttcatgttccttatcgtagagtgtagctgccctgtggaggcctgcgcaatgtgatgagctcagcgggggtaaccaatattgccacctcacgtgggagcctcaccactcttaggacgtgttttcaggggagagttagagttttagaagttacaaataccacactcgcaagcaaactttggggacacaacctctgtctttatctctaaactggtgatcctaaaatatgtcccgtatactatgtggagtggcatggaggagcaaatgagacggtaattgaagggtgtttattaaattataaagtgcccagcgtataatcccgtcattgactttacataatggctagtgtaacacccattgcatagagtgctggcatgcagtattttctatgagtgacttaaggtggcatacaataatagtgcaccgtttcatgccttccttccttccttcctttctttcattctttctttctttctttctacaatgattttacatctggtatgtgccaggagttgttctaggttctgggaaaacagtctctgccctcctgggttttacattctggtgtatcttttgtttcaggtaatactcaaatcaacaaatgcccgcattcaggctcatcatacacgctatacgatcaaatgaagcagcatatggaatagagatcaacaggggagggggaagcttttggagggaggatccagtgatctcataaagatcttgtctgagcctgttagttctgaggtgtgttttggacattgaaaaacctgaaagtaattaaccttcccaatctaaaccgtattttccacaaataggtttgttggatactagtattttcacgtgtaattagaaaaggaattactttccattattaacaaatagatgtgactttgactcatgttcattttttttggccacaaattctcagacttttgatcttaatggtcaagtgcaggtaagaggaaatgaaacaaaattaagcaatgatttgaatacattttctcccttgtagaagactaattatagtttggtcattgagtaattttctcagctgcttaggatctttaattaggtttgatattcactatgaatgtgtggcagggtttcttgggaaagtagagacgggataaaacataaatgatttatgtaactggatatgtcccagagtgaatgagactttggtctcaagaactattccagtggtttgtcgttctttgatgagctccgtaagtgttgctcttctcaacagaaggttgaattttaggtgaacagcctttcctgattgtgtagatctggaccacagtttgaaggtgcccctccctctccctctgattgccagagaacccctgcattatcacagcaacccaagtcaccccacgtattcccaaacacccatctgctcaggacagaagaggcattgcctctagttgagaaccaagaagtggtcatttccttaaaagctttgtcttgtcttattttaatatttaaatcaaatgacagaactgtttatctatttttatcactaaactccatagtccaattttcgtcttcatacaaattaacatgtttttacaaaatctctaatcttatgcactgctcactggcaacctctgtggtgaactaaaccgtaatgaataataggccagagagccaatgcagcctaggttgcctagaggacagagaaacccagtggcaatttctgcagctttgccaacagccctgagtcacctcgaccctcccctggctcctggtccagtctgatgaaacagtttacaagatgtcttccaggttagcttttcttgttagtatctgctttcaactcaaaatgcacacactcaattaaatcttctacttctgtatgacaatgttaatagactcttggaaaaaataaatgaaacagaatttaatggtgccaaagttgattatacttttagttttccatggtcggaaagctgggtcaattttatttggttcctggtccaggacttcgcctgtgaagcagtttgacaaatgtaattataaaatgtaaatatggaagaaaagagataccagtgcagagtgaactagactttactcatttctgtggcccctctgctatccactgtgtagatggtcaatatgtatttggtaaggtaaatgcaattatgacagaaaaagcagcacatggaatctttacaagtaaataatttttactagcttaacagaagtattttgaaaagagaaaaatcttacgacttagcttggcagattagacaaagctaggatcagcatataagatccctgatattcctttctttctgccgtttattcatcaccttcccccaaatgagttaggtcatctttttgaactttaattcaattaactccagataattataacaataataataataataataatagaaaacactcatagagtgcttattatatgctagacattgtattaagtgttttgcttaatacaattgggacagagaagacaggttcctgcaatcattatagccatttcacagatgaggaaactgaaggacacagaggttaagtaactagatgtgtatccattcagcagctgtgcagtgggttccggagatacagaaatgaatcagatacatccctgccctccaggagcttacagtttaatggcctgaggtagatgcataaaccataggagtacatagctgcatatacaaactgcagacatctgtttgcaatatagattatacaattaagaagacaaattgctggggaaatcgttgtaataaatatggcaagtgttaatacccataatttatgcagatcatgttacaactgaatgagatcacatgtgtaaacatattctgtgagctgtaaacaggagggaatgtaaaaggttataatgactactccaacacagctttattaacatagacaataaacctgtgaatttgttacttttccaagtaacagcaagacttgtttaagagctgcctagaagttctgggttttttgtttttttacttctccatgtatttgatagtaaaaaatgaaagataatttattatatcataaaatgtgtttgttacaaattaatattgcctgaaaggaaagaaggagaatagcccaaagcagttaatacaatgattccgcaggaatcaaggtgcagctaattatatttatatgtactcatcgatttttctaagaaagtaggatattccaaagcactagagcccagcccatgtgatggtgttcgtgagcatttgtggcagagtttctgtgaagtttgcatccaaacagatgggaatttttcaggtaatggcatacaagtaacaggtaggtagactactcatgtcttgtaagaggcgtttaaattttatcacggggagagatagactagtcagtcactcagtgtttgctaagtgcgttaatgagtcacagatggatagacatggcattaaaaacaagcatgcccagagttctgaggatgaggctggactttagcataagttgcttggattctctgactgaaaccattcttcttagaagcccttctataatgtaaatagataaggggacccccagtggcatgtcaaggccatcaggggtctcgggggctatggtttttttttggacaaagggctagagttctggtcttgaagccacattttcttttttttttttctttttttttttttttttttgagacagagtctggctgtctcccaggctggagtgcagtggcgcgatcttggttcactgcaagctccgcctcccgggttcacgctattctcctacctcagcctccctagtagctgggactacaggcgcccaccaccacgcccggctaattttttgtatttttagtggagacagggtttcaccgtgttagccaagatagtctcgatctcctgacctcgtgatccgcctgcctcggcctcccaaagtgctgggattacaggcgtgagccaccgcacccggcagaagccacattttcatagtgagcatggtcttttcaccgacatggcaggtttgttggggtggcttgatgaggtatatggtgaaggctcccctggcattccagttgccagaggggactttagaatgttcaattctttcctctgctgtcacatgggttttagcatcatcaactgtggtgaatggagcatccagatcttccaattcatcccatgattcttgtcaaggaaaaaaatctttaggatttgaggccagcactatgggaaatttgaaaagctttgctcctttcaagtttaatttttgctttcagaaaacaaataagtttacagtatgcattccatgtgaactccaatttccctctctatattcagagaaatacatatctattttctattgcacagagctacggaatagtttaccaggcctggtagcagcccaacaggagagagaaaggagtgagacaggctgtggcagctgggagataagtgcaattgatgagctgacctgccgggtggggaggaaggtgccgacctataggaaccacagtctcattccacctaagggctttctctggctctccaccacagccctttcacttgaagcactaacacgtcaccttgtggactaagaggagttttcaccttttctccttttctgcacccagcttcaatcattggttgatgaccagtgaaatgttttaagaaggcaggaagctggagggagaaagacaaaggcttacatatctcccagaatgggtaacaggctacagcatgcatggccatgagttggatgtgcacatgacctgtgtacataaatgacaccctcatgcacacatgccgtaagtgtgcatatacattttgttaggtcaatttctacatcatattccagaaagtcacataatcagttttcttttttggtattcacaattcacttggaattcaccaatttattatgtgacttgaatatgtatggcctttctgctgagtggatcctgaaatacaaatacttactgttactggaagccccaaagtcaagatgcaaattaatagatttctatatggcctcagatctgagtcctctgaaactggcgatttaacaagagcacatgtacagttacagaacctccgcgggtgtgtctttcagggttcctgtttcttatttccatgtctctgtacccaacacacttcctcctgacccttctttctctcctcctcctccacacccgcagaagcacctagccccaccacacataacttgctagtataatgcatttgttcttggaaaatgtgtgtttttgcacactttggtttccacctgcttttttgggaagatgtactatatgatgcataaaagatccggagctagctaggaggagggaggtttgtttgaggcaacagtgcaagaatatcaggtcattctttcaattgcacacttcagagtatggatacttcccttgaaacatttgcagcacaagacttttgcattgacaagcctcttgcttttgaatttgagctgtcaaatgttgtttctgctttcatttgttggatgtttctgcttgaactacaaggtaggacctcatatagataaaaaaccaagtctttaacccatgacttgagggccgagattggattctgattctcagcacatccaaacatgtcttgaatttgtagccactccttgccaaattaactacctctgtgactttaagagtagctaataagagtaacaagctctagtccctctttgcaggatgtaagggtttctaggggccagaacatgttgggcttcttacgccaggtgaaagatgttggatttcattttggggaaaagtgtaacatggtaggattatcattccagtagagaaaccctgtttttcagtttgtatatgacctcacatgacttcacagtttggggctcccaccctgttgtaagttgtccacatttggaagaaactgtagttccaaccaactgaatcaattatctgtaaagttggttcatgcaaatcagtgcatacatgagactgtgcctgtttggtttgtcataactattttatcatatgaagaactgaccatccataagaataatttcccagacctgtcattctttaaattccttttatttttgcttccaacatagaccccccctcactttgggagtatatcttccaggatcatgagcccacgagaggccatcttagtacactgtgtaggaattaaaccactcctgcaaatgtgaaacaaactgtacttttcaattaattaaaatcatattccagtgtgcctacctaaataagagtgatattgttttgagcaagatgagatgatttatatatatataaatcatatatacatcatatatatcatacatatctatatcacacacacacacacacacacacacacacacacacacacaccccagaccatcagacagcctaaactgttttaatgtatggaccattattgtagtgatggattttcttcttggttctagtttcattcatacaagaatgctgatacatggacaacaacaagacaagaatataactatttgcagcctattatgtattatttcaatataacattaaagtctctagtactggggacaaatttaaacgtagctttaaaattatataaataataatgagcatttatcactagtccccagaaatacaaagtctagcactcatctctccaacaccgtgctaactgcagacagtttcacacccagcatcagaatcccacaggagtccttagctcctccccattccagcccaggcacctcctctgaaaggcacaaggcggtcagggagggccatctcatctccttatttcaatctctagttttgatggggatgggatcaaggaggatgagatattcacagtgacatattcagtatcggagaaccaaagtaaagtggttagggccgtcattgcacgtgtggcaaaacttataaattaattggaatacttcattttttaaaaaatagactttatttctcagagcaattttagtacgcagcaaacccgagaggaagatagagtgatttccatacacctgctgcccctacacttgcgtagccttgcccacattatcaacattccccatcggagtgcatttgctacagttgatgaacctatattgacaggtcattatcacccagtgcctgtagtttacattagcgttcatttgtggtgctggacattctgtgggtttggacaaatgtatatttacatgtatccaacattataggattatacggaatagtttcactgccctaaaaaccctcagtgctccacctgttcacccctccctccctctaatctttggcaaacactgatctttcagtatctctgtagtcttgccttttccagaatgtcatataattggaatcatataatatgtagtcttttcagatcggcttttctcttgggatgcttaatttttcaaaaagtctctgtgcccatctcttttcatggggaacttgattggcacatttaaagtacaattcaactaacaaaaacctacttacatagaacacttcagaaacacaattacagacagcagggtacacttgtaacatcccacaggcaaaaacaggacaaattatttggagtctagcctcttacagaggaagaatccatgttgcactggggcttgcattccttggaggtggagaagatcattcctaggactagggagcaaattgagattttaaaacatgaacccagaaccaactcaaatgctcatcaacaatagactggataaagaaaatgtggcacatatacaccatggaataccatgcagccataaaaaaggatgagttcatgtcctttgcagggacatggatgatgctggaaaccatcattctcagcaaactaacacaggaacagaaaaccaaacaccacatgttctcactaataagtgggagatgatcaagagaatacatggacacaaggaggggaacatcacacaccagggcctctcggggggtaggagggtaggtgagggatagcattaggagaaatacctaatgtagatgatgggttgatgggtgcagcaaactaccatggcacgtatataactatgtaacaaacctgcatgttctgcacatgtaccccagaacttaaagtatatgaaaaatagcattatctaaaaatgaacatatcctgtagaataaaggcaacttcaaagaattcgtcgatatgataggttagcagttggaatttagacaataaaataaatgcagttaattatgaattgtattaatgaaatgaaattgctttccacagtgtgtctgatgttttaggacttcttgtccacaaatagtttgaagcactgctgttactctctgggtactaggcagaaaagcctttgggactacggatggatgtgtgaggcttttatttctgggctttggaagtaagaaatatgacctattccccaggaaaaacacggaaaccagaaggcatggtaattcagggttcaaccacaagaaaacaaaaagttcagttacacataattacacttttctaagatagaatccaatagtaacatattaacaaatagttgtttaatatttaatttggtttgccaagggaattcttaataagttctgaattatttcataaaaaaaaaacatgaacccatccccagtgctcatcctagtgttcggagtttttaccatttctgaatcacaccttggaatcaatggagaaaatcctgctttgatgcacccttgctgcttagacgacaggacttcttaacccatgaccccagtagcatcatagataaaaagggtgtgtgaaaaaggagtgaggggatacgggaagtgggaatacaaagcctggattacgtgcagactgaaagtcaaactctggacggggcatcccaggcctgtggaaaccagaaccaggctatggatccaatgggaatttcctcagtttcagcttccccccaaccagcacacataccctgggccctccccagctcacgaggggtggccccacttctatgcttttccttgcagtttctccatctggaaatgctccccaccattttgatttacccagtacaccccattcttcaaggctcaggccagtgcacaccagttcctttaatccctccttccttcttctgtcatccagtcgacacacttagcatgacatttggcacctgcataccaggagctcatgcaacaaatacgcactgcatgtgcatgatatgtggacacttacaggctctgaaaaagagaaaaaatagaaaaaagtctctgccctcatggagccagtattcccccagccctgacgaatctcctgctcctttctcccagtgtatttcttcccctctgttaaagtagttcctagagtcaaccacatgcagaatgagccttcaccaccatcaggctcctgctctgcacatgatggatgcccagccacttgatcttagtattaaatgcctttgagactctgttttataataaaatgagacacccaagcacagaccccagcaagcaggtaaacagggaggacctttcagtgtccaagtatgggatacacatttaaaaattaaaataatctggttatatttaaaacaagtggcccttaacattaattggggagtgccacttgccaatccagagatgcaccaggtgtaccaagatggacacactgggagataggcagggagtctgtgcccgggctctgcagtccctcagccccagggaccagtgtctcaagctgcctctgatccagaaaagcacagttagcttggcaacaggttggtggtatgcagttgctgctcatttcctggtccgctttacaggcctgccccttgattttgccataagacaggccacttgcaagaaggttcatctagaagcagatgtgtgctgtgtagctgatgggtgggggtcatgatgggcagcctgcttctttagtagactgtgtgcagtgttagagagccctggggcagcactcgtcagttaggatgcacaaaaatgccaacccccgactctcagttttttaagttgcataaattccaaatttaacatatcaccatgtgcagtcttggaaggctcaatattggctttaaaaaattattttcctaaggactctctgttgtcaacttgaggaaatggctaacaagcttccttttctatgacacttagctactgaaaatatgttcttcataaagtgtcttattactgtcatactgtgggttacttcagtaagtacagactgtgtcctagccaagcttaaaacctcgacggcagtgattcttaatcttttggtctcaggacccctttacgttcttaagattggttgaggattcttaaaaaaaaattgtgtatatgcattatatctattggtagaaacaaaaacagaaattttgaaacatttacttataaattcatttaaaaataacaataacaaggccaggtgcagtggctcatgactgtaatcccagcactttgggaggccaaagcaggcagatcacctgaggtcaggagttcaagaccagcctagccaatatcatgaaaccctgtttctactaaaaatacaaaaaaattagccaggcgtggtggcgggtacctgtagtcccagctactcaggaggctgaggcaggagaaggcatgaacccaggaggcagagtttgcagtgagccaagatcgcgccactgcattccagcctgggcaacagggcgagactccgtctcaaaaaagaaaaagaaaaagaaaaaaaaattagccaggcatggtgggacacgcctgtaatcccagctattcaggaggctgaggcaggagaatcacttgaacccaggaggcggaggttgcagtgagccgagatcacaccattgcattccagcctgggtgacaagagtgaaacttcatctcaaaaaataaaaataaataaataaactcattgcatgttaacacaaatgagatatttttatgaaaagtaactctattttccaagaaaatgttaatgagaagtggcattgttttgcattttttgcaatctctttaatgtctgggctaattggaggcagctggattctcagatctgcttgtgcctgcccttagaggggtctggggaccccagggggttcctggacaacactttgagaatgactgacctacagagctccggagaatcactgacctacagagcatagtgtggtacctggcactgtgctaggcagggagatacagcagtgaagaagagggacacattctctgccttcctggaggatggtatgggttgaatagtgttccctgagttatgttgaagtcctaacccccaggacctcagagtgggaccttatttggaggtagggcctttacagaggtaatccaattaaaatgaggcccttagggtggtccttaattcagtgggactgatgtccttataaaaagaggtaatttggactcagaaacaggcatgcatagagggaggatgatatgaagagacagggagaagatgaccatccacaagctaaggagggagtcctcaggaggaatcaaccccgctgctactttgctctctgacttccagcttccagagccatgagagaataaatgtctgttgcttaagcccctcagtccgtggtacattgtcttggcaaccctagcaaatgaatacacagactatgtatcgaatattgaaattgggttttaaggcagtaataaggcccatgctgcttccttgaggaaaattcagccgcaaaagaggattcactgcttattaatatggagacacgttctaccagatagagctctgggaatccaggttctccataggcaagcacagcagtgaacagtttttccaaacgtctccttcctaagcagaaaggaagtgacaccattgtctgccatttgccattcagagctcgttaaaacctacagcctcacacccatcaccggtccacaggtaaacagagatttcagggcaggggaatactttggtgccgttattcctttcagttgccacaagtcagtttccctaaaggctgccctattagtggatgggtgggtgggagcctcagtgaggtatttcctgtgtgagtcaaagcctttcaaaatggccgtgaccccttgcagactctgaatgaaaagtacagattctcagttcccagagtttctgcatgtgatgatgaatggaagttcccgttgcatgtgggacaaaggatggctgtaacattttattaggtgtggcttttggtgtacacatggcatatgcaatatatgcattctcatcacatttagttttgaaaataataaaactttaaagatagaaagaattttctttgcagaacccttatgagatggaaaatattagtgcaacacagaagaagacaattcccgggcttttagccaagacggctagagagactccacttctctctgagtcaacacccaggttcctgccatggcctgcaaggctctaccacccccagcctttcctggttcacctcctggttctttctttcgctcctttccagtaacccctcctccctggctgttcttggtcccattgttcctcgtgcagcccccgcagtccactctggccttgttctagctgttgccaaggctggaaggcctattcttcatgaatgcatgggggctcacaccctcccctccttcgcgttttctcaggaccaccctggccactctaaatgaaaagcagcagtttacctctcttttcctgagtctctagttctgccttctgtttcttcatacttatcacttaccaccttctaaccctgagatcaggcttgaaaaacaaggttataaatttaccctatcaattattggttgattaattgattttcaaaaattatctgtggcttgtagtgctagaatacaagccttatgcagataggtgtctttgtggttttgggtcatggatgtaatctagaagcagctagacaagtttctaagtagaaaaggtgttcagtacatatttgttgaacttatgactaagagaatattcttattcctggaagatatgtgtgatttctagtggagactagaaatggcctttctctgaggcaaacttctaaatcctctgaataaaggtatctctagcccatctgactcagtcccacacccctgggctgtggaataaccagtttagggggtgattaaaatggctacataggtacagaaatgttaacttcaggttgtcagtgtagcagaagcaaagatgtttgtcgtgttgtctgtgaagacgtgctataaaatcgtcccccaaagtaaattgtaatggcaaccatgccctcagattgttctggaggatatagacagggaatcagacactactttcaaaactgttacataataaatcttacattggaaaactgtcttagacctgtttagaaatcttgcattctctgtcttagaactttccctcttgagctgataattatcatccagtaatgacacttatgtggccttgggaaacaagttattaagcatgcacctgccatccctccaaggcagtttcacccttcaaattaaatgcgctgcgcttcctggcagcgctgaggccattggagtggctcctgagtgatggcttggaagaaatgatagcctagtagagaagtggcccaggagagtgcacagaggaaagctgacatttagagaatgaggagagaaaaaggagggcataaagagatgggggatggaattgtcaaccaaataggaggaatagcaggaatatggaagccaaagaaaagagggttaaaaaaggggagagtggccaacagtatgaactgctcttgagtaggtaacaaagagaccagctgggagtgaatgtttgagggaaccccaaaaagctcactcctaatcgtggcaggacagtgtcagaaccagacggcaaggttggagaagagaagagagcaggagatgagaatctgttaaagagctgtgaaatatttaagtaagtaagtatggccaatttttggttccttgcatcaccagctaccacccccaccttcggacacccagaccaacacacgactcttgcttgaaagcaaagtatgaaggttagagacactgacgtgagtgaaactagactgaacgtttgcgagatcctggataaataaatattggatatttttgttggataaatattgcttggataaatattgcgaaagtgcattgtgattgcagaaatactgaattggcatcagattcattaataaaaattctgcctgacatctcacgtgtcaaggcccatgggagcctgactggccactacttggtgcattcttttttttttttttttttttgagccagagtctcactctgtcacccaggctggagtgcagtggcgcaacctcagctcactgcaacctccacctcccaggttcaagctattctccagcctcggcctaccgagtagctgggattacaggcacacgccaccacacctggctaatatttgtatttttagtagagacagagtttcaccatgttggccaggctggtctcgaactcctgacctcgtgatctgcccgtcttggcctccaaaagtgctgggattacaggcacgagccaccatgcctggccagtgtgctcttttacagggcccagggagctcagtgctccagtcggctggttttccagttcaggagcttaaggcttcagattcagcagtggcagaagtggtttcccaacttccagctgccctgttctttgcacttttttttatttttaagtcaatctaaaatgagtctgtgttcacaaataaatagcgacaagtgcaagtctgctagagtggaagagagcaagtgcaaattctctttccctttagctaagttgctctttgaagtaggcgtagccccatgacgctcccataaggcttactgtgcaggttggatgagtaggcaacttggaaggccccacctgctctgcaaggaggtagtcctgcacagcgcctggtggtcagatgtccactactcacctacccgcccaccccacaggtggctctgtgctgctcagaacctgcacagtggtgcatagcatttcccagctcttgaagcttccttttcttcctgggaaagatagatgtgaacatccatgacctcacttcctccacaaggatgaatcttaataagtaaagaggtccagtaaggaggcaatctaaagaccgaggtttagactctgtgtacacgtcaagatttcaagtcaccaggctgttgggcaggccttgatggtttggatatgaatgactctgcacacttttaaagagtatttgtgacttttttttttttttttgagacagagtcttgctctttcgcccaggccagagtgcagtggcatgatctcggctcactgcaacctctgtcccccaggttcaagcgattctcctgcctcagcctcctgagtagctgggactacaggcatgtgccaccacgcccagctaattttttgtatttttagtagagatggggtttcaccatgttagccaggatgttttccatctcctgacctcgtggtctgcctgcctccacctcccaaagtgctgggattacaggtgtgagccaccccgcccaggcttgtgactttcaaagtagacatatttatagaggggctcaagccagatggcaaaagagccctattggatgtgatgtaagtatgtgtagtttgaaattgttggagggattgctctcctagttcaaatgtattaggttttgaggtcagcactcccagagtcataaaaatcaagtctcactggcaaccaacttgttagtgcatgaaaagtgttaccaggacggggtctacccagtgctcatctatgtcataggaaaagcatgagctcagcgtataacattagcaaagggctctgatgacctggctacttagtcccctttccatgcagcaaccaggatatatttatgtgctggaaaaatcttctgaaaagcacaggcttagcatcccagccccagggagtcagacatcatcacttaccaagctgaagaaagaccttggcagggattggaccctcacagtgggtgaagactaactctttctacgtaagtcagcgtctaagaaaaagaaaacgtctgtgttcatgtctgcgttatacagtgtgtggcccatgccaacaatgatggggatggggatagaaagcaaaagaaggagacccctggaccatcatgtgaatagtggagacttattcatgtgctcctctgtctgccagaaccccagtttctacaagactttctgttggtattaccatgttgccatgtgttttttattttttaaatttttttatttattattattattgaagtgctttatgtgtagaacagatgccatattcccatgcaagagagtagatcctttccacacttaaaaacataacactagctctcagggtgctgactagcttcttaccattagcacagaaggagatacctacaagattgaggaaaattaaagtctgggggcagcagggaaagaccctgcagttagcatctaacctggatgcataggaactttttagcaactccatacatggtagatttctaccttatctgcatgtctgctcagagatggaggaggtagagactgcagcctggctatggctgaaagaggatgttactagttaaacaaatcgatctcattttggtgcaaaatggagtcttagaaaacatcagtagaccagaccctcattttagacgaggagcttgaagacttggtacatgaggggcacggagtggtggagccccatggccagtggccctgtggtcttgcggcttcttcttaaagtgcccatcctgcatcctggcacgtgcatgttgaacctggtgtgacacacctgtctgtggggaggggggggaccgtaccaattatttaaaaaattaaggctgttttgacacccccaccccctcacccccgtcttatgggaaattttgaattgagtgtttgaaggcatgagagtgacacctgatgaaaattagctaaaagcagagacagagttgtgggtggaggccaggacatctgctgcccctatcttttgcttgccagggttttccattgtgccagaattttctcatgaataaaattcctggaattttatcgaaaacaatgaatccatgtgtcagagattcacagatgagacacattccagatgcgtagcacactgtatttttagcctttgtgtgttttgaaagggccaagcataaaactgccgatttttcacggagctccttctgaagaggagagaggtggtgcaccaccccttccctggtgttcagagaaggaccatgccaatagaaaaaaagtgcaagcaactttgctactccttgagcttggcctttgtgtttctcaagccttgaatcacctgagtttcaacctgggcttgtaagtttcaaaaatcaccaggacagaatgatggtgtgaacctcttagccagactgccatggaaacacttcctcatagaagtttatgaaaaattcaacaatttttagggaaagttaacatagaaagcattatggattccacatcctggaagaaaagacttttcttcagaagtttgagggctatcaactttgtgccttgtgctattctaggtaaaaaaaaaaaaaaagaaagaaagaaagaaagaaagaaaaagaacattatgttataagaccatggtatatctattaatttattatcttgttatgtagagaataccaacagcacgctggggagtgtaccaggattcattccttcctgcacaaagctttgatttaattgacattaaacaaactaatgtagaatttgaatggaaaacccacaaaagaactggaccagggaccaaaaaggctataaatcaaagtgacagacgtgctcttgaagtaaaagatgctagatctcccttcccctctgttaggtagatacttggtttgaaaatccagtacttacaaaaaataagtgataatttgcacacaagagactgtgattttccttgcatctggcttgttagaataatatgactagaatggataattctgatggttcacatgcagaggtttggagtcagtcacatcacccttctatcatatgataatttaaatacaatattaagatttatgaaacctgttacacacactagattatttggcccatttaactgtcctgggagagagctgctcggcagctggttgccatcagtaccacctttatagttgaagaaattgagagtcaaaaaaggataatgcagcacttgttgaagtgagcaggcacccagctcacctggggaagttgttacaaagcagattctgactcagcagggctggagactcggaatctgcatttctggcaagctctcagctcacacttggggcaggaaagggttaaaggatttacccaggtgattcccagagcaagggcagagcccagcttgaaactcacatcttccatcttcagatccctatccctggctcccgtgctctaccagacggtctcctatccattggtacagcttcatgttcatcctccactgagtgattaaaaaaagcaaagaaaaacttctttttatctcaaatgaattatttaaaactagataaaaaataaggaaaagggttttgatgaatattcgtgagtaacgtatgacagtgattagagaaacaaaaacaagtattgagtgtcaagagtagaaacagccctcttagaaggatgtaaaggaatagtgagtgtattttttgcacccattccaatgtaaaacatacaaacaggaggtttccacagatgtttttatactttttgctcatctccaaagaaggaaagaagcctactgggaagaaaaagtgattcttcttcttcttttttttttttttttgatggagtttttctcttgttgcccaggctagagtgccgtggcgcgatctcagctcactgcagcctccccctcccgggttcaagcgattctcttgtctcagcctcctgagtagctgagattgcaggtgcacaccaccacacccagctaactttttgtatttttagtagagacagggtttcatcatgttggccagcctgctctccaactcctgacctcaggtgatccacctgcctcggcctgccaaaatgctgggattactggagtgagccactgcacccagccaaaaaagcgattctttaaagaagaaaataagaagctattcacatcacaggcatgttgtttcttaaacagttaaatggcatttgccagggcaaagagtcccagttcattgtcctttcaaatgcattcgaggtttattctgcatggcactgagaaaacagagttgttttaaaatgatgttggttgacattcttgatctcccaaggctcatttaaatctaattttcattatgtggacataactattctttctttaacatttttctaccatgctccaatctttcacaatatttctagagtttctgctttccagattgaatgctccctccttcttttgcaaacgttcattttccagtaagtcttattttgttcataggttgcttagctataggaagtccctatttaagcctatgtggattgaaggtgaaactctgcaataatacgctctttggtagtatgactgcagacatattgccaatggcaattattttccaaactccctggaactcctgggcgttggctacacaatccattcatctcacaaaaacacgtctcttcatttggatgtaatagaagtttgtggatcccatttatagcattatgatggggctgtaatatcacctgatgtcttagtcctagggctaatatgaacaccaacaagcatttgaggttaagaaattatcttatttctagaggcagacatacagaggagccagccctgaaaatgcttatatttgaataaaggcaaggccaggggagaagtatgtgggcaaagagaattgctggcaccagccaggccttctcagagccctgagaaagtctgtgagtccagagccgggaaaattggctgaaggacatggaggggatggatccccagctaagtctgttctgaagggatgtgctgagcatagggaaaagcaccttctaggatgagagaggaaggagcagaggtgaaatgggaagaagccaggttctctgtatcttttaggcaacatttgccctagtggatatgattaaagataaagaatatctgaaagtcctctaaagcgttctattaataaagataataaggataaagattttcatctctccttattatcttagtatgtatttagtaatatgtatacatacgtatgatatttttgtatatacattatgtattgtatatctgcatgtatttctgtaggtatctatttgcatatatgcatacacttatatatgtatttgtgtatatgcatgtgcgtatctgtatatatgtgtgtgtatgtatatatgtatttgcgcatgtatgtatttgcatgcatgcacacatgtatatgtgtacatatgtaagcatgtgtatgtgtttgtatatatgtatgtgcaaatgtatctggacactagttctgggtctcatttcttagcactggactagtgttgtgagtggtgaaattatttgacactgaagtgataccatattggagaaatactctctttagatggacttcatttgcctacatacatttttcctttgaggttaatccaagattttttttatagttttgaaggactaaaattgcaatgtgttaaattagaaaaacgtgaacacaaagctagatgctgcatttaatatacgatgttaatacttccttctctgaagaattaagaagaaaagaaaatcatatcaagaaggggcaaaaatgatcatacccagctttgtgaagcttctttcacttaccacgtttcgcttttttgtgtgttgtaaataaaagacacactggtcagatgaagattcttgtttaatgagatactggtggcatcagaattgcaaaagtgcacacatttagaataaaaactcctgaaggactggagtatctttgtcaggcttatggtgggagagcagagctttctctaagtgcattgtctattttgtttgtgttgttttttcctcctccaaatacaattagatactagaccttttagaagcatctactgcatatgtgctgccttgaagagaaactataaacaatagagcctgcgacagcctaatagatagatttccaatatccttaggtctgcagacatccactaaaggccgcccaaagtggcataggctccagcatatttataaatggtactcctacctgtcctagttttcctgcatagtactcattaagagaaggcaggcatccacctgcaatgaacacatcccaacacctggccatgtctttgtgtctgaataatctgattaatcaaagaaaagaacaaggttgttgatttaagccattgcaaaagaaatgattaactgtatgcagggcccattgctacacatcccctaggctcatagaagagcatggtatacctagagaagtccttactggttcccagcactctccgtttaccatccagatcctttattccatcccagatccagggattctggacacttatcccttcatctttcttctgtctcttccctctaccagcctctctctctctgtctctctctaggtgattccatctctcatggcaagagcaggcaccaaaacactccaccgtgtgacttttcttaatccaacttcttccttccagtaacagccaggtagtggccagtctacagccttggggaatgattccattcacagacacaaaccctgtttctgcctcatcctcactgttgatgttacttctctaatcgcactttctgatgggtgggcaagaatcacagctgaccttataggacaattgtaaggattaaatgatcatttttcataaaatgtaagatgtcattggatataaaatgtcccattattttatctgccatcagagaagaagaaatgctgcctgatacctaggataagcctttcattttcatatttcagagctgataaaatgtgacaagtggtgtatcttgtaatcaacaaaatagaatttaagaggatattgcatgaaagtgcttaaggtaacctggtttatttggtggataagctatttatgaaagtggttaaaagatggcaatatagggagttaagtgatgtaccaaattctgcgtggttatatgtgagggaaatttaaggaagggttttgtattggattgtaatgggattaaaactgacagaaaaagtaggctattgattgaagatgatgctggcttcctaagtgaatgatctccacactgtgttgtgatagcagcaaggacttctttaagatttttttattttttatttcttattttattttatttttttgagatggagtctcactctgtcacctcggctggagtgcagtcgcgtgatcccggctcactgcaacctccgcttcccgggttcaagcaattctcctgcctcaccctcttgagtagctgggactacaggcgcccaccatcacgcctggctatttttttttctttgttttttttttggatttttgtatggtctcgatctcctgaactcatgacccacccaccttggcctctcaaagtgcttggattacaggggtgagccaccatgcccgaaccaagatttttttttttttaagcatgatcatgatcatacaattcttgttccacttagttgttccatttgtttttcataattatcaaataattatagcatataagacttgaaaacattgaaggtgggtttgataatccaattctcgagaggcctagttctggccatcttcctaatttttgaaaaccacgaaaggaccatggatgcctttgcttactccagatgtgaaattcacctgaccattcttaaagattttctcagtttcaacactttaccactcccaaattttcaaaagaggttaagtatgatggattctctgtattaacaatgtaatatttttatgagctataaggatcacaaattagaatcaattttgggcctttattttctaatactttggttgagaaataggcatcttgcaaagtattcatctgttatagaaaggcatcaggattcctgaaatactttgctgaaaatgtcagtatgcattcaactttgttagttttctttttcagtgttctaatgtattttggatccttttttgtactctagttacttgaaaatagatgcatattttagagttataatatgaaatataacctggtgggacctcccttcatttctggaactgttatcccatgaccaaaatccaaaggaatggtcctcatgtgttattggtatattccgtattgaaatgaaataatcaatactacagtactaacacagtagtaccttttgtttgggggtaatttgcttagaattatgtgtttctcgtaagttatttaaaaatgagcttggtagcctgccatttgcctgatgggaatatcccaactttcctggagctacagaaaaaaacaccccacacattggcaaacaccaatctaaagttcaggtctttttatagtaacatagaagcaggcatatgaaatgattatgccacatatctgccagattttgacgtttaaaatattctctgttataaagccactgaagcagatcccaagccttgtggctggccagagtttctgcaataacaatctatacatgctaactaaggcagctgcctaccttggccggcaggtaggcaggcaggtaagtaggtaggtgagatctgctagttataaagaggaggagccaggctgcagggaaggagagacatgtcagtcaaggccaggaagtctctcccagagctggagttaaagaactcatgtggtcctgattagcagcctgtgttcagcactctttttctggttttaatcctactgggctagatcctctctcccctttgaagtcacagggctgccaggcagggagggccctatgcagcagcgtgtgtccattcaagctttaaccgaagggatgatgaaacctgccaacagccaagtcaagtgggaggacaaagatgtggcagggctgtgccttggtttgcttctgaagagcagcacttaactttagtgaccgctgttgtgggaatgggtctgtgaaaacccctcagcttcttcttactcccaaaatgtgtatgtgagagagattttctttattcatttgtttccttttcctgagctgtacttcatcctaggtgttcagcagcctttgttgagtgacaatcaacaaagtctttggggcatagtttgggttgctctgtcttttcaaaatgtggactgtatttcacctcttttgaagtgtttatcctgaagcttccttattttcagaatttttcccttctaatgaacaaaagcaactgaggggttgctttcaatattctgaattatattcccttcctcatttttgtgcaatattagctgtgagaagaattttaagatgcaaaaaaaggaggcatgcctcccccatctctagcatttctgagggttttttccttcctaaatcgatctcaattaactttgatttctttctttagaaaaccatgtgctgaaataatgctttgccagatgtgagaatggattccttcccctacaaacacacacttaagcttcattttagttctaatattttggtcttttttttattattcaaacttacactacatttttgtggctattggctttgtttgcagaagtaagcttactttatcttggagaaatactaatactttaaagttattgcttgtttgttattgttgcagccatttcctttttagtttgtaattttaaatttagcctgtttcttatatatataacctgttttcgccaatttctgatataaatcacacatttgttcatgtttctcatcatgggtgagccaaagctaacattacatagtgtgttattcccctgcgagccttggtcgagtctcaggcccaggaaggagagaggcagcagccatcagctctgtttcctgttctgagcctgtaaaacacactagccagtgccaccatgggaagggagtatctgttttgcaaaaattttttaataaggtctaatttttgtcttaattagcatgactaagtctatggtgctgattttactttgaaacccacatctatgtgtttagattccttgttttggccactcaattgtgactggaagagaaagccatgaatttcaggttccctaacatctaggatgccgtttctgtactgtcaacttctgtgtcactgcctcgtatcatttttggttgttgatgagtttgattttgctgtctattcaagatgacttttttcccttgtgcctgattctggttctctgtctggcctacctgactctttggtacattttgcattactgtttggacagcaggcttagtctttcccagggtgtcacagggctgtaattctacagatacttatggagtccaggatgggggcttttgctttagcacagacacctgaccaccactttgagagacagaggtttgagtttgttttgattcttcctccttgctgattctcagtgccgtgtgtctggcaaagaagtttgtgcacttgggaagctaaggaaaaaacttggtcctgggacaggtggaggatcgagcgacagagtagatgtggagttgggggtgattgtttcctaaaaattctgatccttctgggtggagaggaagctctccatctcagaagggctgcttctagggtgtgattactgatgggaagcacccttatttatgtaaaggtcatctcagagaaggggaagagggtgctaatttaaacacatgtcccaaaggaaaaaaatgtcacaaagggcatcatagggctgtgggggcaaggagaaggcagatggtaatacacaagtcattcccatcactaatcccctggttgatcatggccagctcattcaagattagctctagacctttctgggtctcagatttctcatttggagatgacaagtttggactggaagggtctgcgcagcccacactcccctgcctcccctgctctgcctccaaagttcttttctttttctttttttttaaataaaaatgtgtggcccaactagcctttgcttctcactagttgatgtcaatactgaggatgccaaaggactaatataaaaatgagcattcatgtggaattctttttgtctgttataagaaccaaaattggattgtatcacaacagctctgtgtcattgcagcacaagccatcatttaagtcgttgaaatttcccaaacttgccgttgctcattggctgtagaatataaacatagccattggctaaccacttgtttgacttaaaaccacgaaaaatgattgatccaacaatgacaaattgctatttcttctcaccaaatcatgcaaaagagcgaagatattaattgaaagtaaggggaaaaaagagcttgtcagtgatccagatattttaaacatcctgctgtttggaagcatctggatacttcacagctttttttttttttttttttttttttttggttcatttatcatccagatgctcaccatcatggaagcaccacttgaaactgtacttcggctaataacttagagtggaaacgtttgtatctttggttggttgccctttggtgctccattgatccctctgtcttcctctaagtccctcttccgcaaaatccccaggaatgtggcaattttgccagatgcttaggtgttggccttcagatttcttttttttaatcctcatgaccgctctgtaccctgtctgcttgaattatagattgcatttgtcaaatagtgacacatgcaattggatgtcttctaagacctttgaaattcaacttccttaagttgagattaaagtggatattctgctgccctgccacagtcaagcctgggatgcttcgagacctgcataaaagtttttctaggctggcatttctaactcttactgtcccgaggaaagaaaaacaagctacttttttcttctgaaaggtagaaatggagaccataaaaacgatctaaaatgtggtcccagttagaaaggactctgaaatcaacaactttttgaaacatgactgtctgttggagtgtcttgaattatgtgtttctttgggcattcaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggtaaggagacttccgcccctttctctccctgacctcccattttcctatcctttgcaaaggcaaagtggaagtcagtcatgcttctctaaagattgacttagaaagcaaggccactgtgcctgtaatcccagctactcgggagcctgaggcaggagaatcacttgaatccaggaggcagaggttgcagtgagccgggatcatgccactgcactccagcctgggcgacagagcaagactctggctaacaaaaaaaaaaaaaaaaaaagaagaagaaagaaagaaagaaaggccattgaacggtgacgttggacagcgctgggaaaatgtgttctccagtggtttgtgtagaggatggagtttgtaaaattagtagtatatttaccaagaactctctttgaagatgtgttcaattctatttcccaggcacgagggctctgtgggaggggagccttgcccacatatggcagaattcatctgaggtttgattgcctggaaaataatgccgtcttatgttttcacaaagggagagtgtcagctagtggccaggcagtgcggcgtatgtccaagccacttgaatttgctagtggatctccattgtctgccctccaccctcaccccaccctctgatctctgcggtcctcttctcttaatgcctgctgtttgttttttttttttttcctcctcttagcttacacataaagccctctccagtgtctcccataattattagcttccctgagtttgtcatgaacatacaactgtcacgtaaaatgtattaccaaatgcagaactgtccctggccctcaaaaagtgttgaattctgtgtagttttgaaaagtaaaattaatttcaattatgatctaataccccatatatattcaggaaaaagaatatcaaatcttaggataaagaacagattatttcttcgaaatgttgcataatctaccatcaggtcataagaacagctcacattttcggaaactttactgtgtacaaagcccttttatatccagtagcccctcagtcctccgagcagcccctcatgaagtatacttgaccccatttgatggatgaagaaacctgtgatcaggcatttccagtctgaccccaaatcaccacttaaatggaatcagagtttggatttaaaccaggagtgtttgactccacaccctgagcattttccactctgttgaagctgtaatggggcctttttgttacatatatgttttaacgctaaaaaggtttattataagtgtcatagtttataagtctggaaacggttgcgtcaattcctagtgtggtgttaatgaaggtgccaagtcacagtgtcctagagggaatgtcaacggcaaggctggacgtgccagatggggagatgggagatgccagaacactcctccactctgagaagtcagtttgcgtctgtgcatctgcttcttgaaagtgcactggctctgatgctacatattgccaccgcactggtcctttaagtggaactcgaggcaggcccatcttgaatctcatcaggagattcattcctggagttacagaaggacctgggtagaaaatgcaatgatgggtccaggacaccaaagttgtgggaaattaatgattacatgtaaatatttttgaatctcatcaagagattcattcctggagttacagaaggacctggatagaaaatgcaatgatgggtccaggacaccaaagttgtgggaaattaatgattacatgtaaatattttttacccataaatcctatgcatttgatacaatgtttctgttgatcattaactatatatatttctgaaacacagaagaatgcagggtaatcatgttctaaagaatgcagcagtgtttatgcagtagatcagttggtggaacacagcctggaaacactgaatgaattctgttttgggtggggtcatatgatcccatatatgccagcgtgatcacggcggagacactaagaccgggacacatttctaaagcttttcttctgcagaggctaatttctacctatgagcaattcacctgcagggaggagggggatgttggaaggtggggagagaggaaggaaacatctcagacaaaagggcactgagatgatttccgatggacaacaggcagagtgagccatgtcctggcccttgtttgagagtctggcctggggccagtctggattcagcaagcctccgaagggagactgagtgaggaggcgagaacagtgctccagaaatgaaagtttctattgttctcactgtgttactcccgaatttaaaataaaataagcattctggccgggcgcagtggctcacgcctgtaatcccagcactctgggaggccaaggcgggtggatcacgaggtcaagagatcgagaccatcctggctaacatggtgaaaccctgtctctactaaaaatacaaaaaattagccgggcgtggtggtgggcacctgtagtcccagctactcgggaggctgaggcaggagaatggcatgaacccgggaggcggagcttgcagtgagccgagatcgcgccactgcactccagcctgggcgacagagagaaactccatctcaaaaaaataaaaataaaaaataaaaaaataagcattctgtttgtgggagaagtgcaaacactgttttccttagtgtgagcctgtgatgccccttggtagctgatgtctcctctccctcctggccaggcatggggaagcttttccagcctgtgttgtgaccccaggggtacaggttgggagtttggggtaaccctgagccccaggcaaggggctacagtctataagaaagaaagacaccaggagcttcagtccataagaaagacaccagggcagttccgccccagggccctcagcgcagcagactggggaaagctcttgggtggtttttctgtcaggcaagtgaaaggctggtgctgcgctgagggtctctttccgggaaacatctttttcaggggaactggacattttctttcttttttatttttcttttagatggagttttgctcttttttacccaggctgcagggaagtggcacgatctcagcttactgcaacctccaccccccggggttcaagcgactcccctgcctcagcctcctgagtagctgggattacaggcatccgccaccatgcctggctaaattttgtatttttagtagagatggggtttcaccatgttggccaggctggtctcgaactcaatccacccatcttggcctctcagattgctgggattacaggtgttagccaccgcgcccggccttgacattttctttcaaggaaacaatgggaactttaagagttcctctctcagggctcatagaattctaacattgcccagattgctgccgtcataaactttcaatgctgttccagctcctaaagcatcggtgatgtgttttggtgggtggataccgagtgaagaccatcatgtcatcctcttcatcctccgggtcctccggtgggttcggtgatgtcggtttggcaggtgctgttcatgaagggaacaaggtggacctcatctgccttcaatccaggcctacgtgcctcctttgaggaaaagggcagctgggttgtaataggcaggggaggaacactggctgcagaggctgcctccgctttgaggcatctagcaatgtacagatgtcaaccagtcaccaagtgtcatcgtcccctacccacaaggatgttccagggggagggagaggagtggctgacactaatcccctttgtagaagagaaagatacagagctcatgcccgtctcccccagagctcagtgtgtctcctggcattgtgtctgggtgctggcctggtgtatcagttgggattctctagagaaatagaacttataggatatttttacattttaagatatttatttgaaggaattggctaatgcagttgtgggagtgggcaggtctgagatctgcaggggaggctggcaggctggaaagtaggcagaatttcttctgctctggaaaccgcaggctttgttcttaaggccttcaactgattagacaaggcccactcacattatctgacatcatctcctttagtcaagttcaactgactagctacctgtgcaaatgccttcccagtacaacctcagttagcatttgattaagtcactgggtgctacggcctggccaagttgacacaggaaactgacccccacacctgacttccagggatgctgcactcatcagtgactggtgacccattgtactttttagatctccaaaccagtgtgctctggggggccagttcaccgctgctgctggagctcagcctgactggacagcgggtggtaaagggggtggcgtgtcaggtcagaggttcactagggggctgctcaagctcagtgatctgaaagaattgaaacataagtggtgagtcagtgttctgctattaacaatccaacgggcttcctgaaggggaatgggggaaaagaaagctgaacagttatcagtggagctaagactcatctcagccagaggttggaggcagccttggggcagacaaaggactgcctgggatcccatccgcaggctttgctgactcactgtgggcttttttttttttttttttttttttttgagacagttttgctcttgtcacccaggctggaatgcaatggcacaatctcggctcactgcaacctctgcctcccgagttcaagcgattctcctgcctcagcctcccgagtggctagttttcatatttttagcggagatggggcttcaccatgttgtccaggctggtctcgaactccttacctcaggtgatccacccgcctcagcctcccaaagtgctgggattacaagcgtgagccaccatgcccggcctcactatgggctctttacgaatgtcaggtgcagctccataaaagggaacatgggcgtgattcactctgctttattttggacaccgtgaaccagcaccgggctgtgtcagcccagctcgaggggccagggcagaggcagggttcacggagacgcagattctgccacggaggggctcacagatgagatgctgcagagcagtgtgtggctgcctgcctctggaggagccccgccaggagtgcagctcctcaacgctccactacctgcacctgcatccttccagactcggaagccccaggccagctgtgccagggagttagcccatctcctggcccctggcccaatagcttcttctaattgtccctcctcttagcttatgcataatgggctttcctgtagtgcacatgccacttgaagtcaagtccaaggggaagttacgtaagtcaaatattactctttggctagaacttgtgggctgttacctttgtggcccctgactatcttgcagacacctccacgggagaagtgcactctctgcagcttaggtctttccagaacatggcccacctccttctgcctagaatacccagcttgggaatagtgccctctgtccatccctatccatccagtacccacggagaaaaaggccatgtgctttgagagaaaggaaggacttagttcccaaccgaatagtggaattctacaaaacctcagtcctaacgtgcttacaagctcctgaaatgaaatacaagtggtgaaacgagatctgttgccattataatagagtttctgtaaagcataataaaagaaaaacaggagagaaaggaaccactgctttgcgagccaactgggatgtccttgtgggtttggcttggccactgccagatcaaacagcagcattcttgcagacagtaatctaattgcacgttgtgtagacacaggacatcatttttcagcttcggtggtccacagccaccctctccctttcttcactctagcctcacgcaccagaaagccccaagtgttcacacaatggagaactgtcagtgtgtggccaaactaaaaccagctgttttcctgtgccatccacaccaagggcctggctgggagtttcagcgcctgctcagcctctcgtgagctccctaccaatgccctgaatttgctgtgaggtccccaaagctcaagtcatgatagactagcaggataagccaagaggtaacacctgctcactcatggtccacaagcaaactgtcttctcgtgagcaggctggcaggtctgtgcagagcaggctgcttttcctccatctgagcatccccagctcaggccagccagatcacaggcagcttacactaagtggcaccttcccctttccacaggcgatggcgatttcgtgaagcccacctggaggctcactgcaggtggaactcagtcaatttatgtgccatgctgtgagtcccccctcagcccagtctgcaggccacctggagccattgccatgtttgattctgttgagtgagggttcccccggtgtggtgattctcagcgtgggctccgggaccagcagcatcacctccacctgggagcttgtttgagatgcggcttcttaggccctgccctagaatcggaagagacctgggtggcagcccagcacgctgtgtttgaaggagccctctgcgggattccgatgcctggtagtctgagaaccactgctctgttgcacgatccaaggagatgaaaaatgagaaagcccagcagctgggtaaaggtgacccacccagcgaatgatctgggaggatctacgcggaggtggggttgttccccagaagtccttgcctgagttgagaaatacctccttccctcccgccacattggcgctttgcccagctgggcctgtgcagcgagagacaatgctatctgggccttgcctctctctgggatagattcattgcatgccatgaataactccagcctcgggtcagatagcaggatgttttatagatgttatttaaaaaacatgccatttgtcatgtgatggagatgagaaaaagtagggagtatctgctgggtccatcagggccttagacatactgtttatgcgtggagtcattcattcattcaatgaatatttattgagcacctactttcctagtctcttgggatagagtgataaaatatacaaaaaagttttgcctcactaagttcactttctagcagtgaagatggtcatgacatcagaccacttatgaaaacacagcaggttagatcatggtaaatgctaaggagaaaaataaagacgtgaagcggatggcagctctaaagaaggtggctggagaagatcacaaaaaagtgatgtttgagtaaagctgcaaaggcagttgagggagaaggcccgtgattaaacagcagaaaatattccaagaggagggaatgctaaatgcaaaggccctgaggtcagcttgaggtgttcgaggacaacaagcaggccatcgtggctgctgtttagtgtccaagaagaagagtaatagatgatgagtttggagagcccgtggggccattgccggactttgactttcactttctggtgagttcagaaatcattaggggacttgaggcaaaggagggatatagtgttacttagattttgcagggcctctctggctcctgtgttgaagtcttcctgagaaaatgtgggtgtaggatgggagacatctgcgtgagagtgggtgagagtggtagcaagggagggtgggagaggcagtcgcatcctgggtatagttggaaggtggaattaacgtgctttgctgatgggttggacatatggcatgaggaaaagaggaagcgaggatgggccaaggcttggggaatgtaccccaaacaaggtacggacaaaccataactaggaatcctcatgagcatagaggcccctttaagggccccttttaagcatcaccccagacactggggacaggaacttctctctaataaacaccaggtaaaacaagaggctcttgcctccttgcctgagctcagtggatcttaattcattagcccagtggttctcaaccatcgtgatgtggcccccagaggcatttgccaatgctcgtgtttctgctggtcacagctgggaggtgttactggtgtctggtgggtagaggccggggacatcctgcagtacacagggcagcgcccctgcagcccccacccccacctgtccaaagagtgacctggctccgagtggcactagtgtcgaagttgacaaatgctgcaggaaaccaacgtgtatttagtgtttaatctgcatcatggactgtgttagcttcgatggagatggattaagaattaagtgaagctggccgggtgcaggtggctcacacttgtaatcccagcactttgggaggctgaggtgggcagatcacttgaggtcaggagttcaagaccagcctggccaacatggtgaaacccccatctctacaaaaaatacagaagttagctgggcatggtggcaggtgcctgtagtcccagctactcaggaggctgagacaggagaatcacttgaacctgggaggcagaggttgcaatgagctgagatcacggcactgcactccagtgacagagcaagactctgtctcaaaaaaaaaaaagagagaaagaaaaaaaaaaggaactaagaggagctcatggtctaccaaaggtgaaaaagattctgtgagatcataagacacattcagtacagagcgatgttcagggcccagcaataacagatatgagggtaccatcaactctacctgggcaggagaaaaagaccctgaaagggataatattaacccatatttctaaaacccacatgatttattaatagattttggtatacaacatattgtccagttttctcaaacatctatgagatgacattattatgattattcacatttacggatgaccactgagtttccaaaagttttcgtcacttgctcaagtgaaagttagtgaaagtgaaagttggccatttgaccacaggcctggactcttcttcactccctcagggcttcttagaagaagctgaacgtctttcctgcattgagagggatagcaaggttctctccacgtgtcagacaagcagtgacaagatgcaccaaatccaagtgccaactgcattttgattttttgtatatgttacacattttagaaacatttattactatcttactttatcacatcaggtcagttcacctgcactcacctttacattaacctcaccaggtgtctccaaaacaatcacattttaaaaataataggtgggtcaggagttcgagaccagcctggccaacatggtgaaaccccatctctactaaaaatatatattaaaaaaaaaattagccaggtgcctataatcccggaggctgaggcgggagaatcgcttgaacccagtgggggcggaggttgcagtgagctgagatcgcgccattgcactccagcctaggcaacaagagcaaaactccgtctcaaaaaaaaaaaaaaaagaaaaaaagaaagtaaaattgttttggttaccaggattcacctggcctgttataaaaacatgaagcaccatactggctattgggctcaatcctttcttctctgaaaaaggagtctttcagacaaattaaaagacgtgcacaagatagaaaagatgtcacatctgatctttgtcatgtaactgcttgtagagatctaaaagcaacacggtcttgctggcattcgtttttggctgtaaagagaaatataaacttaaataatgaaactttctcagggaaacatcgagcccctttaaggggacaaagaactaactgttggtgagctggtggtgactttttaattaattttgtcttcaactgcttcagggaagggggagggaacaggactgttgggaagaggctgaaattccaggtgtaagagagaatatttagtaagggtaaaaataacacacagctgtgaagacaaacatctacggtttcagtttgagcccggagttctacatgaatcactgctgagctccacccgctgctccagccatggggtctgaaacagcttttccactgcctctgattcagaaataaaacagacccacaaattaccctgcagcgctccagacaatcccctccttgtctggggtcctaaaaataccttttgtggtgactggcctcgattcacactatgaaacttgattaggagcttgctcagtcgattaggactaagtatatgcttttaggatccttatgaagaaaaccacctgagaagggatttatttgtattcagacttgagacaggcctggaatgcttgtcccgggccagcctccttgtgggggttctctcgcagaactgacccctttgccctcttagggtagagctgccaaagaaagcctttccatttcttccatgtggcttcctcaccaagttcttcttaatgtgaactaacctaataaaccaaaaggaacattcagaaagacagtgacattccaaaaagcagttgcatgctgaacactgcacaatagtaaaccttagcttcctgacctacctaagagttcaccgaggtacagttatgaacagttgccaagaacaaaaagcctcacatttacacccacatacacgcatgcacagccatgcacatgcagtatgttgctgtgttaatctgtatagtgcttcacagtttgcagactttcttcacaggcatcatctcagggatgtcctcacagcaacctcaagaaagcatccattcatttttatgaatgaaggagttgagcctcgaaaggttaggtgacccatctaaggtcaaccaaggtcagcaatggttttctgactgcaacacgaggggctttctcttgcactgcaggtatgagataaggaactcaatatttaaatggaagattcattcataaatgtactcactcatcctgcagacacttactgagaaaatacagagaatggtgcaattggaagggagacattcctctctggcggcccaggaaaggcttgtagagaacctagaggtgagcatggacaggtgaatagagcaggtaccaggtggtgaacaggtgaatagggcaggtatcaggtggtcataggccttgaaggcagagggagtagcaaaagtgaaggcctgaagggaagagactagggggtgatgtggaatgtggtctttgagcacagagcacatggagttggggagaggggctttggctactcaaatgccagccccatgttaatagagacactgatataactccagtacctggggcagtgcttggcctagaaagatgctccacagatatttgctaaacaaatgagtgaattgaggggctccagagccagatcactgaggagaatctagggaggggctctgggccatgatgggggttaggttggacatgggcagcttgcatttctgtttgggggagagcactctggtagcaggagggagaaagctttggaagagttcggggacatttcaccagcatgtgatggagaacaaggggttggaaagtcgtgtccaggtgcaagaggaattcagaggattaggaaggaggatggctctagaagaataggtagattttcgacaggattagcgggtttgcctccactgactcaaagaagaagacatattgatttccgcaattacattctgacttgccttggactttctccaaggagtgggcccctgctaagtgttctgaagtgagggtgaatcagatttaatgtggccagcgagcttggggctgcccctctgggatgtattcagtgccgttcttggataaatgaggcccattcacactcacaagggctgaggctccatgcttgtcaagctaatggccacggctgtgccatttcattgcgggttctttccatgacggaaattgcctcgctgtaagtagactctgatgtgagaaaaccaaagtcagatgccaagtttattttgtttttcaaagactaaagaccaaattttacatttctcagtatgttttttcagtaatattagtccccaccaccaaccccgctttttttttgtttaaggggtattatgtatggacgacagctcaaggaggctttcatcttggacttattttatttaatcttaaaaaattagattgactgcttccccagtggtccagctcctgtcctggtcctcacctccatctttttgggcctgcagtcagagtcagatgcactcccactcggctgtctcgtcatggggactttttgtctggtttccttttgcacttaagaatgtttgcccatcatctgtgtaaaacatgcaccctgctgggcacagcaatgaagttttggggagaagcatagaacgcttaactgcaaattgagatgactatttcttttagaccaaacttatcaaaacctatttatatctcgacataaacattgccaccttccaagtctcccacggggccctgccttgctccttcgtggctgccctgctcagctcacgtctgtaaccctcatccatgactgtcttcagggccactctgaagatgttcttttagaatacttaatagtgatgaaattaagttttctgaggatccattcaatggtgctttaggtctatgaaagactcctcacacggatttaccaagcaagggcatagagtggggcggtgaagtacttggagtcgagaccatgactatctaggttcaaatcccaattcttccactactggctgtgtgatcttgggcaagttatccaacctctctgtgcttcatctgtaacaaggctcctgctttcgagtatttctgtcatggagatgtgcagatgaaatgaactaacagcaatagctgacacctggcgtggtcatgtgccaggcaccatgttaaatgctttatccatatgtttattataacataaacacgtggaaagagtctggagccatgctcatcattagtcaacagtgaaatactggttggaagattaaccaactgaggcctggaaagagttgtttacccacagtgcatttggtgctcttgggagacataaacatgaccctatttagtgttggtaaatttgaatttaaaatctagaaattaggggtttcagtgcagcagctcatgcctgcaatcccagttcttggggaggctgaggtgggaggattgcttgaggacaggagttagaggccagcctgggcaacatagtgagaccccatctatacaaataattaaaaaacagctgggtgtggtggcacgtgcctgtagtcccaactacttgggaggctgaggcaagaggatcgcttgagcccaggagtttgagactgcagtgagctataatcatacctctgtactccagcctgggtgacagagcaagaccctgtctcttaaaaaacaataaaatcaaatcaaatctagaaatttgggagttatgaaactagaggcatgtataacactgcatctctcaaggttttctccttttttaattacacgtttttttcatgtttttgcattgacttctctgacaggtctgatctttccaatggcagccagtaaggaggagaggctggggacatgccgtctctcatcctctgtggctgcagcatgtgagcactgtgtgcagggagcgtcctgctctgccaccagctacgcctggcacggtgcgggatggtcttagatgtattatgagatgttgggaacgatattgtttactgcataatccagttttcttcatgagaagccccgagaaaaactctcaaagcttaacccagggagagctttatttctgctgaataactggtttgtatgtagcttattaatacctcaaaccttgtcatcagatgcacttgtgtctttgctttggctagtagaaagctcagagttgaattggtatcctacctcagcaggataaatagtaagcttactcagtgggctgctttcatctcttaattcctttttggcccttgtttcctcatttttattctgttaattatttatgttatcattttgtcttatatgtatttttataagccaccccaaacttcacatagcttgcacacaggtaggggaataatggctatttaaaaccactatacatatttataaatagaactctggagttgcagaggaaaattacgaagcccctccctaaaaaactgttaacgaagctaaactcttgttcatccaagtggtttccagacagtcatgtctgggggcttgaaaatggggcttcttccagccctctgattcagtaaccctatgagaacccaactgggcttagcaacgtgtctgccttctctccttaactcaaatttaacaaaatttccaatgtatttgatattctttgccgtgtccttttctcattaattcagaatactagtatgttttaagaagtcagtgctcatgattttaaatgattagaacttaattctccaactgctgtttaagggagattattgtttgaagctcaacaagccagtttcattgggcacgtctccagttactagaagaaggacaccagcattctggttttttttatttccatcatgaatgtttggttgtcttcctacactatttctgtgttcctgtgagtgaccacagttatgaccaaatgccatggaaaagtgtgagattgctgcagaggttacactcctcaaggagtgtggcctgtagtcccagctattcatagggaggctgaaccaaggaggattgcttgagctcaggagtttgaggctgtgtggccccaagggtgttgccagggagttgtgaggtgttatggctggctttttaatatcccagccattgggctattgttcagttctttctcagaattctgaaccagccccccacctcttggggccccctggctaatgtggaatttctgctgctgtgagcagagggaagtatctgtcttcccagctcctgtttactcttgttgatgccacatattgcataggactgtcaagactaatgtctgtgggtgacaaatagaacctggaactgaaaatgtaaatttgagaataacagttcatgaccaagaatccaaaagcaaatgcaacaaaaacaaagataaatagatgggacttagttaaaccaaaaactttcttcacagcaaaagaaataatcagcaaacagacaacccacagagtggaagaaaatatttgcaaactatgcatttgacaaaggactaatatccagaatcgacaactcaaacaaatcagcaagaaaaaaataaataatttcatcaaaaaatgggttaaggacatgaatagacaattctcaaaagaagaaatacaaatggccaacaaacatgaaaaaacactcaacatcacttgttatcagggaaatgcaaatcaagaccacagggtgataccattttactcctgcaagaatggccatcattaaaaataaaaaaaaaatagatgttggcatggatatggtgaaaagggaacacttttacactgccaatgggaatgtaaactagtacaaccactatggaaaacagcatggaaactagtacaaccactatggaactagtacaaccactgtggaaaacagtatggaaaattagaagtaaaactaccatttgatccagcaatcccaccactggttatctacccagaggaaatgaaaaagacacttgcgcatgcatgtttatagcagcacaattcgcaattgcaaaaatgtggaaccagcctaaatgcccatcaaccaatgagtggataaagaaaatgtggtgtgtgtgtgtgtgtgtatatatatatacacacatatatatagacatatatgcacacacatatacatgtatacacacatatatacatatatacacatatatgtatatatgtacatgtgtatacatgtatatatacacatatgtatatatgtacatgtgtatacatgtacatatacacatatgtatatatgtacatgtgtatacatgtacatatacacatatgtatatatgtacatgtgcatacatgtatatacacatatgtatatatgtacatgtgcatacatgtatatacacatatgtgtatatgtacatgtgtacacgtgtatacatgtatacacacatgtttatatgtgcgtatgtacatgtgtatatgtgtacatatatatgtatatgtgtacatattatatatgtatatgtgtgcatatgtagatatacatatatgtgtatatgtacatatatacatatgtatatgtgtgggtatatgtgtatatatgcgtgtgtgtatatacacacacacaccatggaatactatgcacccatgaaaaggaagaaaatggcatttgcagcaacttggatggagttggagaccattattctaaccgaagtaactcaggaatggaaaaccaaatattgtgtgttctcacttataactagaagctaagctatgaggacacaaaagcataagaatgatacagtggactttggggactctgggggaagcatgggagtgggtgagggagaaaagattgcacactgggtacagtgtttactgcttgggtgatgggtgcaacaaaatctcagaaatcaccactaaagaacttattcgtgtaaccagacaccacctgttcccccaaaactatttaaattaaataaaaagacaaaatgatttttgtttgtcctcaaaggagtctgtgagagcaatatcttgaaccacgcttatttgcaataaagaaatttccaccccaaacaaaaagacagatacatttaatatttactaaatgattatctgtttgacaggcacctgctgaatagcctgagaatattctcaggaactgctgcaacacacatatgcaagtatgtgtatgtttaaaagtatgtgtatgtttaaaaggtaactagtcttcatttcaggaaggcatcagggactccctgacccatacactactctggtttaaagtgtacattgcagcactcatcctgacacactgtcctacttcaggactgttcattccctgcacagcatactctttgtcatgtgcacaataaaacaatgcattgaacgtccaaatccttatcatgtgagaatggagaacacgtggtcctctatgctgggcagcgcttggtgcaggtgacataccaagctgtttgcgggaactttttcccggcgatgtgtgagcctcggaatgcctggtgaaggtggggttgcagtggagtaatcaagacacacatttgtgcagtgtggatcttttcttgggcacagagctagaaatgtatttatagtgagactttcaaatgaacacttttcagttctctgaattgtgataaaatttccttttctttttttctctcttttgttttttttttgagacacggttttgctctgttgtccaggctgcagtgcagtagcatgatctcagctcactgcagtctcaacctccccaggctcaggtgatcctcccacctgagcctcctgagtagctgggactacaggtgcacaccatgcccgactaatttttgtattttttgtaaacacatttttcatgttgtccaggctggtcttgaactcctgagctaaaacaattcacctatcttggcctcccaaaatgctgggattatatgcgtgagccactgtgcctggcgtccttttcttaagtaaagcagatatctctgaaaattcttttcttctccaggaatcactcctctttcttatttgcatcttgtatatgtgccctgtttgtgtcatgcacatgcttttcagggaatgaacagtcccagggtaggagagtatgtcaggatgagtgctttagtgtacaccttaaaccagagtagtgtatgggtcagggagtccctgatgccttcctgaaatgaagatctagttacctttgaaaagacattgtcttgcctttactttgtggagtcattctgttcagggttaagaagcagggatggagagttcgggccacccgcactgaagtctcattctacctcctcctggctgtgagtcctggagccagccccttgtgttttgagtactcagttcacacctctggaaagtggagacaatgccagcaacacagttcgctgtggtgaagactgataactattaagctcccaaaacagatcccaaacatgttaaggctactcttttgctgttaaaatttgcaagagaaacctgggtgaagtggctcacgcctgtaatcccagcaccttgggaagccaaggcagaaggatcaccttaggtcaggagttcgagaccagcctggccaacatggtgaaaccccgtctctactaaaaatacaaaaatcagccaggcgtggtggcaggcgcctgtaatgccagctacttgggaggccaggctggtctcgaacacttagcctcaagtgatctgcctgcctcagcctcccaaagtgctgagattacaggcatgagctgccgcaaccagcctgaaggatctactttaatgtcacagagaaactcttgtgatctatgcctagagttcttgtcctcggatatgaaaattaaactagaaagaactaaaagaaaatgaaaaaggggttggtctgaagggttcaaaatcctcaatgtcccctgtttctataattctttttttttttgacatggagtcttgctcttgttgcccaggctggggtgcaatggcgtggtcttggctcaccgcaacctccgcctccctggttcaagcgattctcctgcctcagcctcccgagtagctgggattacgggcatgcaccaccacgcccggctaatttttttttttaagtagagacagggtttttccatgttggtcaggctggtctcaaactcccgacctcaggtgatccgcccagctcggcctcccaaagtgctgggattacaggcgtgagtcaccacacctggcctgtttctataattttatacatctctttgatcttttacttttcaaattgttaactgcgttgttggagaagaaagaattgatgggacctggtatacggccggcacttgataacagctgtctaaatggatgagtgaatgattgaatctgaacaaaggttgtctagattttatagttgttacttgagttactcacatcatctgggcaaagtctttttcctaaagaacctaatccctctaacttctcttccctggtaacttctctccttgagacaaatataccaaaacatatacactctactcaactgatggaattttccagaggaataggaaactcagtctaagtgaagacactctgtgttttcatattaggatgggtcttttagagataaatgtgtgaagccaggaaaaatagcatcaagaggaaataatgcatgtgtaggcagcggtggaaatattcaggatctacttcatgggaactcagaccattattattttaaaatttccttcatgttagcacagctgtgaggatgccatcaggcagggctgtgcattccaggcccatgttagggcctgagtcctgcgtgaccctgactgtaacctccatccgcagatggcagtgtaccctcttcactgccaacacctaagatccctccataggcttcagacacatttgtaagtgatgctgagaacaaacctatattttcaagttcccacatgctgaacaaacactttcccttcctgtccacatcccagctatggctttcaggtgtggaatgaccttctccatctcaccccactcagaaagtgcgctcctgcctcagatggttttgacctccttagacttgaagttcacatccatgccaagcccatagttttttgattgtccaagttctctgcagaactccaactaacaagaagtggaggagataaatgaggcttcattggcgtggatcccacaaccagaaacactgggatagaaatctaaaatctagagaaagcgaaggttcccagattccaaggaatatgaaaaaaatgtatgcattggatagagcctgagaggcatttctggaaatccgccttagacaacagaccctaaatattaatacttctcagctacagtgaccctgggtttaccatctacgtgttaaccatctaagaaggcactgacatgtattttctgttttctgcttaagctggattttctctctcttttctttctctctctttctctctctctttctttctttctttcctttcttctttttttgatggagtttcactcatgttgcccaggctggagtgcaatggcgccatctcagctcaccacgacctcaacctcccaggttcaagggattctcctgcctcagcctcccgagtagctgagattaaaggcatgcaccaccacttgcccagctaattttgtatttttagtaaagactgggtttctccatgttgatcaggctggtcttgaactcctgacctcaggtgatctgcccacctcggcctcccaaaatgctgggattacaggtgtgagccaccactcctggccctaagctggattttctttttagcatttccctatcagatgcgatttcaccaatgtcctgtagctttcacaactcactgtttaaaatgttttccttttctttttccagaaaggtaggtttgactttatccaaatgacagtgactgccttactaacagcagccctgtgacctgttgcccacggtcagtagtcagtagctgacccctctctgcatccacacagttccttccctatccctttcccaagggtcctctaggactgctggagtccactccccatgaggcctcccctagcgtcagtcctcacccttccctgcccttcctgtctacacctaagcctggaacactgtgagtcttcaaagctccatatgtaaagattggctgcagggatttgaaattgagcaggaggatttcattctgaggttttgagaaggaacgtcgttccaggataaacctcactgagcagcgagtgtccctggtgccgccccacagcatctgtctactctgcctgtttgctgtcacaccgcgagaacaaagagcagttcactgttccctgcaagtgtccccaatcagttgtcacagatggagttttgacatgacagtttcaggaggagctgcttaagaaacagaagccaggtggtagttccgcctcccttgtgcgtgttctgtgcatctagccagtatgggcactgtcctagcctgtgcaggctgccttcacagagccccacagactggctggctgaaacaatgggactcgagcttgcatacttctggaggttggaagtctaaaatcagacaccagcagggccagtctctggtgaggtctctgtccttgggttgcagatggcctggccaccttcttgctctgcccttacatggcagagagagagagagagagagagagagagagagagagagctcgagctctggtctctttcttttctaataagggcactaatcccatcgtgggactctaccctcatgacctcatcaaactgaaattacctcccaaaggctctctctcctaatatcatcacattgggagttagggcttcaaaatatgcatttcgggaggacagaaggcaaggcctgttttcggcatttcttttcttttcttttcttttttgttttgagatggaatcttactctgtcgccagtctggagtgcagtggcatgatctcagctcactgcaacctccacctcccggattcaagcaattttcctgcctcagcctcctgagtagctgggactacaggcatgcccagctaatttttgtatttttagtagagacggggtttcaccatgttggccaggatggtctggatctcttgacctcatgatccgcccacctcggcatcccaaagtgttgggactacaggcatgagccacggcaccccgcctgtatttggcttttcacacttgtcctttctcccccagtctcttccgccttgcccttctttggttctctctgtgtattgtgagaagtcgatggagacatgctctttgattgctgttataatggaagaatatttcttctcctccaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcaggtcaggtgcccacagcttcactgccctcggcagatcgcaacttccccaaggctaggctgagcctcagggagctcttctcccccacctgtggcattgatcacatctcctttgtccagagcagggcttgtaaatgggagctggcagaggtctatgcatgaggacatgttcacggatcgacagcaaagcaagaaaaatacacctgtatttaaaaatacaaatatttaaaaaatatgtgagacagcagtatgtagccccagctctttattttgccacatagagaaaaatacacacacacacacacacacacacacacacacacacacactacgtatggagagagacagagagaaagaggatgtccaggcaaacatgcagccttgcttgtgtgcacacacatatgcacacgtgtgtatatgtctatgaaaggtgacctttctagggaggaattgccacttcttggagattattgttccaaatatcctgtccttcatgaggtactatttatgatagatgatagacttgtttgtttttaaaattctcttatctggaaaaataaacatgtgggagccatatattatatggctgtcttacgtgttcccttaagcatctaaaattccagctatcactggcctgtaatacagattctaataaccagagtaactctttaccacaaacataattcaaaaccaacccaaaggaatagctcttgaacttgaaagacgtgacaagaacttatttatttagccaaactaaaggtaatagaaaaaatgacttaaagctcctcagaggatacatgctacctaaagccagaaatataagaacaacagcaacagtcaccagtcagtgaacctttaccctacaggaggcatttggataaatgctttagaaacgtgatctcaagcaatctttgcaaatggacatctttctcatgatttccctgatgaggaagatgaagttcagagaggtccaccaacttttccaagggcattaggctaataagaggccaagttaggactcaggcaggtctgccttactcctttagtctctgcctgttggcattggattaaatctcagctgcttacagcaatttctgtgggttccctcctgttacttgtttcagccatctggtcaccctgcggtcctgcctcagggatttgaatttggcgtcagctcagcctgaaacccttaattccaggtagttccatatcattttccttcaccaagtatccgtgccaatgtcatggcctcagggaggccagtcctgagcacttccgtctggaattgctctcgtctccacctgtgactgccagtctcctgttggcctgatttttcttgatttcattcattcccttctgccattatattgcatgtttatgtaaaagttttcttactggccagccatggtggctcacacctgtaatcccagcactttgggaggctgaggcaggagaatcgcttgaaccagagaggcagaggttgcagtgagccaaaattgtgccattgcactccagcctgggcgacaagagcaagactccgtctcaaaataataaaaataaaaaaataaaaagttttcttattatcctcttccctgaatggaacataagccccacaaaggccctatctccagggccagttgcagtgcctggtaagtgggaggtgctcagtgaatattaagggaggtggagaatggatgaacggacacctcaccactgagctgcactgtacaagttactccttgttggcaaagtagccaagggcatgcatgggtgaaatctgcacaaactcaattctcccttgctcctggggtcacctaaattaatatctgcgaagtgtgatggcaaacaggttagattccctccatggtgtgactttccctttacctgagttggatcatgcccagtgggcttctgtcaccttctagacagaagagttcaggagtgcagggtactttgcaaaacatctggcctggatttgaatcccaggtttcagcttagatctgtcaccatgtgactttcagcaaacacgtaaagctggttcgatgcagtggggtgtgaaagggaccatcctttggggttgtgcctgatttcaaagcattttttaagacttacaggagacactgatggtagattacgaaagggagaaaaccgtccttagtatttactgaaaggcagttgacaggtacagaggccatgcatttggtttgatcttgacaatgcacctgaatgcctgagactgcctcacttgctgctgtgcctcagaacagggggctgttcctgttggatgggaaaaatagaaacacaaatgtcccaggtgcccactccagatgtgtggcacataagaaaaactcgaaggctaggatgtgcctggaggagaggcaggagggcagtggtgtgttgcccagacactctctgggcatgaacaaagtgaagtagacacccaaaggaagccccctaacccatctcaccctttgccctcctccttaagaatgtaatttcttcaaaggagacaaaacaaagtgtttagatctcaaagatgagagaatccatctgagggggcctgcactgaagattccttgcttggttcctcattgaatcacagatgtaagaggtaatgcctggtaccatcttctaactggtgaggctgtatttccatgaggccatcaatatgctttgatgtcataaatatccttttcagtagggccagacttgagtctttctacactaaggaaagtatttagaaaataagagagatatttgtgtggggaagagaacagagaatcaactgaagtcagagcacccaggattttttatacatagtagctgctcatcaaatattagctggatggatgcaaggatagctctgcaaattggcttatagtaagctttgatgtgaaggctgtttcctttctttggagcaaagtactcttctcttcagctcttccctccttcagttgcttcacgccagtgtaggcagttattcagttaatagtgtttgtaagagagctagttgtggctgattttgcaagttgtgagtctttcagttattggtcaagcttcatgtatgtgtgctcatacacacacagagatgaacacacacacacacacacgcacacacacacacagcttcattgcacaatctggacaattttccaatgtggccatgaggttgcaggacctcaggcagctgtaccagctgctgtatccatccccatggtatccaggcacctcactaaggcagatttggggcacggagtaccccatgtgtgcaaaaagaattctccagacctggtcctgagtggttcacatagaccttactacttagagacattgcttggcactaatgcaaatcacacggatagctgagtgaaaaaaaaaaaaaccatcagttattcctaaacatttgtaccatcatcaatacatgccgatgtttacacactagagatagcagtggccctaataaacactgatgaggaaatttgtactgtacggagactgagagataaaaccacagaggagctggggggctttgtccgtgttcagattgggttctggtacctggaacccacttttgagaagcgattccctcaaccctggttttgatactcatgatcttgagttaataaagaagcccataaaaaaagtgtcaaaaaaaagcccataagaaagtgtcaactagaaaatgtccctgaaggataaatgtagactgtcacttgatatatttacactgcctcctatttcagaacagatttaagaaagctcacatagatacatatgaaagagcacggtagaatccactttttaaaaataaaggaatgtggagaatggactaaagtaaaaattgaacagagagagtaaaaccaggagtgaggtttacacgcacgtgtgtgtgtgtgtatgtgtatttttaattgcaacatttaaatattgcagaattgcaaaaggtaggtgttatttggcttcgaggtatcatcaggcagtatgaaagggataattcagtgcctacaggataaaaagaaagcaaatgtgaaaagatggtccagctattaattctgagtctggaggaagatgtgttcctctgtttgtcctaaggaagataaggggagtcatgagcaaagcattcaaccagtagcgccaccaggcattctgggcagccctggtttgtgcctgttgttctggcaagactgttgattgtgccttcccaaagggtactggttaggccataattcccatctctggtttttatctatgtatttggtgcgagtatctgtaaatctaggaggatctctcatagggcagggcagtctcttacactgtcgtaaacccaagtgtcattcagtgaaaccagttgtaataagaggggcctgacaagtgtgacatcccccatgctggttacatggctcttttttggccgagcttaatttggaggttgactagaaagtgtttttctttttctttctttctttttttttttttttttttttttgagacaaagtctcgctcttgttccccagactgaattgcaatggcaggatctcagctcactgcaacctctgcctcccaggttcaagtgattctcctgcctcagcctcctgagtagctgggattacaggcgcccgccaccacgccaggctaatttttgtatttttagtagagatggggtttcgccatgtttgccaggctggtctcaaactcctgacctcaggtgatccgcccacctcggcctcccaaagtgctgggattacaggcatgaaccaccacgcctggcctagaaagtgtttttcaaagtatggtcagaaccacttgtatcaagattacctggaaaatttatgattaaaaatacacatttcctgccagtcacagtggcttacacctgtaatcccagcactttgggaggccaaggagttcaagaccagcctggacaacatagtgggaccccatttctacaaaaaattttaacattagccaggtgtagtggtggttcctgtagtcccagctacttgggagactgaggcgggaggattctttgagcccagaagtttgaggctgcagtgaaccatgattgcaccacttcactcccaccaggaagccagagtgagaccctttcccagacacacacacacacacacacacacacacacacttccaaatgttccaaacctgggtgtggggttggaaattttacattattaacatgcttattgtgtatgtaattttcatgtacaataaggttgaaaagttctaatctagatagaagatataaattttactttaatagacttgaattatttttaataaagatatggtttatcacttttagaaaaggcaagtagacaaaaaggaaagatagaaatgattaacagtatcacattaacattccaaaaaaaaatgaagaatcactcattgcagtagttactgttactctttaggtgttggctgtgaacatggagatgtgctaaccaagtggctaacaaagaggaaggcacaggctccattcacttcttaaaagttgcaaaatgctgaccaaaatgcaataggacctctcgctttagcagcttatagcattttgaaagatttctctttttctgtttttttattattattttttatttatttatttattttgagatggagcctcgctctgttgcccaggctggagtgcaatggcgcggtcacggcttactgcaacctctgtctcctgggttcaagcaattctcctgcctcagcctcctgagtagctgggatctcaggcgcctgccaccacagccagctaatttttgtatttgtagtagagacggggtttcaccatgttggcaaggctggtctcaaactcctgacctcagatgatccacccacctcggtcacccaaagtgctgggattacaggcgtgagccaccgggcctggcctctttttctgttttaattccttaaaataggtgctaaagtgttgagtttttcaaatgcctctgcttctatttttaaaataattcactttcagcatagacccttgcaataatcagtaatctcagagataagagtagccacattcttctcttcactgtatctcttcactttcttcattattaattcattcattaaactcttactgtgttccattcaccgtgaataaaagctctaatgagatttaaaatcaccttttcttgcccaccaaacatgtgtggctgaagctacatgacttgtgtcttactcagacccctgtgctaggacctttctattccgttagaaagtgttcatggagttcccattactcttaatcactgaggagatgaccgaaggctgtcagaagtagctaagacccacccatgtggggtaagtagtttttgacagacaggagaaggtgtgattgagagctcaaatgaatgactcagaccagtatttcagagcatgtgaggaatggagattgctatgacaggacgaatcaagaacagcttcatttatacccacgatgatgtgatttcgaaagccctttgcagcctctgccgttttcctctgccacatccccaactcacgcgctgcattttcaccacccggtgtccttgtccctgcggttccctctctggaatgctcttgctcattcttccagacatcttcaaaatctgccctgtcaagggagccatgcttgatcctctggcaaattaatcactcctcttatgacatcttaccaattattttgttatcatactttattttgtttcatattgtattctcaaatgcatgtatatacttacttaaatgtggatattctgcaaaggatttgaggtgccgtgtgaactaaactactgatgggcttatacccaattgacttatcaaatggaaattaggaatcagtgctaaggcagttaaaaatacaaatgagaagccaagagcatgtgagggaagaatgcagccattttgaccacaagcttgcccaagatgctgtacttaagtttctagtatggctttgagcttcctggcagccaaaatgaaaagagttatttggggaaataatttttcctttcaaaaaagaagtttcacagggaaggcaatgtttatcatagtgtagaatcctaaaagaaggatcccttttggggccactggggccatagacctgaccatcgaccgtcttcctgccacagttgcagcactgcatttcaacagcttatttcttgtgacatcttctgtgagcgctgagttacattagagaatagctcagcacaggtagaggacagacacccagcatgagtctttggcagtctgatttcatgtaaagaagggatcttgagttctcagagtgttagaggactgcatagtttccacatgatcctccctaaatattgacattcccccactgggctttgaaagccagtgaataacaagtaatagaacataccctccgaccaagccctgatggctgatatattatgtttccaatcctcttagcgtgagttatttataagcctgtctgttctattagattgtaagtttagtgaggtgatgatcatgtcttttgtgttctcaatcgccagacaacacagccagcacttggattctgtgtggaggagagtaaatgtgatttatcaagttaacagtaatctagatctaactagcaggaatcgcagactcgcaggggttgcaggattcttggtggtctaagttcagtcttcctttaaacatgagaaaaccaagactgagagaggtgaaatgactttcccgggaacacttgcacaactgggtgagaccagagcctattctcaggcccagaacctgctggtgaaatgacttgtgtcttcatctttctttgttacgtccctgaacacacccgaggatctcttccactctgtcgatatgatgggacatgcttctttaatcttctgtttaaattcctgctatgctcaaacaactaaataacaaaacccactaaaatagaaatgctaacatcaaagtttattatgtgtattttaaagttatcagctgaatagcggttgaggaaaccaccattgggttaaatgtgaggctaaaatcaagtcatttttctaaaaagcaacgacagctactatctattgatatgcactgttgtcaggcacttggacatgcactttgtagaaaaggcattatctcatttaaatcatgcgaccaccctatgatgtaggtactcattatcattctcactcgacagtaaagaaactaaaactaggaacgctaagagagttgccaaatatgtcacagccaatcatttgaagagccaggattcgaacccagttctttctgactccacagtctgggttcttcttcctaagctgtgctgacaaaaatacccaggggagaacacaggaatgggatgagagaatgtgtttgttaaattgttgtagacattctgcaacagccttttcaaataagacttaagtaaacaaaggaggtggagagggaattttgtaaaataatctactgtgttgcccagggctaatttttacatttctacagtgctaatgatgttatctgtttttcttgaaagtcaaagagaagaatggaattgaagacagcttagatttagcatgagcagctgggtaggtgttaatgaatatacaaaaaaaaaaatgtttaaaataggtgatttcagtttggttcatcctgtgtttaagatgcttctgggacacctgtcaggcagtgtggtgggcctagagctcaggatggaaagtccttgatcgggagtcacagcacttgagttctaaactctgccatgtactaactgtgggatctgggaagctacttaatcttgctgtttctcaggtttttcatcaccaaaatatggatgataataattcctacttcatgtggtgctatatggattaaatatagcaatatgtgtgacatgcttaaacagtacctgggataaaaagtgcagttcttctgtttatatttgggtctggcatctgtgagagtgccctggggactcaagatatagactggcagaaacagctgcctgttacaggttaaaaaattgtgcctccctcacaagatatgctgaagtcctaacccccagttccttagaatgtgaccttatgtggaaatagaggttttgcagatttaatcaagttaagatgaggtcattagggtgagcctaataaaatgactggtgtccttacacaaaggagaaatttggacatagacacacacagagggaagatgatatggaaacacagagggagaactccatgtgaagacaggcagaggttggactgatgcaactgcaagcaatggaacattcaattgctggacagcaccagaagctagaagagccaaggacagattttatccacagtctcggatggagcaaggccttgctgataccttgatttcagactttgatcctccagaactatgagacgatgaatttctgttgtttctaagccacacattttgtggtacttggttacggcagccctaggaaaataatacagcatgcatgttatagttcaaacatgagagcaaataagaatgcccaaagatacatatggagagaggagaggggtagaccaaggatgaaactctggggatagcaacatttaaagagaagacaaagaaagaaaacccaggcagggagaaacctttatgtggaacaagccattgcatttctaaaacatgatgagcacacacaatgttgtcatggaataacaggaggcaacaacaacaaaagaaaacaaagaacaataacgatcattatccaaaaacaagatgattacttgagaatggtttcatccagagaaataaatcagtgtgtcagaatgacaaagctatgtttagagcctaacaaaaataatttagtcatgtatttttaaataaaatacacagaattgtagattctcaaacaagtagaggacaggcactctttcttgccatttttgaatctttcatagaggattatacaattcatataagtaatttttgacaattgattaattaataaatgaatgaagtaaagcataacatgagttaggatgatggctgcattaaaaatgaaaactattcaaagtaaataggtaaaaagtatgcagagagggctcttggttctagtaaaatagagaggttactataaaaggacctgagaaacattccttttgcaaaacacctggaattgctgcatggagtttaacatccttttaaatgcacagctgaactgggaagaaaggcaatgaactccttagggactaaaataaggaaaaaagtgagaatagagcagagcagcacattcttatgttgacacctggttgtcctaggttgctataatgcagagatttgggttttaaaggtcaactaggggcaaggaatgaaatcttgagcttccacaaagcagagaattggaactgagcctgtcattacccgagtccccaccccatacacacaacagtgtgtgccaggaactctaaggctgagaaattaatacagaaaaatggtcatgggctagtgataatctgggaaacctggcagaagtaaatacgaaatcttcatggagagacatgtcttcaacctacgctgtacagaattcctgcagatagagacccgctaaagatgactctgccacccgcaaattacaaaaaaatagctgaagagagatctcccccaaccaagatttaacagaaacaatgaacatgattaagcagaaggttaaataattaaagtattggataaagagtataaaataaataaactttttaaatattaaggaagaacataaaagaaggagttaaaaagagagtttgttgctaattgaacctcacttcagataataacaaaagatttaatttaaaaaatggatcctagaagaagggagtgagatacaggaaggaaatgggagcaatgaaattgattaaggtgagggtagatctagaaagaaatggctgtaaaatgacaaccacagcctccctaagtagggagtagaaaattcagtggagtaaaaatatgagggaacattgtcatgtaaaatcagagatggatgattcaagtataagctttctaaattactggtaattaaacttagattttgtttaaagattaacaggaaagagaactagaatgtcaaagagcaaaaccaatacagaaacaaagaaaaaaaagtgaatgaagaaaagtagatcaatctgattagacacttggcaaggagaaatagagaatggactaagaaagtttaacataaagcacaaaataagatggtaaaaatcagatagatcagtgataataagtgtagatagaccaaatttgccattaaagacagagagtgatagactagactaaaaaatactccacaatcagttatgggttgtttacaaaaaaatcttgcacaaacaaagattgagagttgacagaataagatacgctagtgaaaattgaatttttaaaaagctgacaaaaatagaaatagaaagcagactaaatatactttcaggcagaaagcataactggagataattgagggtcattacatagtgaaaaaaggctaaattcatgacaaatatataataatgataaacttacatgtacctaataacatagccttgaaatatgtaatgaactgcaaaaagaaatagtcaagtccaatttagtgagatattttaatttgcatttctcagtaattgataggtcagtgacattaaaattaaatacaccttaccaagagttttttttctagaactctgtactcccaaattagagaatatgcatttcttaagcaatcaaggaacatttataaaaactgaccatgcactaggccgccaaaagagtaacaaaccggaactttttaaaaagctaatttcagctgggcatggtggctcacgcctgcaatcccagcactttgggaggccgaggtgggtggatcacctaaggtcaggagttccagatcagcctggacaacatggtgaaaccccatctctattaaaaatacaaaaattagccaggatggtggtgggtgcctgtaatcccagctattcgggaggctgaggcagttgaacctgggaggcagaggttgcagtgagcccagatcatgccactgctctccagcctaggtgacagagcgagacactatctcaaaaaaataaaataaaataaaatgttaatttcatacagactctattcactggccaacgtgcaataaaattagaaatcaataccaaaacaataaatgaactctacatataagttagaaatttaaaaggctcagaaacagtcttgaggtaggctctttatttgagatcaaatttccatttgtgatggagtgaatcattgctcaaatttaagccagttctctctattgggcctgctttataaatgtaacttctgtcctcctgaggatgcaagatgttaaatcttatttttgcaggcttatgagtgtcttggacagcagattggctgacttgcccagggcctggatttataaacaaacacctcactaggcttgtgatatggcttagaggtacattttagtttttattttttgatgtttttttcataaccaagagtaatttttttcttttgggaagccaatattttacgttgatattatttaagaaaaataacattcaggactttcattatcaccagtttggcttttatttaatcttactttattcatttctctagaggggcctctgaaagaagatgtttgcctgtgtgaggcattttgtttcacaaaggcacagtttgtctttggcgatgcagtgcccctttgcctgatttaaatatctactcaatattttcctggcaacaggggaactctactaggtcagaatcctgtttcatggaaatattttttttaaatgtcagccttcctccctccctcccactgcttatacccccactcccactccacatacagagtacattaacagtacaactccagaactctgtgtgtaatggtttacttttatttgttttttaaattccaatttaccaaagtagatttcataataaccatgtaacttaagatacaaataagaggcttcagagagtgatggcttctgtttagcctgtgccatgacagtttaccattttggtgtccatgacatgtagaatgatgacacagatgttttcaaaacaattggaatggaaggctgaaaatgaacaacttatcttcaatggcttatgattcatctgacagaagcatctccaaaagtttcttaaaataaaattataaattggacttttgtgtcttaaggaggaggctgcccctgtgataacagattttgttcttattccattttagcagagtttgcaatgcaaaatcgagtgtgtggatgcattctttttttgcagtatgttattgttggcaaagtgctttcacatccattatctcatttacttttctattcccctaacatttcatttaattacccacagaaaaatataaaacaaattccagagaggttgacgtttacgtccagtaaatggttgaataagaatcccaatgtgggtatttggattcccaataaagccttttattttcatcaccaagttttctgtgattggtgttatttaagatttttaaaaatttcttagaaattttcaattactctgaaatctctaaaaatgaaaatccaaccttgttagcaagactcaaggaccttgttgatctgagcccagctttcatccccatcctcgtatgttgctgtgctctctctgaaatcctccactgcagccacaccaaatttctccctttttcttaaacatgtcagatatttcatgcccatgtcggatgaggctgggctaagtggttcccctaaaccaaagagcttctctctacttctgtcaaaatcctcgctgttaatccaagttcactctcctggtaagcctttcccatttttcctggttggtgctacctctctgcacttccacttcctccttggatcacggagtctttttttttttttttttttttttatgagacggagtttcgctcttgttgcccaggcttctggagtgcaatggcgcaatctcggcttatcgcaacctctgcctcctggattcaagcaattctcctgcctcagcctcctgagtagctggcattacaggcatgcgccaccacacccggctaattttgtatttttagtagagatgaggtttctccatgttggtcaggctggtctcaaacccttcacctcaggtgatccacccgccttggcctcccaaagtgctgggattacaggtatgagccaccacgcccagcctgatcacagagacttagttctgctttgtggttgtggtcataagctgcctctctcagtgggtccttagtgtttctcttggtcttggacactttggaatctccatagtactggtgcatatagccatatgcataatgcttaatgacttttacttgaattaaatctatcttagttcttatcctattcgagtcatttctcaggtcctgaaattctccacattgttttacagaagagaaaaatgaggtccagttataaaattaaatgacaggttccaaacacactgctacctggagacaagaggtgttcctacctagggcagaaggtcgcacctaaacataggcaaaggtgatgcctcggctggggcttatgctgtagtcccctccccttcctcctacacatgtgtggttggggtcaagaaaggaggaagacaggcctgctgaatctcataggaactcatgagcccctttctttgattcctggtgtgacagaagccataaagctttgctgagataccatggagtgtggaggagactagagagactactggggctcttcatggagttaaaaggttagggccaaaacctgacagcctggacccagtgcactgacctgaactctaaaaaccatcatctacagctgcagcatcattgcctggccaaagtagtggaggtggagttcagtgtgagcagagactaggtcttcagtcttgttatcacttcactgcccagagatttgttaagtgtttcctctgtgagaacatctaggacagatgcccaaaggaggtcgtgagtgtaggtgagggcacaagaaggtgctagtccttcacgctgtgggtggcatgtggcacaggcatggaggcattggctcaggaaatgtagggtggagggggaatggttgggaatgacacccatggaacaaaggactgtgtgcttcatgctggggaatctgggtttttcccctgcaaactgtcctctattgcaacacctccggagtgggtctgggagagtggtgcgagtgctcaggagaaaaggaatgccctcatttcttctaccgagtggccatgttttgttttcaccattgtttgcttagaaatttatagggcagaggtgtggagatcaaatgctaaaaggatgtgggagtgttctgacttcatgtaattttactcttttcagatgaagcagtctatattaacaaaatataaaagaaactgaaacttaactttttatactcttgacagcaattttataaaaatactttcacatatatactatatataggtagtatatatagcatatatgtaagtatatattctatatatattatatattttattattttataaaaatatttttataaagtattttagtagttttattttttatactttttataaaatgctttgcatagtttcatttttttaacttttctttttgtttttttacttttattttttatacttttaaaaaatactttttataaagtatttaaagtattttataaaaatactttcacatatattatatataggtgatatatagtatacatataatatacattaaatatatatataccttttgtaagaccatgttttggctttgaaaaatagagaatacattttgtataaataatttgtaacccaagtattccatatttattatagaaaaatgagaaaatatagtttagtgaaaatgacaaatctaaaattccccatctcctttccctcagtgacaacagttcacgttttgctgtatctccctctgaatttctttctgtgcagatatttatatatctttgcaaaatacaatgatatcataataatattttgaaactttaaaatgcaatctactttgaacattttatcatatcaataaatatatttcaacagtgtaatttttagtctctaaatatcacaggaacattcctaaatgcattacaaaactgcttctcttttgctggacatttagggtgtttccaatgttttgctattataaacaacactacaaagaacatccttgacaataaatcattgcgcacatcctctattatttccttaggataaatttctagaaatggaatttttaagccagggaatctgcacatatttaaagacgtttgattgtattgttgtgttgtattgttgtattattgtgttgttcatcagaaaggctgtagtaatttatactcatattggcagaactccggaactccagaacagccttttaccaactcaaagtgagacttgtagagataagtacaatacaggttgaggactttgtctctggggtcttgcacctgattcccttaaaggaaaactgaatgggccaggataacccttgtcttgatgagcgaaaccaattaaggggcacaccaagggataatagagagattaaacttctcctttcaccattttaacacgaacctagtggctttcagacaatatgtttatgtgtcattttgagaatatccggttccaccatttagagaagaaagtctgttcccagaatgaacttatttctaggaagtacagttgttacattaaaaaaaaaatagtcctcccattttgttaaaagcaaagcaaaacaaaacaaaaaggtgggtttcgctaacatcaaaggatggaacttacagggaatgacttgggtaggatggggggtcttctctctgtgagggctgaacaaactatcctctgcacagaaccaaaggtaaagagaacttgccctaagacctcagtatgatccatttttgtagaaagaggaattctgacatgtcatgaaaaaagaaacattttatctctgaaagccaaattctcagccaatgacgaagagtcatctgaacttcagtgaactggataacattaaccttccatatctacattcagttttcacagactaacaacatgtttccaagtgtttggatgacaaataaatatgtacacttttctgtcatcactgccgttggagtttttgttgatattctctctgtagcaaaaccagagttccctttagttttcaggttctgcgcactgatgatttttttttttttttttttttgagatggagtctcgctctgtcgctcaggctggagtgcagtggcctgatcttggctcactgcaagctccacctcccgggttcatgccattttcctgcctcagcctcccaagtagctgagactacaggcacccgccaccatgcccgactaatttttttttgtatttttagtagagacaaggtttcactgtgttagccaggatggtctcgatctcctgacctcgtgatccacccgcctcggcctcccaaagtgctgggattacaggcgtgagccaccgcgcctggcctgtgcactgatttttaagtgagaatgtgggtgtttaaatattggtagacatccaatgctagctggtcaagttgaagatggatgtgccctgtaactcagaaatcccgtatctaggtactcagccaaggccagcgtgtccccaggtttcatgtgaaaatgtagattctggttcagcaggtctgggtggggcctgagactcagcatttctaattagctcccaggtgatgctgatgcttccgcggttggaggaccacgcttggaatagtgaggcccagggaagatgatctgaaccttggctgctcattagagtcacctgggggagctgttatcaactgtgatgcccaactgccctccagcctaattgaagcagactctcccaggggagaccaggcatcactagtttttcagtctccccagatgattccagaaaggaccccaggccctggaccaatgcggactcattcacgcgtatgcatggagatggacaggggacattcactaaataaattgagattattcacatgggggaggcctaagagctgcttaatgattgagtatatctttgtgaattcatttggctacatcttgaaattataacattgagtgccaatagcaaatcatatatcgtttatgttaactttaaaaacacaaaacaatatatgtagtttaaatggtaaaaatattaaaatatgtataggagtgatacacgtactaacttcaggatagtggttacttctaaccactagctactaacttcaggataggtgtttgcagtaggagaatggaatgggaaaggtagattctactggacctgcaataatttctttcttctatgtagctgaagggaagaaagggagggagaagcgaaggaaggaagagggaaggagggagaggaagagaactctgggtgtatgactggctggctgtttctcactattattacggtttacctctgcaaacctaaaaatgtattgcagcagcatactacatgctccattcttgagtagcctaaaatattagtgggaccaaacaaacaaggatctgaaagtattagctaaaatgtgactcccacacctgactttcattcaagaggactggaacatcctggcatgcctgacccctaagggcttgtcccgggaactgagatcagtgctcttagtttacaggtgggacagacacagaaaggagaaatagctgcccacagcaaggtccagaaagtggagaaatggtgggattagaactcagggctccaactccctgcccatgtgtctctcagggctcggggcccaagggagcagccgccccatttaccacactctgaagaccctaccactgagggtgtttaccacaggacatcccggctggcgtttctgttggagatcacctgctccttctcccccgggccctgctctccctgtcccataggtagcactggagtgtgacgacgtggcctgcatcctgtggggtgtttgtgctcgccatggccagctgtggaatgcaaaaaccactcaccaaccccactcctgcaggtgctggttaattgcaaaaccaaacaccctgcaggaaaagtctggaactgacagctctctatgaggaacgctggctcataggaggggctagagtcttggtgtatctatatttcatttccgattctgtggtcagtatttttcagtattttgcataaatactgttattattatttttgttgttgttgtgatctgtaattagcaccttcctgatatgtgtggcttactcttatttccatataaatatatataaatataccagtagttttctaaggaaaagaagtttcctcttattcttactcattttaaaataaataaataaaattgaacataaatgagaaaaaagaatttttaaaatcttatgcctacaggaaactttagattgagcaaaaacaagggcatgtgatgtgaataatcccaagattccagaactattcactttaaagacaatgatctatggatgtgaggcagcttttgtctttcccccaaaatgttctcctgggtagccagggaggctggctggaggctgtgcttgtggaaggcagctggtcagaaatcccacgtggatggggatctaccccaagatgaagatccctggcttcaggaattgactgaatgtgttcccacccctttcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagagtaagctcccccttcctccaaggatagatggctgtggctatggttcttatgacctgagcttcagagggttcaaccaggtgtgtcgacagcatcctcctgccctcgcccagttcccactggggatccgagggagccacatgcttggtatgtgatgacttaggggagcaacaccctggccacatcacctgatgagaagtagtcagcgctctcaggagaagccaaaattcacttcaacactcagctgcctcctccagggtcctgcgaccaagaagatggaatgtcaaaggggaaaggaagcgttaactggtcacacattagttaagtctccatgataccccgaatcgaaatagaatcattaaggcttctctttcgtaggaattagggggattattctccctaaagctacatgaagccccactttatattctaacctgagcacagaacaagggaagttttcactttgtatcatgtgattcggcttaacctgacagaaagggatggcatgttggcatgaatccagaatgtttgctgcatgctttaatttctacaacgtccagcatggtgagaaggaagtagtgtgacagacagtgaggtggataaattctcctccattgctttgcctggcatcccaaccacttcttccctgaattaaagacgggcccccatgtaggttttaacatgctaacaagtagcaggttgctggaaatagttataagcttcccatgatgttagtgtgggagtgggggaacggttttctttctttctttttctttctttttttttttttttttttgtaagaaaggtaattctctttctctctctctcttttttttttcattttgatgtcgctttttgttttgttttgtagctcctcttccacatttgacttcagatgatgttgataaagccttacaaaactctccacggttaatgcatgctagaaacacaggtaatgctggccccgcccctgcctcccagcaagagcgtagggtcttacgtacaggttgcatgctttcatgggaaaccagtcagcgcgtgccaggaagacagaacgcaggtagatgattcagaatactttcggatacttaggaatgtaccacagcctaaaggaaggtgaagccctttggttttctgagcgcttcccaagcaccccactttgattatcaaagggttcctttttaaccaggagacgtgcagaatttgcctttagccataacttagctcacatttgccggattacagtcttcttctgttggtcccaatatattcgctgtgctgactctgtagacactaaaagcatgttcgatataaaagggcccttagcaacctcctttaattttttccatttttattcttaaagaaatatttgctaggataagttggaattttctttttcctttccaataaacttttaggctatttgatttgttttcctacagactttgtatgtttgcaaaaggcaggagggaatttctgtaacattttgagagcttttgttcagagggaacctctgctataattttggagaatatgaaattagtcactaaccaaatgcctgttttctatctctaaccgttgcctctacatttgacttagttatgtatttattttgcctgagcctaagtagggtttaacaccgtgcctcatcctggctaaccttcctccctcgccccccgctcacagcagaggctgggttttctgtggatgaatgtgttcctggttcacatccatctgctccttcctgatggagagagttccggaagcatggccaccggctgctcaccccactctgttagctgcagggaccctccacaatcactcgggctagggagggagacgggaagtgccagaaagccttgcaagtcagccagttaactcacgatcagccctcacatagaaatacgcaattttcccaatatttaccattttattttaaaatataaaatgtgagtgagtcccggtttgagtattacaatgaaattgctcatttatcatggtcttctatattcaacacattgtctttttaatctgaagttttaaaaaacctgcttcgagttggtagtacactttttcaataattttggttgcacacatcagcctattagtgaccttgtggccagaaataacagataacttagaggaagttacttccccttcttaggaaacacctttgagctatgcacattttctgataatttcacatttatttatgagttctttaaccattgagtgaaagtttcaaaaaagctccaaatatattaaattttgctattgttaaacacggaagaaaccaatgaacaagacaacaaattccaaatggactgaactatgaaaagggaattttctcagctaacagcatgagttttggtcaaaagagagagagggaaaatgcatttgaatagagatgtggattaattattaataaaatccatatactcttaggctaaatacttataattgcttgatactactttccaaaagctctgtaaaatatattatgggtttttatacaagttgaaaaataaaacatgtaccatataattttttaataaaacgagattgcccagtgggaagtgggattgagggggacacagatagggcttcatcaagaagttataaaatcaaaacacaaaacgctttatagcaaacggggcacaggagtacaccaaggctccaagtttcacttccatcttgagaatctgacaggtgcacctgtctgtttctccggagctctgttaaggcaggtttgaggaggtctcttccctttgttgtcatagggaaaagtagatttggcgctgatgttgagatcgacaaccacaacaaaagaccttcacatgtttgtctttccttttgtctgcagggggtgcagcttttattttcccaaatacttcagtatatcctgaagctacgcaaagaattacaactaggccaggtacgaaaacacccctgtgtgatctcttcattgagagacatcccagatgtcctgctgagatccgtgccctaagtcacgtgatacaaagagagctgatcccggagctgaagccagtcccagacagtcttattctgcctctgttgatttggagactaaatccactcaaaccatttcattcaaagaccacactaaaggaattaagagcagattagccctttaactagcttttcagaaagacagatgggcaaagaaggcatcctggatgcctggcagttaggaataggccgacttttgaactaacagaaggatctgtccctcctcgggggaagagcacaaaacaaggacactccccagattcacagtgaccgattatcagtatgtcacaagaagccagtcttgcagagcagaagcatgcaaccagtagtatttacatctgaatcttactgcctgtcctccaaatgatttaattaggtaataaatttacatgccattcatgcaaaaataaacatctatcaagtgcccattagtgccaagcgtggtgttagactctgggaatatatagatgaaccaggcttcagtaagcttcctgtcttcagaaagtttacttcttcattcagcttggtttgttcatttgctgagtgcctcctctgtgccagccacggatggtatgatggtgaacaaaccgaaatgttttgcctccagttctagatgtttcagtagagtgacctagagccagagagacacatatgtacacataaatgttttccctaatgtgatagattttatggtagaggaaccacttctagcaatacagggcgtaggagcaggggtggggaggaactcaatcccccatgaaaggcataaagatgctttccagaggaatggccacatggcaaaggggaattagatgtttgccagacgaataatgagcagggagagagggcatttcccagaagggtatagcttgcctttagcatttgtcctctccctgggacttacatcagcccgataagctaggtatcattgtaccagcctcacagctgatgacattgtgttcagggtggtgggatggtttctccatattcatacatgcttccagaattcatgttaaactctatcacatatccggaatacacaagtctcagttcgaactggttcaagatctaggcttggcaactactctttctttctaatgagaaagactgggggcccagggagctaaagagaatgaatgaggaagcttctcaggctgttcaaatactgacactgccctggttactgcctagtgacttcaggctggcaattttctcttctctaacgtcagagaaaaagtttactgtcttgctcctgggaagcatgatggaaaggcttagcagctaaggggtactaagaggtagtaagtcatctctgtcatgtaaaagatttcacaggccattgaaacatgggcaagacccagtgcctagagtctgcaagattggtcctaaagacatccaccacgtgtattgcgagtggaaaatagaaattcatgtttgactcaagctttagagattttgtaattctgtgagcatttaaaaaatatttccatataaactaaaaaaataaaaactatttccaaaacatttggctagggttttaaaaatttttttactttttaattttgtatttgtttgtttatgttaagacatctcataggtgcctctgactgagttgcaaagccaggggttgtgagctagtattataaactgtgttaaaagatcacaacactggccaaattcattggcacaatctctctgtcagacaagccagctgactgatgctacctggttaagacagtgggtcctggagctgctttgttttcacattttaggatatggtggatttggaaggtatggcccatccaggtggatggagaagagggtgactgtgaggatgttggttgggactccctctctgcccaacccagggaaggcaagggtggcaaactcagacacctcccatgccgctctgatggtggtcttccatgggcccataatttgagcgtgacctgggagagagcacacttccacagctccactactagtcaagtatgttttcgcgactcagtttgtacctgaaataacctgttttgaccactgctactgtgattatgagaaccaatacaaatattggtatctgacctgtaaagaatttaaagcagactgaacaagccagaggactatttactgtaggccctattcagggacttgaacttggagataagaactagttatacacctcgggtcatccattgctaagcgatcaaccttaaaggactgctcctgtggagataaaagctgtgaacctgcaactggagaatgaacgtcgtgatggctgagggggaagagcttttgcatcactaactttcagagctgaacgagctccagagggaggtcactgggaatctgacgatatccctgtggtcagtgggtacctgactactttcagaaaggtgattgttgactgtttctttgaaggtccttggggatacagacccaaatccctgtctcctccactcttggtttgctgtgccatgatcttcatttccataccctttgtctaatcccacatccgagggaaccgaactctggtcagcgttattgtgctgaccatgaagcaagccaggctcctaggtaacaactctacttagaccagaatctgtctcttctctgcatggtggccgtttcattatagagtccctgatagaggagacagtggtgttcagggtttactggttaaattagacagcattccgcaccctttctgcagagactcctacacatgtgtgttgtcctgctgcatccaccttcccagcacttcctcaccacccttccctccttcccttcccactgtgagtcacccatccctgggttactgccccaacctaccttttcttttcttttatcttcttttctcttcttttttttttttttttttttttgagatggagtctcactctgttgccaggctgaagtgcagtggtgcaatctcggctcaccacaacctctgcctcccgagttcaagtgattcttctgcctcagcctcccgagtagctggggctacaggcgcatgccatcatgcccagctaatttttgtatttttagtagagatagggtttcaccatattggtcaggatggtcttgatctcttgacctcgtgatccgcccacctctgcctcccaaagtgctgggattacaggcgtgaaccaccatgcccagcccccaatctaccttttcttctgttcatggcccaccttcccaagtggatcatttattccagagccccctgactgcttccctgtcaggtcagtctcgctgctgctgtgtcagttcagtctccctgcacaattggccgaggccgttcactgacctcacaggggaccacatgtgaacatgccctgccaccaccactacctgccatttgtccaaacctcatcccttttccttgcatgcccgtacctagtattttcccacgttttcctgattcaagatttaccttctttcacaacccctttgttgaattagcattgagacagtcttctctactctcataaagtatcaacccataggcatatcattttacattctgtggttttatgattttttaaatatatatatattttattatactttattttatgatgtttcacgtgtttctcacgttgttgcagttactacgaccagaatccctttctgtacctcctctacaaacacccttcttttttgctgaatccacttcttttggagccatagccctttgaggtctcaggggaaaaagtggcaaaaacagatccacagaatcttgcaagcccctattaactacacagtgcaccaccctgcctgtcctcttaggagcaggtcatgcaaaagctcagttctatcccaaggatgatgttctgcaaccccatcctttcctcttccatccccatgacaacccatatattatgatatgcctctggggtgttatcaaaagagattagagagttaagcctgcaaatgcagcctttgcttctactttgaagctgctgctcttcaggggtttcttggaatcttaaattattcctccattggagctcacagcctagtgcttttcagcacagctaggcatagtgagacaatacaactactgcatagcatctctcagttaggtgttatgtaaagcctgtatcttagcaaatggctaaaattgcattctttgcttccgcttagttcttatataaccacagggatatgcaaacctaggcaagaagggaatgcaaaatgtttccaaaactccatgctcaaactttgatgtagaattttaagaagatctggaggaaaatagagagcaacttaattatgttaaggttgactcaaactttttttttcatttcacagacacttctagattggttcttagcagcagctcttgctcttcctaatttgtgttccccattagcatctaatttcaagagcaggcaaatctcatctgttcccatccagcccagccagggaacctccagagttgctttgcagatatggtgtggatcctgcagaatgaggatgagctcttccacgatccacattcttgccctttaaaaaataaagcgggtaggcagcggggtggcggtgtggggtgtgtggggcaagagctagagcgttcctcctcagtgagtttgatgaagggagaatgtaaaacttggctgaacttagccctccaggaaagggtagccagaatgttgtattaatttagtgatgtcttcaaaagggtgtggtggaggaggagtctcattcagaatgagaagctgatcccagctcccaggaaatcgacacagttgctggtgtgtagtggtcagcactagccgagtccctatttgtagcttcatgctgttttttatactgttgtgatgtaatgtacatctgtgttcacccaagctgcctatgcaatgacttctataaagctcagtttttaaacacagtctcttacagataaaacaacagaaccagtgccagaaagcagccttcccttacatgggcacttctgccaagcatatgagttcattgccttgaagatcaaagtcaaagagaaatggagagggtgttgaaatgatcagcgaaaattaaatgtaaaatatattcttattggaagtctgatgctctattatcaataaaggacacatagcaaagatacatagaggagtgatttttcaagcagtcaagagcagaactacgaaggttttgagatggtgtagctgccaaagaagtcacccctggctgtcccccatctcagtgagcctgagttgaatgtttcccaatgtcatatcccacagggggatacttagtgcccacagcatgtgatcggtagccgataaggaagcattggaccagaatgtcatggaagaaaacaaaagcccacttatcttccgcggcaatatgtttatgaacatgtgaatcattgttcatataactgtctcaaatacttggctgaaaagtagactgtttggtgttaagtttcgacttattttcgagggaggatgggatatggttatacaccatatgaaggattttgtgaataaagagtttcaaaatattttgggaatagtagttcggcatttattttttttcccagtcacatttcatgagcaacaattttatgtttaaggtagtatctgactaacctactgatgctgtctattcattccattagcatacttatgccatgggtaaaagcaatccatctagaactctttcaaccattttttagtttgtctttgcacactctagatagcatttctgaaatcatctgcaggaacagagttcctgaaaagagcaatggtctagagcaggctttctcagacttcagtgtgcaccagagtcacccaggatcttgttaaaatgctgattctgaggccaggcgcggtggctcacgcctgtaatcccagcactttaggaggctgaggcgggcggatcacggggtcaggagagcgagaccatcctggctaacagcatgagaccctgtctctactaaaaatacgaaaaattagccaggcatggtggcaggcacctgtagtcccagctactcaggaggctgaggcaggagaatggtgtgaacctgggaggtggagcttgcagtgagccgagatcgcgccactgcactccagcctgggggacagagcgagactccacctccaaaaaaaaaaaaagataataaacaaaatgctgattttgatgcagtaggtctggggtaagattctgcatttctagcaagctaccaggtattgttgatgttgctggtccacagaccaccctttgagaaacagagatctagaacatatttctgtatttctgtattatcttgctttttttcatttggtaaatagaaggccttagttaatgtgcttttctgctcctaaattaggttagatgtggctaggattgccttgtgagtaggtttttctttctgagacaatttgcaaattgaaactctggctgtccagtttattttagacaaaatgcaactgactgagaacccatgtgcagagtgttcccagagacttaagttgaagttcagttgtaaattgttaggggctgcagatataattcctatgtgtaaccccaacacaagagatgtgaaaatctgaggatctgggtgggaaaagatttacgtccaaaaatgcaaaaatgccagctgagagagaggagtaacatcagtttaaaaagaaaaattatctaattctccaaagctctgaagggtaggatttcatagaccacactagtagcaaagatgcttgcagccaaacagaccaaatacattaaggagattctgtgttgactttcacgttgcgcatcatttctattctctttgggatatgaaaataggaagagacacatcttctgcaacacagtcaagctctttgaagattgacccatcaaattgctggttttaaacaaaattaaaatatttgtttaaagagaagcttaaaaacaattgcattgtcctaccctccaagtgaaattttgtacacatctcctggtgtctggcagcaaagtacctgctgagatatttggccatggccttcacttggcccagaatgacacatgacattgaactgagaccaagcaatccaagaagacataattttgaaacagttatgtaataagattgcatgtagaaatagccttagctatgcactcttagcaagagtattataataaggtttctgtaatatatttttgaaacaaacttgaaatgacatagagctttgataatcattaatagaactcacactgaggatgcagaagtatagttattaaatttgcatatgaaaagtaaatgaaggtttataggacaagtgatacgactttataaatacaaagaaatgtttggcatatgcttaagctcagaaggtcatcattaatgggctgtgggagcaatactatttcagtcctgtaattcatttcatgcaggtcattttagagaaattctaaatttatttagaacattagaaatgggagacatttgcctatgaaaatcactagatcagataagactgatttaatataaattgatgagattataaagggaaaatgggagttggctaagagaggcagctggcaaataaaaagataaggcagcgatcacttcccaggagatgcaagaagaaaaagaagctgaatgtcatttgattgatttaggaacagacctcaaacaaaaatgggctggttcatccaagttgtagactctgctttggatgagtcatgaagataataaagagacagatgtagatcagtcccagtggaagcaggatgaactagattgtaagaaacttttattggggtcttgacttatggttgtaggaaattagaagagttggaaagctctgggagaatctgccaatggaagttttcagacaaacgggtgagaattttagaccactataatatatgaaattttaatttgtaaataaaactcaaatctagtgggatatttctttggattaccagatttttttgcacaaagtttattctaataaatacaaaatcaaataaaaaaccaaagcatctcttataaaaattacatgattgatcttttagtcaatttatttgtctttacagatttaccatatgagccccccaggagatcagcctggaccggtcacggccaccccacgccccagtcgaaaggtacagtgttggctcccatgaccctgagtttcatgtcacaggcagtggatgactgttgatggagtatataataatttctgtggttaatctgtgattttgcaacatgtgatgggtttgttccattgacgacaagagtacaattgatctttcactgcagtgattctttctccatttgggtcatcaggactttcataacaaaaataaaggaatgatgtagtgtatgtcaaccttcacaaatgcatgtttcatgggatgtttgagtacacattaaataatcggtgttttcctgaatcttggccatgcttaaaagtatccctggctttactttatttgactggtggtttccctttatgtgtttatcttagactatgatttattgtaatctgtttggtaagccattccaaattcttttttttttttacttttggaaaaagtgggaggtatccattttttaaataattggaaatgtcctctttttttgttacagtgtttacatttgatttcatcagaaaggaaaatttttccttaccgtgagatgcttctgagttagactattatgttaataactaaattaactgatagaatgattatgcaacaacatcaaagactagtgaccaaatctgttatagctaattgccttttgtatttctggattttcagctgctcaaccatctccttccacagtgcccaaaactgaagaccagcgtcctcagttaggtatgtttcaggggccgtctggataaccataagagaagattcaggctcagcagcacatttctaaaatgcttcactttttaatggaaattaacatgattgtttgcctcttttcgacagctccatacataagatagggcccaagtcatcagcctactcatgcgaggtgacttgagatggtgctaaaacacgtccccaactatgcaataaatagggaaaaaaattctacgtgcacacaggctgcttctttgtgatccattaattttttagattttactttccatgcctaaacaacacagcctgcacggccctggattgatggggcttggcacatgtttgccctctttatatcattggttggtgtgagccttgagctatatgtcaggatcctggggttgaatccaagccctgccaccaattaggagtcccctagcaagacatctgagatgccgtgtgacatcttctctcatagaggaggtggaggcagttgatttggagttggaggacattttcggctctgaaatctgaaaaaacaattaagtcaggcattatgtctgaagtcacatcatactatgttacaactatgtctaggatttgactttgtttctttttgctgtagatccttatcagattcttggaccaacaagtagccgccttgcaaatccaggtgagaaactgctgatgattttcttcttacaaaattactttttggcagtggttattttgaaaagtaaattggtattggtgagaaattccttcaactgaacagattttagttttaggtctcactgaattatttgccttaatggaaagatgggttgggttataaattaagatttcagcttcagcaaagaacattataacctaatccaagctgtaatagttttctagggctgctgtaacaaagtaccacggattaggtggcttaaacaacaacagtttattgtctcgcagttctggaggctggaagtctgaaatcagagtgtcatggtggcaggtttcgttccttctcagggctgtgagggagggatctgtcctgggggctctccctggcttacagatagccatcatctcctcgtgtctcttctcatcatcatctctctgtgtgtgtcagtctctgtgtccaaatgcctcttttgcataaggacattggtcaggttggaatacctaccccataaccttactataacttgattacctcatttaggatcttatctccaaaaaaggtcacattcttagatactgcgggttaagatttcaacatagggaattgagggaacacaattcaacccattatacaagcagataaaataactagtattttttaaaagagagccttgatacaaccacaagacttcaaattcaggctcatcttcgatggtctgtttctgaacttcgatgctagaagaaagtgcagattcttaattagcccatttgtaaccagtgcattgccaaggtttgtcacctgtcctagtgtttcagtgccaaccacatagttttatttgtttgtattcagatcagaaccagctgtgctggcaccagcttcagaaattcatagcctatgctgcatattcccaactgcaaattcaaatgccaagatgttacaggcatattgcaagcacaagatggaatgtgtatttcctaaacgttgaggccaaaataaggttcgaaatggaataattaagatttaatcagtgtacatccctgcaagagaatctacacattgaaaacacgaaatgttatcattattgaacatctgtatttttgaagttaaattttggttaatgttaatgaattcaatgaattttttttacacagctgaaaatctaaagaaaactagttagcctggggcctagactaggtgctcaataattatttgttgcatacatgaatgccaaggataatgagatatagtcctttagctcagggtgcttttggtccgtggagagatggacacaggtagttacaacattgtcccaaacacagagccacaggccctttttgctcatgctggctttcatctagtagcccaggctcctgaggctgtggtctcttctcagccttctgctcagcttttcatttgcaactctgccatataaccattcaaataaaaataatgactatgttttgagatgattattatcagtcatgcttcaggaagactgatctggcagcaatgttcaggatagattagaaaaaagaaaatgacggaagctgaaacactctgggaatgttaatacaatcatgtgaaataacaatcaaacagctcccatcccgcagaatgccccccatagaatgtctgtggtcccttctgtgtctcataacagccctgggaggttactatctccatcctacagaaaaggaattagaagtccagagaagttaagtaacttttcctgtgtcacacagccaatgataagggaggtcaggttagaaacctgactctgtctgcaaagtctacttttgttttcttgccctactctgccactgactaagtatgaagggaagaggaggtcttacaaaatgcggactgtgagaatagaaagcaaggatttcctttcagggtcataactgcttaggtgcaggcgatgaatctgaggtcaggaaggaagaggaggaaagagtcaagctgcaccaaagaagaccaaactggcctttgcactcacacattggccaaatgaaacatatatgtccatgaccacgttgtcacagcccaaaggtactgcttggcttgtttgtagaatagggcctgagtcacttgctcctaagcaaagtgccagctttcacaagggaacactgcatatgccctgggcccagcagcccggggatgccctttgtagatagagggacctgagctcagagcaaggagaccggaaactcatcacaggcctggggaaggaggactgtgcttcataccattaagactgttcttaatgggcctggagaaaatggcaacatcccatctttgatttgcaggcaagtgactttaagataaagatttatttcatttagtttctgatgaatttgactttctctccatctatctttaggtttgtgtctgttgtgctcatgtgaacttttcccctgaaaccagaatgtcttttatctttgtattaatgacaatgcttcttcctgtttgattctatttttctattctctgataaataaatctttcatcacttaaaaattgctgtctttgctcttcatacaatacaaattccttttcatcattttaagtggaaagattgcatcatatagtatgaatgcacaggatgatgtcagcatcccaacatctctatcccaaatattcacttgatgtgtactttggacatcacttttcctgctgagaacagtgtgtccctgcattctgatatcatggatcggttataagcaacacagctcctttacatcccatcagagcagctgagaatctatctaacatggttcctctaatgaaagagctttggtgggttatgttcagaggcttccttgatgctaactggatactcttcaatggtgcacatgaaaatacatcctgcctcttgcagaacgacagaccaggctagggatgttttcccatttgttaggaggtggcagtgtgcagtcttccagtgggagtcccccagggaggggacaacatggaaaggacctgaggaggctacagaggtgtgcataaaccaggcctgaaagcaagtttgcgcagtgattaagcatggcagcctagagtctggatttcaacccttgccaacgctaagcaaaataagtcagtctacctctctaagctccaatttcgtcacttctccaatggactaatcacatgattcctgtggggattaaataaaccaatacatgtaaagcgtttagaatggtgcatggcacacagtaagctttcagaggatatcagtcagcccaagaatagcaccgtttcaagcttcttcatggttcaataggccaattgaacagtatttctctttctttaggcatttcctggctataggagaggagtgttatctttccttaaactctgattttcagcccaaagaaattctgacaagaccattcaagtactgagttcatccttaccatgatcttgcaagatagtactattaccatcacccccactttacagatgacgatactgaggcagagagagctgcgagagttgccaaacgtcccacaaagggcagaggcaggattcagctgaagcagtggcaactccaaagttggtgctccctaccaccatgctttcctgcccctccagtaagtggtgcctgagcctcactgagcctcggggcagagacttccattcaggacacacctgctggacacacctgctgccttgcagagggtccaggccatgcacacgggatcttctgcaccacccctggcttctagagaaagtggccccaaaccactgccacatggtactggtggggcccctcacggctgtatttactgcccttgttcatcagctgacggctgcagggctttgcaccaggatgctgtttccaccagacacagctgctgactcactctgcagctctctgctttgctctgtggtttgtaaaccgtttagtttttttttcccccttttttgctcagtctgtacccctttgctaccctgtttctctccctttcttttaacaatattaggagattactttcctctgtaaaattaaaggagtgcctctgtcttcttaaaagccacagccgctccctttcacccacagggttctctgtaggtggacaatgctgcttgccactgttttttacctccaaatatgttttattttggtaattaccctaagaaaaaattagttcctccttactgacatcgcaaggatgttattaagagagagtaaaaaaaaaaaatagatctgaagggtttacccaagaaaggtgagtcctaaggtagaggtggtgatgctactcaatgaaagctcttgtctttcaagaacttctctttgtaaatcctggtttggcccatgagtgacccaagccacttttaggctttcctaaaccctaagcattcttgtttggaaatctctattctatattctaaaatgcacctcgtcacacattaaatgttattgttttggaagtaaaataagaatttaaaaattgctcttaaaattttatgactgagaataattcctttaccactgacaattttttaacaaccattgttcatttttgagaattcttgcagtgagaaattttgttctacacactgcaaaatgcagcgaattttgttacaaatattaaatttaacaattaatgagtttgacatgatgttactctttctaccatttacttaaacattcattgattttgcatttccaggtttctttcaaggtttgaaagctgatgaattttgcttacagttctcttatttctatagaccctcccttgaaattctcacagtcctgagccctatgtctttatggctactgggtaaaatagtcaagtgagaaattagctcatccatcctttgggcatagagtttgctgccacaaatttaggtcccctgctttctaactcttcagaaataggagagacatgagatcacttttgtccactgattctgtcctacacacgtttataagagaaatgggtgagggacaaattgctaagaggcaatgccaaggtttgagtagattccaagtgtgatttcggcaggtctgtggagttgctttctctatgggagaaagttgacgctgaatatttattttcaaacaaccgtatgtgtttatattgaagcatctgttagactgttaaatcaaaaatccatgccttttcctattcccaggtcatatacggaattttttcaagttgtaattttttggttacaatatatatactaagaccatatggttttctcataccattctttgtattttctaaatgcatattaataaaatgttggaggcaacaaaacttgattgggaacagtttgtatatgtggttctgaaaaagcaaaggcttccacttcaatgagctacaagctgttaatacatttcaaatgtgttgctagactgaaaatgagcactttccagcatagattcagaaaaagctgacctttctcacagtgctattgtatggataaattcacaaaaatatccatgtccatgtagccaacatgcaaagcagagtttataagttgggtgatatgtacaggaggctagcgaggatttagaagaaaatgaacgtaaaattgatttttacagtatattacttccctgagtagatgtcagttaaagttactttaatcattttatcacatcgattgatattacttacactataataaaaggtaatcttttggtaataagtctaaggcagtgctgtaactggaatttgggaggaaagacccacctcccatctgttcttaagcttctgaaatatgttcagcacagcttagcttctcttggtacggatactgctgtcaatatttacatgctgctgtcttctagggagccataaactatcttcaagtattgtaacatagcagctagaatgatgtgcctagatttttctttgaatttcataaaacaaagctgtatctgtatgatttcaatgaaatcaagaaaattctgactttgtccacccagctaaatgtgatctctttgacaaaggaagagtctcattcagcttcccaaggggacttgcaatcactcattgttggggtttttcttctggaaatgctgcttaacacaattggcgttgcagcacacaggcaaggcactggtttccgttacgatgcgcttgcccaaatactggaactgggtgatctggtttgaaaaagagccagctttttttttttttttcctaaacttcctcattttgagtgggttaattctgttctaggaaaagttttcacagaattgctttctgagcgccagcaaaatgttatgttagaaataatggtgtttacttccattctcgatttttttccataaacttttagaagttcatttcctaaatctaacttttattatcttacttgacctagccaatataaatggcattaagtcattattgccatccacataacagtactttgtgcttcacaaaataggaaaaaaaaatatatagctctttcatcccctaaacaccaggttgatctggctgttcttttaaggacgtcagaaatggatggaagcagcctgaactttgccccatatgaattcgctgcattccatctaggtcttgaatctgttagatcatcgtcctaggtcgggttcccttgatgcagagcttggggtaagcctgcttgtgcaggtgactgattaacggcatgttctcaggagagagagaatgggaagtgctgcaggggcagcgctaaggaagtttctggcctcctccaagcctccttgcagctggacgctgtttcagcccaatcccacgggagccctgaagcctgaatagcgtcatggagttggtctttccttgaggcaagggggccggcccgtggtaccccgttcagtccacccagctgtgggatacctgggggtgggcgaggcggcggctctgttcaggcaagggcagttctctggagaagtgggtggccatggaacgagagcagtccgcacccctgcagctgagggatggacggacaggcctggtgaagggaatgtgggcggcacaccaatagcacctccttccgtcatcacagagagcctctttcccctggaacctgtgctcactggagttttccttcctctcctgacctcattaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaaagacctggcggaggcttttcccatcagcgtgcattcaccagcccatcgccacaaactctatcggagaacatgaatcaaaagtgcctcaagaggaatgaaaaaagctttactggggctggggaaggaagccggggaagagatccaaagactcttgggagggagttactgaagtcttactacagaaatgaggaggatgctaaaaatgtcacgaatatggacatatcatctgtggactgaccttgtaaaagacagtgtatgtagaagcatgaagtcttaaggacaaagtgccaaagaaagtggtcttaagaaatgtataaactttagagtagagtttggaatcccactaatgcaaactgggatgaaactaaagcaatagaaacaacacagttttgacctaacataccgtttataatgccattttaaggaaaactacctgtatttaaaaatagaaacatatcaaaaacaagagaaaagacacgagagagactgtggcccatcaacagacgttgatatgcaactgcatggcatgtgctgttttggttgaaatcaaatacattccgtttgatggacagctgtcagctttctcaaactgtgaagatgacccaaagtttccaactcctttacagtattaccgggactatgaactaaaaggtgggactgaggatgtgtatagagtgagcgtgtgattgtagacagaggggtgaagaaggaggaggaagaggcagagaaggaggagaccagggctgggaaagaaacttctcaagcaatgaagactggactcaggacatttggggactgtgtacaatgagttatggagactcgagggttcatgcagtcagtgttataccaaacccagtgttaggagaaaggacacagcgtaatggagaaaggggaagtagtagaattcagaaacaaaaatgcgcatctctttctttgtttgtcaaatgaaaattttaactggaattgtctgatatttaagagaaacattcaggacctcatcattatgtgggggctttgttctccacagggtcaggtaagagatggccttcttggctgccacaatcagaaatcacgcaggcattttgggtaggcggcctccagttttcctttgagtcgcgaacgctgtgcgtttgtcagaatgaagtatacaagtcaatgtttttccccctttttatataataattatataacttatgcatttatacactacgagttgatctcggccagccaaagacacacgacaaaagagacaatcgatataatgtggccttgaattttaactctgtatgcttaatgtttacaatatgaagttattagttcttagaatgcagaatgtatgtaataaaataagcttggcctagcatggcaaatcagatttatacaggagtctgcatttgcactttttttagtgactaaagttgcttaatgaaaacatgtgctgaatgttgtggattttgtgttataatttactttgtccaggaacttgtgcaagggagagccaaggaaataggatgtttggcacccaaatggcgtcagcctctccaggtccttcttgcctcccctcctgtcttttatttctagccccttttggaacagaaggaccccgggtttcacattggagcctccatatttatgcctggaatggaaagaggcctatgaagctggggttgtcattgagaaattctagttcagcacctggtcacaaatcacccttaattcctgctatgattaaaatacatttgttgaacagtgaacaagctaccactcgtaaggcaaactgtattattactggcaaataaagcgtcatggatagctgcaatttctcactttacagaaacaagggataacgtctagatttgctgcggggtttctctttcaggagctctcactaggtagacagctttagtcctgctacatcagagttacctgggcactgtggcttgggattcactagccctgagcctgatgttgctggctatcccttgaagacaatgtttatttccataatctagagtcagtttccctgggcatcttttctttgaatcacaaatgctgccaaccttggtccaggtgaaggcaactcaaaaggtgaaaatacaaggtgaccgtgcgaaggcgctagccgaaacatcttagctgaataggtttctgaactggcccttttcatagctgtttcagggcctgtttttttcacgttgcagtccttttgctatgattatgtgaagttgccaaacctctgtgctgtggatgttttggcagtgggctttgaagtcggcaggacacgattaccaatgctcctgacaccccgtgtcatttggattagacggagcccaaccatccatcattttgcagcagcctgggaaggcccacaaagtgcccgtatctccttagggaaaataaataaatacaatcatgaaagctggcagttaggctgacccaaactgtgctaatggaaaagatcagtcatttttattttggaatgcaaagtcaagacacacctacattcttcatagaaatacacatttacttggataatcactcagttctctcttcaagactgtctcatgagcaagatcataaaaacaagacatgattatcatattcaattttaacagatgttttccattagatccctcaaccctccacccccagtccaggttattagcaagtcttatgagcaactgggataattttggataacatgataatactgagttccttcaaatacataattcttaaattgtttcaaaatggcattaactctctgttactgttgtaatctaattccaaagccccctccaggtcatattcataattgcatgaaccttttctctctgtttgtccctgtctcttggcttgccctgatgtatactcagactcctgtacaatcttactcctgctggcaagagatttgtcttcttttcttgtcttcaattggctttcgggccttgtatgtggtaaaatcaccaaatcacagtcaagactgtgtttttgttcctagtttgatgcccttatgtcccggaggggttcacaaagtgctttgtcaggactgctgcagttagaaggctcactgcttctcctaagccttctgcacagatgtggcacctgcaacccaggagcaggagccggaggagctgccctctgacagcaggtgcagcagagatggctacagctcaggagctgggaaggtgatggggcacagggaaagcacagatgttctgcagcgccccaaagtgacccattgcctggagaaagagaagaaaatattttttaaaaagctagtttatttagcttctcattaattcattcaaataaagtcgtgaggtgactaattagagaataaaaattactttggactactcaaaaatacaccaaattctgtgccttctttttatcttttaaccttggtttaaagaaatcttgttgactcacacctgtaatcccaacactttgaaggacagaggcgggtggatcgcttgagcccgggaccagcctgggcaacatgagagtacccagtctctacaaaaaaataaataaatacaaaaagccgggcatggtggtgcacaactgcagtcccaggagttcaaggctgcagtgagctgtgatcacgccactagcctgggtgacagagtgacaccctgattcaaaaataaaataaatttttgacaaagcagcccagattaatgctatatagaaacaactagataaacttttctaacttgtaattttaaactcattttactgagtaaaacatcattatcttctcacaaaaaaatgttaaactattattctgttggagaaagtcataatattacctgattataattagtgctagaatatgtgaattacaaacttctgcaggaagcatgttatatgtagaaactttatggaaaaaaaaaatggttttttcatgttctgtagccacatggcatgtttcctaaagaagataatacagaaatagtaggtaggcagaatttcatcctgatatgacttcataaaacaatctggagatgttacaagtttatgactcatgactcattgaataagcacagccaaacagtactaattaaaaaatggatgctcgtctagaagggaggtcgcaggattaaaccccaggctgcggcccttgaacttacttggtcatactttactcagatgaggatacagaagctatcctgatctcagctccaaatgccatggggctgagatgacaataggttatgtgacacatccaggatgccaaagaacaggctgaggtgacgggttagatcttgaaggtgttaggacctccatccagtcctccccaaaacatctgggagtttgatggagcagcagcacatgtgaaaagacttcagcgttttggagatgacagcaatgagatgtagaatagcagcttttaatgagccatgactaggtcaggtgctgtatacacactgcctcattactccttccaactgcccctacggtacacttaaaaaaatgtcttgacagattgaacaatttgcccagctctgcagcgtaagaggtgcaacaaatgcttgttccagggctagttaattccaaaagctttttcttaatcttaagctattttgcctcatatggacagaaaattaaacgggaaggtgacatgactgcccaatcttaggttgcattttctgaaacaggtcacaaacgaggacttatttgttatacattagactgcaacatcaattctgggcctacacttaaagagggacataggacagttagtgcaggttcagtggggagagacaaggggaatgagagaacccaggaccatgtcaagtaggggctgtcagtgtctctgctgaaagtgggattacccttatcacccattgattcaggacccagcacagtgcctagcaatatcaagctgttggaaaacgtttgcagctatatgcatgaatgaacatccagaaaggtaacatctggactaaaggtgggctcagcagggatgcccattggccaaattcaagagaaagctttttagaagttggaggaggtccagatggaatggtcagcctttgtccaggagttcctggatatgaggtgtgcttatttaacaaccatgcaactatttgccaggtgtttggcagcacatggactacatggctatttaggtcttcttcggtccagtgcaacttgggttctgtgaaatattaagtgttgtccatacatagaaagtcaggggtgagagtctgaaatcagtgatggcttagtggcctcactcttgatcagtgccagtttgtcctaagagtcagcagtacattagggctttagacattacagagacagtggaatcaccccaaattgaattatgttgtggctctgtgtctctaaattgattggagtccagtctgcttggagattaaaatacatcctattttctcagcactgcagggcccaggtgaatggtgagaagcagccaactgatgggataaatgaactttgctttcatgttttctcacttatgaggaagaccaccccctacagcacacttgcataaaaacatgtcctgagggtggttggtcacagcctgctcagcattagacatgcatcagctgaaagagtgtcagtctgcctcaggggccctcaatcccactccagactaacaatttccacctccaagtcgtcgtgggatgccaggagccagggctgatctccatttgcactcatgaggttgaggctaaggaaggggtggggtgtagacaaaatatacaagaaagaatttggtgtagaagtcacgaaccattctgtaaagtctcttaactggaaagccaggatgtatcaagatgttaacaactttttattttaagtaagttctcttattaatttttggtttttctactcggcaagaatataactgaaacttgtttgaaaggtttggaggtgggtggatgtgtaacttgcccaacctttttaaattaagggtgaagagaaaggaaaaggctagctgtcctcttcttttctatggcatcagggcaatggtttctaagctgtctcatcagaattggcagcaggctgctggcaggaggcggaggctggcattccagttctaagtaattccagatattaagctttcaggtccaaagaggagcctcccaatggatatcattttctcctttaaacaataatactaattgctactacttttgataataataatagcttagtgccaaacaatgtgcatacactatctttttcatttaacttgcacaataccgctttgagatagttttatccatattttacagatgtgaagctttgagaggttaaactatgttataaatcactctaagtcacagaaaaatcttacagctttcaggacttgaaattggaatggccttcctaagccatcgcttggacagtcttcagggcatgtcaaatggagtgccctccccttatctagctatgctgggcagaagcccggttgttggtagttatcagacaggaagcaaagcgcagccctcccatttccttgctgcgccctttggttttagggcgggagtgctgcttgctggggacgcaggcggactccaggccgctttgatggagaacacaggatacgtgctgcaggtgctcttctggacggagtcccagctgctgggccataacctggtggaggcgagtggggctgggccccatggctgtgaagagacccaccatacagcggcctcaggattttctgtctccatccgctctgatgcttagggtcagaggaaaggccctctcaagtccggcagggcctgcctccaggagaataaatggctgttcctttcttccatctttgcaaccaactcgggagtcaggtggatgaaaatggaaacgtccctttcctagtaggaagaacatgggttaagcctgcagtgggcagaccagcacttccaccctttcactgatgtggttgggaaggtgcaggacaggaagcgactcccattggacagagaccagaaccggtttccatcagggtaggacccgcctcttcctgtgaaagagagcggaagtggtgggagagagcgagagtaacaactgagtgtccgtcccatggaaacatgcatagcgagaaacgaacaacaggcccagattcacatccgacaattccacagttctctttagaagaaacccctcccctcatcatattttctaacctgagaccctgggcctgtctgtgcctctgtgcattcacactaatgtgacatagggcattttaaagtggaactatgcaatggtcactggattttaaaccaacactgtcaggtccatgttcactaagccaccctaccccaattaaaaagaaaatactaacagagggtctatagctttcattcaaggaaggctgagtacttgttaagatcataggatgggcaaccacaataggatgagcaaacaaacaaatgattattcatatgatgctaggaagttaattaaggcaggaagaaactagatagaaggggtaagacagttggaaggaggctgaattgttaagttagtgtgtgatgtccagttgtgttgggggtgcaggaggataatgagcaagacagtgggactatgactacccggggcccacaacagaccagagatgcctataaaaggaccctgtgactcctgtggagtgttatacacaccaagtaaacaagtgatgcgcaatcaagccaaatgaacccaggctatagaacgttcagcttcagttgagtgaacactatgttttgaggtctgtttacaggttgtgatttcaccaaagtgtttccttttctcaatccagttcttcaatccaattctcagtttttgttccacggtgtgtcgggctctgtgggaatggtttttggaaataaggttactgtattattagcatccaagataaaatcagtggggagcaagaatgtctgctctcatttacttaacaagcatttgctaagaatctttgatgtcacaatgatgtaagaggtacagaaaggtgttagggagttcttgcccttggagagattataatctagaaagggaaaatgtacataaaaatctctaatgcaagacaagacatgcatgcacctatcgtggttccccatcctaggagcctgactctcataacatagaggtcgggttttaagtcaggtctttctcagaggtaaaacagcacagtggctcctcatggtgggtttggaaccaaacagaacctgatccaaatcctgcccttgctgctttaacagctaagtgaacttagaaaaaatgatcttaacaagtactcagccttccttgaatgaaagctatagatgctgtgttagtattttcttcttaattggagtagggcagcttagcatgtgtgagctgcttctgagtatgaggatactcatactcatatagtgggctgagcaggaaaggcttattgaaggaggtgatatttcagaaagggaagggttttgatgaatagaatgcattccaggcagggaattttttcttttcttgagcaaaggcatggggtcagaaaacaatcttcaggagcaaaacatactagtgatggaaacaaaacaaaacaaaacccaagcagtctgtggtttaaaaaacaatataaggccaagtacaacgttcattttttgtatttaatgaaccaaaaaatactgaggagtggggcttggggcatcttgctacacctgtggaccatgtctgaaaagtcttggcacttctgggtctgacctaccatagtctgttgtaggggttcaatcaggctggtgggaaaaatattaaagatggttatagtaacagccacagactctcttggaaggcctgagagtttgcataacttcggtaatagatctggctgaaggtggcctggtccctttacctttagttaaatatattaaagtagtaacaaaggaatgtggagagtttttctagctagcttgtttactcatgtggtcttaagactaacctttgatttaccacaggtgcttaattgctttctactcgggaagtccacattgtcaattaccctgtagtggtgttgactcgagcctttgtcaattaatctttaccaaataaatgtaagtctcactagctggtcgacaactgtttacagtactctccagggagtctgtaagcagctgagacacttagctggactggcaaagcagaatatctgtgtgtcagtgtacattattcatctgtcattgggtcagggtctgtggggcagacgcccacagcctgtggtatgaagaagggttggagcacaagagagcgaaaaattggctgcacacattttaaaatataagccattcaaataataagcagttttgggagatgtccctaagactttttttcaagtggcttctatctcttccttgggtagagattatattaaacaattgctgaaaaatatgtaaatattgggggatgatctaaacatttgaggatgagggatgtaaaagcatatttgaggatatctcacattgctgtgaaatataatagaaaggtgacaataacaatatacatttttcatgtgcttaaaaaaaaatagtttacaaagagcttactcatgtgctgtctcagttcatcatagcaaaaaatcttgaagacagaaatttatttattctttcattcacaacaaagatttgatctacaatagtagatgtggaattaggcccaaggaatacaaaaagaaatagaacacaggccctgactttgtagacctcagagtcttgcagaattcctgtccccatttgaagatgagaagtagagactccaagatggtaatatacatcttaaaacatgtagctagtgaaaagcagagcttgaactcagacccaggacttggatgctagccaggtacattttcaacctcccagtgctactttctcaatggtactacaagaacgtgatacagaaaaaaacaggaagccaggcagttggtttgtatatttacagaggtactgacctttctgtggagggaaatatgcctattgtaggcattattaccagatcttacgtctca

SEQ ID NO: 1127 - DNA, 1389 bp, Homo sapiens
atgattcagactgtcccggacccagcagctcatatcaaggaagccttatcagttgtgagtgaggaccagtcgttgtttgagtgtgcctacggaacgccacacctggctaagacagagatgaccgcgtcctcctccagcgactatggacagacttccaagatgagcccacgcgtccctcagcaggattggctgtctcaacccccagccagggtcaccatcaaaatggaatgtaaccctagccaggtgaatggctcaaggaactctcctgatgaatgcagtgtggccaaaggcgggaagatggtgggcagcccagacaccgttgggatgaactacggcagctacatggaggagaagcacatgccacccccaaacatgaccacgaacgagcgcagagttatcgtgccagcagatcctacgctatggagtacagaccatgtgcggcagtggctggagtgggcggtgaaagaatatggccttccagacgtcaacatcttgttattccagaacatcgatgggaaggaactgtgcaagatgaccaaggacgacttccagaggctcacccccagctacaacgccgacatccttctctcacatctccactacctcagagagactcctcttccacatttgacttcagatgatgttgataaagccttacaaaactctccacggttaatgcatgctagaaacacagatttaccatatgagccccccaggagatcagcctggaccggtcacggccaccccacgccccagtcgaaagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcgccctccgttactactatgacaagaacatcatgaccaaggtccatgggaagcgctacgcctacaagttcgacttccacgggatcgcccaggccctccagccccaccccccggagtcatctctgtacaagtacccctcagacctcccgtacatgggctcctatcacgcccacccacagaagatgaactttgtggcgccccaccctccagccctccccgtgacatcttccagtttttttgctgccccaaacccatactggaattcaccaactgggggtatataccccaacactaggctccccaccagccatatgccttctcatctgggcacttactactaa

SEQ ID NO: 1128 - protein, 462 aa, Homo sapiens
MIQTVPDPAAHIKEALSVVSEDQSLFECAYGTPHLAKTEMTASSSSDYGQTSKMSPRVPQQDWLSQPPARVTIKMECNPSQVNGSRNSPDECSVAKGGKMVGSPDTVGMNYGSYMEEKHMPPPNMTTNERRVIVPADPTLWSTDHVRQWLEWAVKEYGLPDVNILLFQNIDGKELCKMTKDDFQRLTPSYNADILLSHLHYLRETPLPHLTSDDVDKALQNSPRLMHARNTDLPYEPPRRSAWTGHGHPTPQSKAAQPSPSTVPKTEDQRPQLDPYQILGPTSSRLANPGSGQIQLWQFLLELLSDSSNSSCITWEGTNGEFKMTDPDEVARRWGERKSKPNMNYDKLSRALRYYYDKNIMTKVHGKRYAYKFDFHGIAQALQPHPPESSLYKYPSDLPYMGSYHAHPQKMNFVAPHPPALPVTSSSFFAAPNPYWNSPTGGIYPNTRLPTSHMPSHLGTYY

SEQ ID NO: 1129 - DNA, 57561 bp, Mus musculus
  misc_feature (1)...(57561): n = A,T,C or G
ttttagataaaaagcatttaccctggagcagagaaactagttcatgtgtaatttagatttgagtttagggcatcttaacatatttcaaattctgaaacagaaaaactagagtttttaaacacatgtgttcatacatcttgattagcatctgcctttttgaactaaagggccaggtgaattgagtctgataccagctcttcttaggagtgagtatggccgtggcaccatctccttccccttgtaagtgatccatgtaagtttttgctcatagactcccttcccctcagagcaccctgctgttgtgactgagttcatcatcttcctgtttggtttttatgtccacagagcaggagaagggagagtgaggccagggtgtgctgctaacataggagatttgatttagaaggttgtttcactagtgtaggttttacatagctgtgggaggaggtgaccaaggacattgatgttgtcacatggggatggtgttctgttcttctgtgaagaaagaggaggcagtgaggaagtccctgtcctgatttggagggagaggttagaacatcgtctgtgttgtgttgtgttgtgttgtgttgtgttgtgagggtgagctctgtcttgttggtgcagtgtttggggtctgggtgatggttctgagcctttctgctacttgagtgcaccgtgagctacaagtagtcttgagcgtctcccattttggctctaggaaaacaaagagtctatcctttagcttcttgcgttgtctgtacctgagggagacatttcttgtttgctcagatgtgctgagagtttttccttctgcttgatccaccccaggagcaaacccaggcatccgagggattagcatgaagctttccggacttcctccaaggaaggcttttttaaatggtgaaagttgataatgagagccaagttgtcctgtgtctacacataccggtctatttcagttcatccttgtggcccatatgctgctgacagagccatagtatgtcatcatatttaggctgtgcataccctctttttccattacaacatgaccatgacaagcttggtgtacatctctttattgggcacctgtgtgagtactcttctaggatgtatttctcaaaataggctagcttgatcctttgaaacccacatggcataaaattttggctttgggggggggggtttcccagtgattcccattttgtttctttgcaaatcccacgagtctaatctggaattcagcctttctgacaagaggatgtgtttaatgcctgagcaatttaaaaagaacaaaaccttgtccagcacatttttcctgtgagggcagcccggcactgcacacaccagctaaaatcacacattcctttaggctagtggggtgcagggctgtatggtgtcctgcccagtggggtggatctcagctgtgtttacctctgctcctcaggagggagattgtggacatctgacgtctgaattgacatcagcatccaaaggccagtgtggcggggaccttgggtagacttggtattgaaagaacaactgtcatttagtaaatggaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgtcacatttcctgtgtctccttaaaacaaaacaaaacaagccccccaccctccccacccccccaaaaatccaaagccatggttgggctggaggtgtagctcagatgtagcgtgcttcccttgcatgcatgaagccccaggtttcacccccaataccacaggaactgagtgtgccagtatacgcctgtaatcccaggaggaggcagaaggatcagaaatctaatggtcagccttaaggccagtttgaagccagcctgggctacataaaactggccattttaaactgtttttgaagatctagtttagtgatatttaacacacgcaaaacgtcactctcgtctgtctcctgaatcttgtttacctcccaagagtcaagtcccctgtaaagaaaagcagaggctctttcgaatcaaaacatgacagacgagttgacagtgccgtcgtacccctgaagccagggagctcgagggtgtcttaaaacatttggggtataaatgacaccaagctcagctcctataatttgcctaagaagatctaaattgacaacccagcaggtagaaggagctcaattccaagccagtcatcctctgtgacattcattagggtattttgccttcacatgtttgggtcttcccaggcctgagccgggccagccctttgctctgtctatccacgccagtgagcaagcacaaaggaatcagtgctgttgtgcttcgagcattctgcatggtgtacccttcataagtcattttgggacttcggcactggaggagagacactcttctcttcctaaacaaccttgctctttagactctgcaaaggtgtgggagagggcctggggtggggttggttggaggcagccagagccccagacagattctgcaagactttgcataggcaggtgttccaacaggagggatggctacccgctgcaacaggactgaagatcagaagagggaaagacggtaagccaggcactgctcagtggttaaaagtgcatgctcttcttgcagaggaccccagtttggttcctagcacccatatcaggtggctcacagctgcctgaaccccagctctggaagtactaatgtctctgagctcttaagtgcctatactccgcacctccctaacacacattattaagaaaaataacaaacataagtctttttaaaaaaaggaatgcagaagaggtcaggcagaggtcagggagacagctcaatgggcatggtgcttagtgtgtaaacatgagaccatgggcccgtgggcaaaagctggggaggcagagactggaggacctcttggttttgttgactagctaaccaagtcagctgataagttcccccatctgtaagatctcaaaatgaaagggctgggggggggggctggtgagatggttcagtggttacaggctttacctttgtggaaggcgagcaccagctctacacagagccatggcaagcattcctcacatacagtgcacatacagtaataaataaaataaaactaagggagagagcagccaagggagacacacccaggattgacctggcctccacacaagaggtgtgaacctgcacacacgggcatgtgtgcacacaaacgaagacagaggaaaagagaagaaagggaaaagccataaagaaccctaggtctagtggtgcatacctgtcacccaacactggagaagccaaggtaggaggatcatgagttcaagcccagctcaggccacagagcaagaccctgcatttccaaagtaaataactcaggaagcagagacagacagatctctgagttcaaggccaacttagtctatataacaagtttcagagctaagggtataaggggtgtgggggtagaggaaggagtaggagagaaagacagaagacctggttggggcagattgactaagcactaatatccttgtcctggcaccaacagtccttctgaaagtacagtgctcccttgatccttgctctgccttctctactgatcattttcagttctgaccatcttttgtgccgatatgtagaggttgggaaaaggttaggggaaacaaaacaaaactcacaatccaactggcttgagcctggccagtgcgaatacgtccgcagaggcctgacagggcaatgaactcattttgctaattgtataatgagcatgaggcctttagcaggttattgggccctgaacatcagtggctttgatggctgcctctcctaatagctatgcctcaccaactggtttagtgcgttcttgttgagagaaaagtcaggctggcttaaaaaagacttctctcttgtttttacttgtcttgcaaatcgcagaatgttctttctctcttcagcccattgcagttgctaagaaaccaccattttggaagaagggcaattaaattttgatttcaatttaaggatagagcaggcaaggttatccttcaatgaatgggttgtccaagaggacactggctgcttccagggccttcctgggaactcggcacggtttcagtctcgctgccagaaaaagtagctttcaacttttgggagcagggtaaggagtcttaagtgctgcttaacttttgagaagaaaaactcaggagactgaggcaccagtctggaaaccagggcccttggcttgattaatttataggtgcgattcaagagtcctgccctctgtctgatccctgggatacctggttacccgcatctgtccatcagaggctgctgctctgttacagcaaaagttgtaggtctatcttatgcaaacacatcattatatccagaggagtcctgacatgttataaagttccagtggtcaattaacaaagacttagtctccatcactcaggtagtccccctccccctcccccagctccataataaccttggaatgaagcgagctcttgtccttttcccctctttggctgggtcttggctcccggctacagtgcaaggctggagagttaatgtgtctatgtagtctctcagcagtggaggagtagacacttgaggcaagggggccagagggggagaggagagagagagagagagagagagagaggaggcaggagggcatttttttaaaaagcacttcaggctgtatttactaagcatttattcaaaggaacctcattccagagctgcgggccaactgtcccatcggccatggccccaccctttggactgcttttccacagtgtcttaatttgaaattcacacaggggcctcaaaaggctatttgaaagcccctcccccttccttccccgccttttgggttcacggatcagcagcctctaagtccaaattgtaaccattttcaaatcgcagtgcagaagcagaggtaagctgtccgtgggcttagccccttcctcgtatttatttcactcatttccctggaaaaggaaaaaatgtgttttctataatatctgagagttcaccatgctataagaggagctcacctctctgtaaatccttcctgctggaggagatgagatttttgttgtcacgtagaggagctgagccagcagtgggcttcagtctctcatccaaaaataattcacaggcctaatccctttacttcagtgtgctgtgagaagctgtgagaagctgtgagaagcttcaaacctgtgagctttgatgtgcctggggctagatgaggttcaggggagctttttggaggaagtcattctggggtctcaccctcttctccggtgcccactgggaaggctgtacgggctcccctgttgccagcgtctcctcaccaagcatctgaattacttacaccccagctttccaggagttttccatgcacttccaccaacttcctggtgaccgctttttttatccgcacccccccaccccgaccctgccccccccccccatgacaaggtctcactatgtagcccatgttgacattgaacttctgtccctcttgtctcggggttctgagtgctgaggtgctgtggtcatgggtgctgcaccccagccctgctgttgttcagggtctgttgacaccagatcgatggctgaagacaagatggcagatgccggcatcctggggccttttccaagacgtttcaggcctcattcttcaacttgttgaagggcagagactaaggttgcaaaggaaatcaaagcctgatgtggagaaatgaaacatgaggcctactgactttttaaaaacattttaaataacattctctgaggtttcattttatactgagcgcagctgtaagaagttttggaagaaggtgtaagggttctattacacagtaactgtacttgcagtttttctgcccaaagtgagaaagagccgacaggggagagcgggtagtttggaggttattttgtataaggtgagaaaatttgaaaagatgaattcaagactgcgagctgtaacgtagttcagtatgccgtaatttgcaaacgcagtaacactgaaccattgcaaaggtctcctttttccctttgggtgaaaatagtccggatagcttggaataacttaataaccggagctcagcagccctttgaccacgagcaagctctggaccaggccctgccagtattacccccgcaacagattccctgtccaaggctggtgcttgtggtagacgctgtgttctgaaagcactccttgttcatgggcagtgttatgacgtgtgtagtgtttgcgtgtgagatggtttattagaaacaagtatggctaataaaaaaaaaggcttgcaatgaaattccatagatctggctcagaaccttagagattttgtagtacttctgtttccaaggaaggttacactgtccatgcatgcacacgcgcacacgtgcacttgcatgcatacatatgtaaaagcatgtgtgtgagtgcaaaattggaaaaaccaaagcagggaatgaactgataactaagattccttccctcgggctggagagagagcctcgtggcaaaaagagtgttttgttcttgcagaggacccaagttcagttcctagaactcatggtgggttctcagaactgcatgtaactccattctcaggggatctagtaccctcctctggccttcaagacctgcattcatacgcacacacatgaacagacatgtgcaaacacacaggcgtgcacatgcacacgtgtggaagctagaggcagatgtgcttagtcaccctcaactttattatttctttttttttaggctagaactcaatgatttgtctaggctggcctgtgagttccaagggcctcccttctccacttctccagtttaggtttcagccatgtgctgtcccgccttgctttttaaaatacatggtctagagaactgaactcaggactgcaagcttatgcagaaggttctagatcaacagaaccatccgtctgttgagccctgcaactccttcttttatgagaaggaaatgaccttcttggtatttgacaggtagaaatgagcattttggtgagtttggctggcagtaaccagcccagaggtcagcttctatcctgctggtagctttcctggtatatatgcttggtagagacagaggagacatgaatacagggacttccttcccattttaaaggacccagctgggattaaagcaaatcttgatcattctctgtggtacccaagtccctatgacccattctagagggtcatggtcatcatcccagagagtagtgggtttcctgtgatgtcttaagaaatgaagctttgagattttttttttttcagttacaaaaatgaccagtccaacttctctgttccacatggttgataaaggaggagatggatgactctataaggggctctgaaatctttattgcgtggcaatgtaggtgtctatgaagtgatggaagattccagaatgaaatgtgctccaatcttttctcttttttaaaaaaaagtttcttaagggccagtgatgatcttatagagtcagtttgtatatggtctggctctggttcagcaaatttcacagtatgatattttaattggaaaggccccaatacagaaaggcgtagagacctatcattctaatttgctgctttaagcccagtgtgcaggactcacaaacagagggccatccttgatatggtgagctggtttggtggtagtggtgctggtgtgtagggttctttttatttctcttagctattttttgttgttgttataagacaatcttagtactatgttagccttgtctagaattcactgtttagaccaggatggcctcgaactcagagagaatcacttgactctgcctccaagtactgagatgaaagatgtgtgccctcgtgctctgctctgcctggattgtatatgttaagctaggacagtgtaactctctgttggagaaagaagaaaagagaagggtttgggtatataagcatgtatttgggaatgggttggtaaccagggtgcatgtggctattgatagagctgctgcgaagaaggttccagtaacttagtaatcacagtgtttttgtatttgagattaaacagcagcctactctgttagttaattctttcatgctctcaatcattcattcattttactgttgtaagagcagtaacatgtattgtacccctagtatagctttcagtgtagagacccttaccgtccaccataggtagaccagatctctaggatatatttaccttatgtaactgcaagtttctatgctgtgactagccactccctttctactcttcttcactcctgcccaccacagttctattcttctgatatagcaattgagagttttagatccttccttataagtgggatcacacagtacttgtcccatgactgacatattttgtctagcataatgtcctccaggtccactcccactgtcagttggcatcaaattgcatgcttttcttctttttaaagctggttcgtttcccattgtatatagagagcagagtttttatgagtgaaaactcattctcctgttgatgggcattgagggtgttgactaacttaaaatcttagtttttgtgaagagctctgtgatgactgcatctcagatcttcactgaagtgagagttgctggatcagatgaactgctttgttattttggaaggtgaactccagtttcctgtccttaccctaacaattgtattcccaccagcagtggaacaggggttcactccccaggccctcaaccgcacttgtcttattatctctttaatgatagttttgatttgcattttcctaacgattactgatgatacacatcttttcagctgcttgttagccatgtctatgtctttggagaaactccttagcccacttctaattgggcattacctagttctttagggacctcatgtgtaggtgcaagcagaccttgacctggtccctctatgggtttctgccgagaacacctctcatcggcagtggacccttctgatctaagataaggagaaatgtgctttattgagaatcttctcagtgagctagaaaggaatgaccaagcatccctcctgtggggcctcctttgacactgtgaaacttaccctgggaactggtatctgtccctgtgtttcttgagtgccatatcagaatatgctaaggaatatctacttctatacatctggtgcctggcgcacagtgacacttggttcttgtcaaatggatcaatgattaaagaaagaaccactgaatgaagtctgtgtcatgattaaaaagcaggatccagtaggtttggtttcagcccgcttggagctttgctttccaatttgctttttaaagcaggggacacaagacttcccagagcatcttagcaactgactggaagagatcatgcataggagaacctctctcgatatgcaacactaccttaagagttagctgtgtcccttgcctgtgttctctaacactaccttaagagttagctgtgtcccttgcctgtgttctctacctcatgtttaaagtgaatctgggcatcatctcaagctaaataagtgaataagtggccttctaccagctccatctgtctctcgggttgcagcaataaagaatttccccttgtttgttaggtagtccataactcggagtgtaacgtgttctttttctgattctctaaataagttatcctttacaagggttgtgcttcagtgactcactttgaagtcatttgtgttgtgcatggggcccctgtgttattccaatggagtcagccagcagacagaggcctttttggcttgagttcccccccaccccccacccccacacagccttctggacaacacaacttatttattgctctctctcccccctcccattgcctctctccatcagaacggtcaccacaccggcccatcctccaagctggactgcctgcaaatgcctccacggtggtcggaggggatgtggagtttgtctgcaaggtttacagcgatgcccagccccacatccagtggatcaagcacgtggaaaagaacggcagtaaatacgggcctgatgggctgccctacctcaaggtcctgaaggtgagaactttctgaatcctcaggagcccgcagtgagggctcccttggagatttggccagggtctttgatttcctgttggatttcagagatggttttctttatggagcagccagtagagtatattaaagaatgagtagccattaggcctgctaataatgtttctggaggctgtggagtaggggaggtgctgatacacttggaaccagagaattctgctatttattagccccaaggagacgctaaagctggggtggggtactgctcccaaggcgatgtagagagtcaacgggatggggtagatggaaataactggaacgctctagacaatgtactaacgtttttctgatgttgttttatgatatttaatgctatgtggataataacatttgaatcaaattttagtagttagaaacaattcaactttctttttcaaaaaacttctctttcaccttttatgatgtatgtgtagtctagagagtaaatggtgtgtgtgggggagggctgttttttacatctataaaaaaaatgagcgaatttccttccctttgtattaaaagaaatacttttttttcatgtactcttttttttttttttttttttttttttttttggggctccaacctctttagtttttgggtctagcttcctcttcagcgtgctgagctaagtctgttttgtcaattctaagccactgtctgcctgtctcccgtgctcccagggagtggagtatacagcagtcagtcttcctgttcgactataggagcaacaggcggctcatgaagaactctcaacctatagtcttctctctagccagccatacccaggatccacagtgctggagaaagacggccagcccggagagctgctcacccgtcccactgactggtcgcctcttgcaccctgctctcatcactactgttctccaccacttgacttactttgttctcctccctcccacagctctttagatgtaatcagtggagattgttttcttgtggtgtgttggtggtgggaccataggcagcaccgagtccttcctggttggccgttatattgttttcctatgtctgttctagcactcggggataaatagctccaatgcagaagtgctggctctgttcaatgtgacggagatggatgctggggaatatatatgtaaggtctccaattatatagggcaggccaaccagtctgcctggctcactgtcctgcccaaacagcaaggtaacaacgttttttgtgtttgtgtttttttgttttttgtttttgtttttgtttttaagaaaactggatataggagtttaaaagactcggtgctttgggaggcagcaggcagcttctagagtaactctcatggccttggtttatttataatgatctttctttggtgatgcagctggcgtcatgccagtggccatggaaaaatgcccacaatgttcaaagtgcttgaagattatcctccgtccctaaccctgttttcaagcgcttctttctggtctgtcttgattggactgcacacttcccatgatcactgtgtctgagtgctcagggaccttgcatttgcatgcctgttgagtctgcactatctgattatgaagcaggactcacatttctttttacgctggttatgtagagaagtgctagcatgataggattcacctaatgaaagttttgttctttggtttggttccacaccggatcctatccaatattggagattgattatcttccagtgactgtgacactggaggatggtgaaggcagacggtggagttttcagttatttttcacatgcagacattcatattagaaaacaaaaaaactataaaagttcagtttttctgttaccagtattatgctttctgccatgttctttcaatgatatgtaaagcaagatgattttagcttgagcaaaattaaccagaatctggtaaccaagatgacatcccaccctggttcccatggtgcccaagggatgtgtgagatgtccacctaatctgccatgttttgttccatcatacagaagatggaacctccccttttctcacagtgggggagtctgcatccaacaggaccagaacccaaattagccctctggatattgaactttttgttaacccacccccaaatccaaatgaaaatgaattcaaagagaacgaactctgtgggccaatttttccatgtgttcaattgcatgcatgtctaggtggtgacgccggtgtggtgacgggcctgcagaggtgagctggccggtgtctcttcgtgtctctcggttgtgggctttgtggatgggctgcagttggaatctcctgatggccagcacgccctggacccgctgggacgaggcctcttggttccaaggctccctccacactcattcctatgtctagcccttctcttgcttcgtttgttttctaggccgccggtgttaacaccacggacaaagagattgaggttctctatattcggaatgtaacttttgaggatgctggggaatatacgtgcttggcgggtaattctatcgggatatcctttcactctgcatggttgacagttctgccaggtacatactgctctttctctctatgggttggtttcttttcttggttgattgctataaaatcaacacagcttctgttcttagaaatagccccgtttatccattgcataaagatgcccccccaaatgttccaaatgacccctccccccggaacaagaaacaaccttagacattcatgcacgaagagatcccatactagaattgatggttaaataaaatgccaccttttaaacccaaagggatcttataatcttagtgaattgctgaattgttgactcagtgggcccatttcccaccccagcccccaagaagaaagtcaaaattactttgtgaaattcaaagtaattttttccccattgtaaatcccactttggtaaaagcccatatgtggtttgatgcctctccatccgacttgctgacatctcatttgagtgcagatgtatttgtattggggtacccaggaagcacctctgaagggaggtgtgcagaagcagtgtgttaccttgggaatcgggtggcttgctgcatgccttgatagagtggcctctcgttgcttttcctgcaaaagcatgtgtgtgctgtcttgggctcgatgttatttctgcctcatcgagaaataaacatcagcaaagcccatcactgtctaagtctttaacccatgcctctgttctagtccaactttctcggtacatgctgctctctctcgtgcattgcctagcatttcctttggaaaactgcatagactgggttgcagctcatgacgctcttctgctccagttatgagtgccttgtttctagagtaccatgctgactgcatgcttgttttatagctcgtaaaaataaatggatcatttcgtttttgtgctgtgctgctgagagttttgactatctttgcaaatgtttgtttttctgattaaaatgtataagcttgagaataatacccgttgcatccaccttcccctttggttatgttatgagtccgctctgtgagtagttggtcttgaaacagagatgcctctcctgttgagcttgcttgtacttacagtgccacgctctcaggtgcctacctggcacttcttaaccaatttgcctgacagcactaccccttaaggagatgcagcttgagaataatcatgtttggaaatacactgcttgtagattgaccagttgaggaagaaccaatatagttgacagaagaatatgctaaattaatcacagttctgctcacatgcagtaccatcatacatttaaaggttcagtaacaagtcaggataactggatatacaaacattttattggttcttaagtattatatatatatatatatatatatatatatatatatatatacatacatacatacatatctacacatacacatacatatatatcatatattatatatgtgactatctcaagattgatacatctgtttgtttaactgaataaatattctggaccatatgaagggacttgccaaaacattttgggccagcctactagttgagtgtgagccctttggagctaccatcctctggggtcctgttgaaccttcccctggaggcacctccctagctagcaagcatcatccctgtctccttagaagcaacagtggatgaggtcccttttaataattctgtttggtttatgtcgagccgccatcatgacagacagtcctcctgtggtgggtgtcctgggtgtcctgctatgaccaggggcttagcagaatgaggccttgtagtcccccattacagtctggtatcagctgctcactggtggcagatgcccattgaggctggagaaggcagctgcctgggctgtagtgataaaccgaggaacccttggctctttgttagcatttggagaggcccaggcaggaggcccatggctgctctgcatctgggtatctctgtgcattgacctgtagatagggaagcccttgatgtctttggcgtcattccttgaagtgtgcttcgatacatccctctggtatcctaactctgtggcctgcttatttgtccctctcccgcggatctgcaacccagcgcctgtgagagagaaggagatcacggcttccccagattatctggagatagctatttactgcataggggtcttcttaatcgcctgcatggtggtgacagtcatcttttgccgaatgaagaccacgaccaagaagccagacttcagcagccagccagctgtgcacaagctgaccaagcgcatccccctgcggagacaggtaacagaaagtagataaagagtttgaagaaatttactcccctcccccacccagccagctcttggatcttcttccctctgattttccccctaacttctgtgagctccagaactgcaggcaattctaatctgccactgtgtggaggttcagtcagcggttgggactaaagagcattaagtcacaatgctgctctgggcttggtaggctggctctggttttaaaggacaagagtgtgaagactggagctgcccagtgggatgggcagaggaggccatgccctctgcgcccctcaagctcacggctcctttgggagaacaagcatttggtctggctccattgcttctgtatgaggccagatgttcgggttcaagttttacccttcataggaaagagagtttaattttctttgatttactattttaagtagagatcagaaacagaggatggaggtatacctgaactaatgcttgcataaaagtggtctgtgatgtcttctaaactgggttttggctgattttgtctggtttttaaaacgctgtatgcgtatagtttattgttacaggtttggctagggattcagtgataggatgattgtgtgtgtgtgtgtgtgtgtgtgtgtgtgtgtgtgtgtgtgtgtgtgtgtgtgtttgtatttaggttataagtacatgtgtgcaggtgcctgtggagaccaaaagagagtgtcaggtccactagtgctagagtttatcagcataggtggtaggaattgaactctggtcttctagaagtgcagcaagcactctttaaccactgagccagttctccagcccccagatacgatgattgctatgtagaacagggagaaaattacctttaaccttgagcttgatctttgatggctggctttgggggaggtaaggcaatagaaccttccctgtgccataaaacaaagcccttcaaaggtggataaggaaaaaatgcttgacttctgtacttgctcctggattccaagagccaggcatgtgtgggtgtaaatctttatgataagattcggaacttgattctgataagattgtcactattttttttaaattagcaatggaaatgaacaacctggcctgtgctatggggaggtgcatcttagtgtttgttaaaactgcatattcattagtttcaaccctagaaattcttatttagtacttcttgaatggatctgtaagagtctgcattttaaacactttctcgggtgatactgtgtaataccttaagaatctctgggttcaacccaaccctgcctttcctgggccctttctgtggacaaggtgggaactagcaggtcagtagtggcttggacacagggccttggctgttctcaacctagcttcacactacaggctgagcaggtccttgtcaacgtccttgaagcctcgtttccaacaggtgtttcttgcagagggttaagatataatttggagcatatgtcagatgcagcctttggccagctgttgaatgtggagtcaaaaaggctcagttgggttccttttaatcctgagaatgctgtgctactttgagtgacaccactgtcatttgtgggaccatagaagctagatggtgctgaagttaaagttggttgcctgaatgagttgctggaagagtccttaataaaactcttacctggctagatagtgttaaggcttcaggctgaatggccactcctttggccactcctttggctactccttcacagcctctcctgatctcttagccctgggccattcttaacatctggactctggtctagggagtttaagtaaagggagcaatgtcctgtctcatttgtttttataatagagaaaagaagtaaaatccataagttgaggtagataggccattgacccttaattatttcatcatttaaaaaactgatgtgtgtgtgtgtgtgtgtgtgtttatacatgtgtgctggagctcttggaaagctggaagagagcactggatccctcagagctggagggccggtagttgtgagctctctgatgtggtgctgggactagaactcgggtcctctgcaagagcagcaagcgctcctaatcactgagccatctatctctccagcctgcatcacttttaaagaaaactctctttctatttctccattttccatttccatttccatctttttacatttatatattacatttatatatttatgtagcttgggcacgtgtgcgtttgtgtgggggcatgcacatggcatagcaaggttagtgaaggtccttttgaaatggtggccaggggacaacttacatgggagccagcacctttctctaccacgtgattcccaggaatcaaacaggtcaggttcagtcaggtcatcgtatctgatgaccgattttgttgactccatcgcttttaaagaaaaaaagaattaacacctattacagcgctcttccttttgcttcatgtgaaaaagacagaggccctggagttcccaggcacatggattcagcatgtcttcctttctgtttgtccaactgagtttcttcattttctgtccacctaagctgtccattttgtttgtttttatattccctgtgtgaccggagggaaaagttgttgtttttttttnnnnnnnnnnnnnnnnnnnntgtgctaagtttctcacctgcttgcctgaactagccaataagctaggttatctggtctgtgagccccagggtcccaattgctcctccttctcctcctctctgttaggattccaagtgtcggctcccaagcctgactcttctttttttttctgagacagggttcctctgtgtagccctggctgtcctggaactcactctgtagaccaggctggccttgaactcagaaatccgcctgcctctgcctccaagtgctgggattaaaggcatggaccaccaccgcccggctttttttttttttttttttttttttttttaatatagctcctagggattgctctcaggtcaaggaaggcaggcgttttgatccttctttctccttgaggtttgcttccctgccctgaacttgtttaaaacaggcatttcactttaaaaaggtagggtctttttttttgtgggtggagggggtggggggtgttttctgtatcaaataaattctttatagtctttctagtaaacattaattttgggagacattgtgcttggagtaagatacgcaactttttggtgggacagcctggtaggtagcctgtgggatctctaaggaggagtcatctctctcacccaaggctaggactgggcactttgtaagcgcttgcgcacttgcctctacttcttggtacctagtgttaaatggcaatagtcagtctagagaagggcaccttgtgacccaactggaccatcagtggtcactgggcagtggtctttgtgtacttctgagtccaagtggaaggatttgcctactgtgatttccacaagtcccttgttggggaggtgggccgtatgtgagtgcagagcggggtggaggaagccttgttctgtggagtgcttgtttgtggaggagctttcctgggtaggttcagcttctttctggagccagaagtttgcttagggcaagatggagatccatctgtctgtgtccagatgagtgcatagcctacccgatccccgagtctcacacgggactgtagtgagtttgttcccagcctcagccattgacatgggtagctgagaaaaccagagagcaatttcataatgcgtttgagactcatggttattcagggtgggctggggggaacacttaattccagagctgttctcagggcaatgtattcgtggtcttagagtatatgaaactcagtgaaagtgagtgctgactgcttagcatcccagcaccgtgacctggaatctccatcgtacgaggtgtagtcgatccagagttgcagtgtaccggttctgggaaacatttgggcagctggatagttgtggatgacccgagtggagtcttcgctttcctagggatcgatcgctttccttgtccccagtttggcctgtcttttctctcagcccctgaaagacatgctgccttggctgagatccaccctagacttttgctgatgagctataagtaggttcagaacacctgagtcaggtacttttactgttgtgacagggcattcaagagtccagaggaggtagaagctgtctaaggggcagtgtgagcaattacctagattttgttaggaaggaaaaacaaaacaaaacaaaacaaaaccaaaaannnnnnnnnnnnnnnnnnnntttatgtagcttgggcacgtgtgcgtttgtgtgggggcatgcacatggcatagcaaggttagtgaaggtccttttgaaatggtggccaggggacaacttacatgggagccagcacctttctctaccacgtgattcccaggaatcaaacaggtcaggttcagtcaggtcatcgtatctgatgaccgattttgttgactccatcgcttttaaagaaaaaaagaattaacacctattacagcgctcttccttttgcttcatgtgaaaaagacagaggccctggagttcccaggcacatggattcagcatgtcttcctttctgtttgtccaactgagtttcttcattttctgtccacctaagctgtccattttgtttgtttttatattccctgtgtgaccggagggaaaagttgttgttttttttttttttttttttttttcatttacctccctttcttcttgtattcattgttatttactgagtgcacagtttcttttagtgcatgggcctaaatcaggactcttgggctgggagtgtggctcagtgctggcatgctcgcctagcttgtccaagcctcagtatcaccaaagaaaataattaagccagtttcgtgtcagagaaagcctgcccatttgccactggctgcaaggttagtgaaggtccttttgaaatgtttcttcatgctgacgctggataacaaatgtgtgaggcccaggctctctgcatgaggaagcctctgggagataaatgggttgaaaaggtactgataataccccagcatttcctagaagtcatggggaagtatggtactaactgcctcttcccaaaggatttcccaaagcccaggccactgggaggaggaggaggaggaaaaggaggagaagaaggaggaggggagatgcttatcatgagtctggataaagagggttttgggctgtagctggaggcctgcagataggttaatgacagagtgaattcctcagggatgccaagcatgccttacctggcgacagatgagcctgtaatcagatgtctggaggacgggtgctcccaggcactaagaggctagactttattttgtgttggcccaagcttctatatgatgcagcatccatgccctggcccttgcccaggacggcgaggaggcgcatagcctctctccattcactccatctttgtctttgttttagaacgagaaaagttggtttgtttattcatgctgtttttttccatgtgcacaagcgcgtgctcggaaagtgtgtaggtgtgtacagaaagtgtgctgaggnnnnnnnnnnnnnnnnnnnnaggtgtgtggggctgacttaagatagaacacactggcctgttctgatgtggaaggctccatctgctgcctgggagtcggagggtgtctcaagtctgctgtagtccaagggcatgtgtcaattctcaggaataaagacaaacttgactcacccttccccgtactgtctttgcttccgcctgcactgttgtctgtgaggccccctctgaatgttcagcttcatccagcataaagggagacggctatgacttggtggctctttaaaaagaaaaggggagaaaacccacttcctccgttaatctcccatatgtaccgtggaaatatatgaaaagcacatttagttaaaagcttgatttatggcacgtggtaaagagatcccggcatgtaaggctgccgaattggagactgtgaagagtgtgcggctttctaaaaaccgcctaccaagatttggggtggggaatgggggtggggcggagcaacagtttactacagtgttagcgtttattgtttataagtgaacttctaacagtgggatgtttttaagtgcgttgaaagggaaactccaaaatggaagtttctagattaaggattgagaactatctgaggagggaagttataagtacaagagaaagagaagaaaggaagtctgtaatacagtggtgtgaggaaccttccaaggtgggcggtggggccacaattcagagggaaggagcccctgaaaagccaggctcctccagggacccctgctggggattttgccaagccctccagacaggttgcctttctgaggagaggcgagtgaagagaaagccagtcatgctttatagccccagagaggattttaaaagtatagtaaaacgcatggaggtagaattaagatggacctctgtagacagggagagcagagtctgtatgctcagagactttgcgtattttcttaccctttcccactctgggtgttttttacaaaggtattttccaggcttgtacattgaacctgaatctgcactgtgtattgaacaaaattcccacacatgaaggcagttttacattttgataccaatgtgcagcaacgactgccaaggttttttttttttcttccgtattagtttagtttttttttttttttctccccgttttccattttgaaaatgttgcccttaaaaccttgtggaggtgctctgttgtggggtgggtatgcgtatgggaaacttgcaccccaggcctgtgctgtgcattctgtttgggtcaaaggtcctccacagagtagttgatgtcagactggatggtaaatctctctgttttgaggtaacccctaagtcatggtcaccagcgggaccttgctgctctatggttttcttcttctcctctaattcctacattaaaaatatatatagtcttgcttactggaactccaggctatcctggctggcagtttagggtcccattttgtaaatcagactcgcaattcaggtgtatgccatctaaaatcagaacaaactcaccttgtagagcagactggtgagctatggctgtcccagctcagcaataagcacttgatgctgtcttcattctgtcctgctaactctgagaccacctgagactcacatagacccccggaatctgaccttgacttcacggtaccattgaccaggatgtagcctgccagggcatcttggccctgggtgatcaccaggtcacacattgaaggatgcggaaacatcacaaaacagcctggggtgggggggacaaaaaagaagtgccatcgggcgtcttgctagtttctaaactgaagtctgcataattcaaccctgtgccttcttttcctgctgttcatatttattttattccaaatgctattttggctaaagaaagaatgtctactaaaacacaaaggaaacacaagaccagggtaataaaatctatatgatgtagaaagttctagaataagacctgtttcctaccttgctccctattcttgatctctcactctctctccgaaggtgaccactgctaaatccttagatatctttccagaaaacatttcctgctttgcttcccaagtcttgatctctctccccaaaggggaccatggctaaacccttagatatccttccagaaaatgcctgtggtcacaacccatcctgtaagcctctatgtgctgagtactgactcccaaggacaggccacagaagctgcgatgtgccactagcctctggccattaccatcattcagaactgtggtcttctgagatttctcagcatcccctcctcactggtcttagcacacagtgggtcctaacaactaagctaggaactttagggtccagtgatgcagaggcaagctgatgatggccctataaagagtatcctggctacacacagtctctgttggctctttgctccctggggtctgtgttgtctcattactgggcagacttttacttgtttggctgtagcttcttgcctctgattatctggtgtgaatttttactatatttctactgggagatgatttttgcctatttgtgtggaaagactgccagaaagatcttaaaaattaaaaaaaattacatgccttttgcaagcataacttgtgagcctgattcagaatgagtcaggtgggtggttccacagaagcactatggaccagctccattccagaatcttctgagtcccttgtctgtagatggagctcacgatgtttttgtggccagtggaaaatggacatcttgatgttgtcaggaaacttctggtttctgatgcagcctgctcaccacagttaggctggacaccatgcggacagtggaaggggcttgggagttatcttttgtcctgctgggatggaatgcctattctggaacaaggcaagtgggttctagaggcactcgcgtgttccctgctcaccttcccctgcttgcttctgcgtttgccttagagattgggatccttgaatgtatggctctctattacagaattaccaggttccttcttcttcttcttctttttttttaattaaaaaaaaagcatcaatttttgttgtggcacaaggagtaaatgtcctgtctgcatagtataatgtatatacagcttcttcttgggtacaggtgagatggctcaatggacaaaggcacttacgctgatgaccaagcctgacgctctgtagtcaatcttcagagcctatgtggtaggaaaagagaactgaccctcagaagttgtcctctgacctccacactgatatgcacacaaacacatgcacacagatacattttttttcatttaaaaagaaaatcacctttctccttcccaaaagatacttagaaggttcagaaaagtccttatgtgtattttaaataataagatttcatatcaaaatttgcttactgattttaacatttctttgtggggttttttttcttttgagggggggaggatagggtctctgggattgagctcagtgggtagccaaggataaccatcactgactttaatactgcaaacacttttcttcaattctattaagggtagttgggtttccaaagagcagaagggcttgccaatgggacagtcagtcctgggaacaacataggaccttgggttcctctgatgagagtctaggatccacatgggagagttcctttggctttatctttgccagctggattgaggagtttgtatactcagcaggggattgtcacccatgtgggagctggaagcctggtgtgcttgctgagtggctcttgtctaacctcacacccatgtctccgggaccaaagcctccgttgtggtctgagttgaaagcagtatccagcagcccaccatcacaccaagattgtgtagtcatacccaggcacaggctttgtgtgggctctgggtatattttctttcgcagaaatcagccaaggagagacggtgtgtttcagagatagacactgggtctgacacagtctgctatacatcaaggcaaacttggtgaagccctgtgtgctgctgggtgagagaggacccttcccgtgtggctctgagtgaaagtatcttttccttaacccttggtctcctgtattcactgctctgctttctgaagctaaagtgacaagagtcagcccattttcactatatggtctgggcatcatcaagtttcagaaggactggggagagatggagaatagcctccccgtgcctggaactctggatttcttgaataaaagacctttgagttaccagaatgccctttccctgtgtcttagttaggattttattgctgcaaagagacaacacaatgtaacttaaaaaaattatttatttgttttatgtatatgagtgcaccatgactctcttcagagacactagaagagggcatcagatcccattacagatggttgtgagccaccatgtggttgctgggaattgaactgaggacttctcaaagagcagttggtgctcttaactactgagtcatctctccagcccccagtgcaactcttataaagaaacacacttaattggggcttgcttacagtttcagaggtttagttcattattgtcatggtggaaagcatggcagcttcctggcagacacagtgctggagagagaagaagctgagagttctacatcttgatccacaggcagcagaaggggattgtgtgccatactctttgaggtttgagcaaaggaaacctcaaagcccgcccccacagtgagaaactccctccaacaaggccacatgttctctagcaaggccacacctcctaatagcgcctatgggccaggtattcaaaccaccacaccatacatatcttacagctctttccttgagatctttctttatactttggaggcaatggcagcacggatgacctcacttgttagatgtttgtgaatccctccctgctgacttgattttggatgtgtttttattttatggtgctggacattgtacatgagacaagcatcctgtaattgagcccagcctttgagttagtgatctataggctgagcaaaaaactataatgaagtcagtagagtctgtctgcacattcttaagtggctgtcttaaaacaattaaaggtaaggggctggagagatgcttcctcggctaagagcactggctgcttttccagaggacctgggttcagttcccagcacccacatggcagctcacaactgtctatacctccagttccagtctgacatcctcacatagacatacatgcaggcaaaacaccaatgtacattaaaaaaaaaacacctaatttttaaaaagttcagatgaaaagaagaaatactatgattaaacttctagaaacatttctatttgtaaacttgacctcccaaggtcaaggatcctgtgacttctcatttttgcccctgtattttgttgttgttgttgtttttgtttgtttgttttgtgttttgtttgtttgttgtttagtttagtttctcgttgtttgttttgttttgtcctttcctggttccttcccctttctttgtaagcactcctgctctggctgggtcccagctcacttccagcctcctctgatggagccagcattacatctgctgctttgcattttgtatacaggtttcggccgagtccagctcctccatgaactccaacaccccgctggtgaggataacaacgcgtctgtcctcaacagcggacaccccgatgctagcaggggtctccgagtatgagttgccagaggatccaaagtgggaattccccagagataagtaagtactctccctctgggagggtcgttgtctgcacctcctgggactgagcgcaggtcttggttgtgggagtctccacctgtgtcttggtaatcagggacctgtgtcttggtaatcagggaccttcgaactgtaaactgtaaactgtaaactgcagcaggatggtgcaattaacagagctgctggtgcacagggtaggctaccagcctgtgcccttgaggtggaagaccaaccttagctctgggaagtgaggatcctggaaggctggcagcttccttcttgtaggattagcgtctaaacagcttgagagtaacagaaggtggaaaaatgggctctttctgcatcaaagacacaggaatacgctcccagcttgcttgaagacaactcgtctgcctatcttgacattttttcagtgtcttcctaagattgttagtgatatgtttaacacacacagcgtgtgtgtgtgtgtgtgtgtgtgtgtgtgtgtgtgtgtgtgtatacagagattcagaaacacaaagacaagctttcccaagtctgggtatggccagctctagttgaaagttgaaggaagcttaggcccccttggagcttcgtgtcacactattccaggtattttggttcccaacttagagatctttacatatatcctaatccagggccgaggaactgtctgtgtagtcatcttatgtcagtggaaagaatttccagtttctttatatactgcagtgaaaagagcattcattcattccttcattcattccgggaatgtttagtgaacatttttggggtgaggtatgaaagaaaacacaaagaatggcttctttacctatagaattttgagaaaggaaggtatgtttctcttgacccttgccagcctcctagctgggtgtgattatagaaatagctgggttcgtgtgcacattcctatgtctacaaggctggactggggagttgtgctcatatgctaaaaacttgcagctttcgggttgagcctgtgctttgggccacctgtgacaccacagtcaacagtgtgagtctgtgttgcccagcagctcccacccgggggtacccaagtgtggaaaatctgagcgctatgcatttccaagcagtgtttagcacaaatgtaggtggagcacattcccaatgaatgaaggctatttagaaatggtttattaggttggaggcaggagttacacaaagagaggtttgttatggttgtagtaacaggggcaataggacataaattagccattttccaacgcaaatgtttattttctgccaagatgttcaatttaattttagttcttgactggaaagggggcgccttcagcagagcaagtgctggtatccattttcttttccttttttgagcttttaaaagcgttgcgtgcttactgcaaatgctgtttactgaggacagctcaatacttgcctgtactgggcttatggttttttggtttttgttttttttaaacaaaacaaaacaaaacaaaacaaaacaccccgaaaagcatactcaggctggagaggtatctctctggtctaaagcagacactgccctgtaaaggaccagagttcggttcccagcacccatgatgtgtagctcacaacctctgtaactacagatctggggaatctgtctgggctccttaggtgcctgtgctcacatgcccataccctctccccagaaacacacatacacataatcaagaataaattgaaaaaaaataaaaataaaaaacacactcctaagtattaattccaaagacttccctgttcctttggcttctggaacatctaaaataatgtcaggtcatttgtctgttgtgtataaaacttacatgcttagaaatgtaacttgtgctgttttctatttttttttttccttgtttactttgggtagtgataaggaatcctaaacttatgtcaaaaaggtatcgtgcctgatttctagaagtttttcttaatgagacacgataaattatttgaaacgtgctgaagattcctaccctgcaactgggcaatcgatgtaaccataaaatctaccggtattgaataatagtgatttgagagttgccactttacagggacagaaaataagaacagactttcactttttttttcacctctgcgacattttaaattataaatatttaattggctcaagaccaaaagctccctatggctggcatgcagggagcctgaccaccgcgctagcaaggacaccttccataaagaaaaagaaaataaatcgagaggacaaatgtgaaatttaatagtccctccaacagtaattgacgttctggaaaaacatcactaagaaaatagcctgcgtgtgtatcggaggctcattggttccatatgcatgcctctggaagatttttatatttagttctggaatttccctccctgtgcccctcggccagactcgcggtgtgctaatcccgtatttacacatttaggctgacgctgggcaaacccctgggggaaggttgcttcgggcaagtagtcatggctgaagcagtgggaatcgataaagacaaacccaaggaggcggtcaccgtggcagtgaagatgttgaaaggtgagtgggcggatgggcggtcggggaggagagggtcttatcaggagcgagcgttccttttgtgacatgtgaactctgcagggacgtggggtcagagagcacatacttgacctggcggttgagggggttttcaggataaatgagcaaatgagacggaggatttaccttgagctgtgtgtacttaaaaagaaaagccagtttagcagcaagttgtagcttgctgggctgaaccggtctctaactccttagaaaagggtcccgattctcttcttttctgtgtgttcatgggtttagaaagtttagggggtttatttagctggttaaattttggacccagacttttaacatacaaataaggagaggtaggtgttggagtggcaactggagacagaatgtcaaaatgtggattcaaagagtcgcttagaagccaaaaaggagcaaacaattggaactgatgcagaatcccagggacatgtaaacaataatgccacgctataaatgcccgctttgttcttttcttttcttttcttttcttttcttttttttttttttaggggaggggaggggagggggtctgggaatttatccacaacctttctaacacagcttgatgatgacgcccaaggagcttaaattgctttcaactattaacttatccttgcatgggtattcttttatcgaagagataaagggaaaggtcacattataaatcctgttgttggggaatctcagaaaggagaaaggagccatgttcaatgtttccctggcttgtgggcagagaagtctgtcccgggcctgtgggatgtggcatgttctcaggagtccgaccttttctctctttgataggacacttaccacatccctccctgatgcagacaacaaagggccaggacatggttcattttgtcagttttagttattgacctgagactcccagtgaaatctgggatgttcctttctttggagactgataccaggaaggagatagcaagtatcggggcaccagggcagaggcagcccttggtacctactggaagctgtgggttgggaaggatcaggcatcatactgctttccacagaacctctggttttgagatccctggggctagtgcaaaagggaggtttaggggttggcccttccctttaagcaagatcacccaccatccttttcatcatggtcagaggacatgccttttcaacattctttgtgacagccagaggatggctgaggtgtaaggaagacaagtgtactgagccatgtgtctgtccatagtcctctcttccctcttctctgtattggtcaggatagatttttggatacctgtgcctctatttcatttttaacccttttgcttttcttttagctcagatttttcttttctaagtatttctgtattgaattagcttagtgacagaacacttgcgtggtgtgcacatggtactgggtttgcatcctagcattacaagaatccaaacgacagcagaactaactgagaggagagcacagtaccctggaaatgctcttcctcttgtttgaagctctctgtgaatccatgttgtgttgggcctctgccacgtatgtgccatgtatgtgagatgtgacttgtatctctggtaaggtggtagttggagctttagagaggtctcttttgctcactcgactgtttctgtgtacacacacatttgtagatgtgcttatgggcctggacctaactttgaataagctaaaggctctggaatttttgctgtgtaaaaaacaaattttctagtggttcccaatgtttttcctatggctttctccccattgttcttggagttttttgggggtgcatcaggaagtttgacatgctttctagaaggtaccttggatacatcagagggtggggttaattcacaatcaagtacttcacttcgaaagacttggccttggtcttgtggcctagatttggtcccaacgtttgcccatgtgccctctggtgatctctttgttactgagcatggcactcaccggcttcagcttttatctcttcactgattagatggggaagtgtttctggctctaaaattcaactccacggtattctaagagtttgatggtcaagagtgatagcttgggagttgggagaaaccagctgattaatggcttgtctaattcgtgttcacagatgatgccacagagaaggacctgtctgatctggtatcagagatggagatgatgaagatgattgggaaacataagaacattatcaacctcctgggggcctgcacgcaggatggtgagtacgagaagggtgtgttttctgtccacaccacaccgctgactgccaggcttcaactagaaacaactgggctcttggctttctgcttttagagcatctcaagaatgcattttcccatcacacctatcccaggcactcaagatgctgagacagaagagttacaagtttgataccagtctgggatacctaggaagactctctcaaaaatacacaaaagtagaggctgggagacagctcaatcaatagagggctggccttgcaccatgaggacttgaagtggatttttagaatccatatttaaaattgagctcttgccaggagtggtggtgcacgcctttaatcccagtactcgggaggcaagaggcaggcggatttctgagttcaaggccagcctggtctacagagtgagttccaggacagccagggctacacagagaaaccatgtctcgaaaacccaaaaaaaaaaaaaaaaaaaaaaaaagagttgggcgtggtggtgcacgcctttaatcccagcacttgggaggcagaggctggcggatttctgagttcgaggccagccggtctaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgtgtctgccctctaggggcgtggcaagttggaagtggggactttggaaaggaatttctgctgacgctcttgctgtgtatggggctaagagagatttcttaaaataagagaagagcagtatgctttagttgagaagttctctcaaaatggggactgaggaatcctgtcttgctttaggcagcagatggctgagcagaatagcttcacagagagagtggaagaaaagggcagtctcccctccctcccccatctcccaccccctggggagtgagctcctggctgctctcaggagtgcctactggtactttagaaatcagcttgacagtgatgagtagatttgaaaaatgcttgcgcagcttctctttaggtgtgcagagactggaaccttcttcaaagggcgactgtaggtattttagacttttgtggacctgtggtctctgttacaggtacttgtcactgccattgtattgaacaaacagcttatatgatagagaaatgaatgggtgtgactgtgtgacaataaaatgtgatgaccctgaccagtatcgggcaggatgtggggatgtggcctggggaccattctctccaacccttggaccaaccccttgctctggctgtttgaagccatttaaattctctcttttatttcatcctatagatttagtatttacttatccttacaatatatgtatatgcacatgcatgtacgtacacacacaaaggagctcaagggacttagaatggccatgcttctgatggacattgcttttccaggaagacagcagtgtttctcaacctgtgagtcgttctacccccatagggggtcccctaagaccatcagacaacacagatatttacattatgattcgtaacagtagcaaatttgcagttatgaagtagaaatggaataatttaatggctggggtcaccacaacgtgaagaactgtattaacggactgcagcattaggaaggttgagaatcactgctctagagggaagaagggcattcaaaggaaagttgttacaactatgtcttttatttctttaagcctttggaagttattgtgttgatcatcattttggaaagattagaaatggaggtgctcccagttatccgtgcctttctgagtggtaaaaccttaaaaaagaaaaaggttggggctacctcaagtgatggtatacttatttagcgtttactaccgtgttgtgttcgaggctctgggtttactcctcagcaccacaaatccactctaggttgtaatgaccaaagcctttgctgagtcaccccggaatagttcctccagccttccctgctttaaggagcctctcccctctgccacaggacctctctacgtcatagttgaatatgcatcgaaaggcaacctccgggaatacctccgagcccggaggccacctggcatggagtactcctatgacattaaccgtgtccccgaggagcagatgaccttcaaggacttggtgtcctgcacctaccagctggctagaggcatggagtacttggcttcccaaaaagtgagtccttcccattccacttggttggatgcaaatgccggttaagtgtctttgaggaagctgggtggttcagacgtgctcacttgcttgatctagtcctcacttgtcttatacaacctggaaaatatttgtggtgttattcacgttctggtttaatggactcttgagaggccagaggcagcctcacaaactcataacaactgccggagagcggaccctgctttgaggcagggcaggtgagatgctcctggatgacctggcttcgatcgagtgagcttagaccacagttaagggtgttaaatttagaccgttgagctcgatgtggaattaaatgatctgagaatggagattgagcacagaagtatttttgacatcaagagtctgggatatctgtttattttgtctccttcggtgactctgtggtcagaagttggccaggtcccctgaggtaaatggctggcattccaagccagccacttacaatggaacgctaagcattccagctattctggaagctgtgaggcaggtgctcagacttttcatggggatttcagaggacctaagatacctttcctcacttccatacttatgctcttcccatagagatgcttggctcctacctggagtggagcttgctgcagttccattgtctctaactcctcaggttgccaaagacaaaggatcccctggaggggcgcttctctatgacttggagcctggcctactagaagggtcattaatctggattcccccaggggcttcattagtgttaagagtgagtgaggtgacctggtcagatggcacaggtgccacatactgcttctcagcctgctctccatcacctgggaacatggcttagagttagtatgtgctccaagttgtgctttgttttatttacttttttctttttctattttcttgagagtttacagcttatagcttatacgttttccttcttttatcttttctttctttcttttttttttttttgaaaccactataaaactttctgatatagagggtttaagaagccaaatttgaagagttttgagttctgattttatacatgcatggtgtgtgtgcacatagtgggagcagggtgcccctgagaaaatctttatcaaggagaaacagacatttgttggccagtggtggtgcatgcactcgggaggcagagatagtttgaggccagtctgctctacaaagtgagcttcaggatagccatagtatccttcataattttatgcataaaacaaaggtttatgatctgaaactttccactcatgacatctcaccaacactgcaaatgttttgggttttaggttaggaaatgttgaggaaccaagatgtctgcattttatgtatatgtatacatgcatgtgcatatatatatatatgtatgtgtgtatgtgcatgtttgtatatgtgtttatatgtgtacacgcacatatatgtgtatttgatttaatgtctggcagatgtggatagctgtggcatgatttcctcttgacatgtttgaactattgcacatggaaccctgggccgggcagtcagccgtaggcagcctgtcagctccaggcttggttgctgctgtgtgtccttcttggtaggagatgggggatgcttgcatgcagtgggcttgctgctgatggggcagtggtagaactggctcttcgttttccttagtcctctttagtcctcaagactccccaggaacttgttctctgggccaggctgtccagtgaggtgtcattcttgatttctcaaaacaggagtcatgagtaacagtggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagctgtctgtcccctgttcagagtcggggaaggagcgtgctggtccacaactatgttcatggttctgacccacccccagtgttgtggactttttaggttgcagccagtaggtaaagtggagcaagggctgtcacatgaactttgcaaagagagaatgagtacatttgggggttgcagaaacagcgaggcatagacgtgtccttacaaataacatggtgatcattgactgccagccacctttcgagagcctacattggccagacaccgtgtagttgtttagctcttggtattttccagcttcctgggatagagagtgagcaagatggtaggtagcagtggcttatggcagcctctctgtcccagctgagcctctgtgtggtcggagccccctgcaggggaagctagattcttctgaccactcagactgccaaactcagagagcacatgtcagcaggaacacactaccaggagaacttggccagggccttggaagttgaatttgaagaggcctccaaaccggcgttgcactccagcccaggcagaactagctgcaggcagccccgggagctctcagatttcctgctcctagtctggctggggacacgaagacttgggtggcttgcctgcttcctcgtctctgagttttggcccacccacacatgcaagggaacacaggggatgcttgggcgtgggtgagggcagagttaaaataattctttattcatgtttcaaacacagttaggctggtttcgtttttttacttggtcgtttcatggagagcttacaataaggcgttcctagtttgctcatccagtagaggaagtctctctgcttcatgtgacagttaaccttggtttgtaacttatataaaggcatttgagggtgatgcacttctaaaacacagaggtagatccatgtgaaggaaagcctggcctttggaaacaaacagtaatgaccagaccttcctgagaccgtagttcctattggcacaaaacatcctcccatcagatgtatcctagcaaacatagcagtagcgggtcctgatgtatgtacagacacagtttcacccctgcacaggctggctgttataacaaactgcacctaagaatgtggaccgatgagtactggctgggcagggagccaggagaggacatgctgggctgtgtcgcaagcacatcatgtaaaagatggaaagggggaatcaagaaagtttctgggcagcagtccacagaggtaggggaaggacagtgaccacagcctggccgaagggatgagcagtagaggacagacattggagccatctaggagttggaatggtcaggactcgagtctagagcacgatcctttctgattaaaaatcaaacagaaaagaatcagaggagtagaagcattggctttaagatgtcaagagggcacaactgtctgtggaaacatcctgagtctcagcaggggccaggatggaggtaggggtttgcagctgctttctgcatctaagaattgatgctacaggatcgaagaaacacgcaaaccgcatgtcacagtttctttgctttaagggatttgggaagagaagagtcagcctgaatctgcaagagagtgaagcaagaggaagatttggggaggctgctacgaaggaaccatttctagaaacagacctctgcagtgtccagagctgcagagatggcagacatggggcaacagaagagatcagttgggtctaacagtgaagagggtctttgtatagcctagaggccagactagacaccacgtagggaaaggaaaggcagaaatgatagagctaggcttcgctgtttgtagaacatcaggtcacattgttagagaagtggccatgaaatgaagactgttggagtttatctttgtcatctgaaagtcaggctttcctgggtagagagagcaagtgtgagctcaaagactttagcatggtatctgatgtcaagtttgtgtgaagctaccggagatacagcagtgttgtagacacttgaagataaaagagaaagtggttatataatcaactgttactttctgagatgaccagggcctttgtttgtttatttagattacaatgaatgattaccatgccttgtgggagcctcttgtcgatgctagtcagctggttgagtttgcagcccaggatggctcttgcagtagtctgcacccaatttttgacttggggtttattttctgtcttgcatttttttccaagagtgtttttcttttggttctcaaaacatgttgggattatatctctctttcttcttctttgattgcagtgtatccatcgagatttggctgccagaaacgtgttggtaacagaaaacaatgtgatgaagatagcagactttggcctggccagggatatcaacaacatagactactataaaaagaccacaaatgtgagtatatgatgtaacactggggagaggcgtggcaaaggttacagaatgaatgacacaggtttattggtggaagaactgaggggatttccccctctgtgttacattctgttgttttgcttaactcttgatcagcaaatctaggctatatctctaagataggtttaggatatacagagtgctattttatacagaataacaagcaaaagcctccagggctccgtgtggctctcttaagagccttcataagcaggagatggcgagatggctcagctctcatagcaatcactagaacttggacatttgctgggttcatttttgcctccaggctgattggagtttatttgtgtgctagggaggtagatgataatgagcatataaagaaatgtcactttgatactttattcaaagaaccaaatctatgcatcttagccattatgtacagagctagctggagcttattcctaccctagtggtaaattggtgaaacccattagaaaggggtgtcttcatttagtttagactgtaatgtggatacccagaagtggtgtgcaagggagccaggaatgcctaccactgggtgctggatgagtgctcaggtttggagctcaaactcaagacaggctggagtagagaaatgagaaagagacagaagtaagaagtctactttccagacctggctcttggaaccagcccggaagtcctgggacttgatctggggcctcagtttttttgtttgtttgtttgtttgtttgttttcttcctggggccctgtgcatgtcaacacagtcattttcatctgcattcacttgccttccaggcaatgcacaggcttgtcttccatggctcagcgtctctttccatatgtttcaggaagatgctataggacctaaccaacccatgtggttctgaagtcctttattttaatttttggcaagattaggtagccaggtatgggagctcaaaagctgaggcaggaggactgccaagagtttgggcctaccctgggctaattgtaagttgtgggcctctgtgggctacaaaaatgagtcggtacaattacatagggcgtggttctgttgggcccacagcagtactcttgtaaaacctacaggcttttccattttcttacaggggcgacttccagtcaagtggatggctcctgaagccctttttgatagagtttacactcatcagagcgatgtgtaagtaactctgtccttggcttatacatgggttgagttgcagaaatattacagatctcacttgtccatagaaggcatgggcgtcggggatctcagatggcaggagtctatggtagactggtgcccagtgtttggttactgatctgcctacctttggaaggtggagataccagccttctgctgccagagtggaagtacctccagtgatcactcaccactccatctcctctcttgagtgggtggcatgctcttcactcccttaaagaaacactcttagctgggcctggaagtgcacatgtacaccctagcactcaggaggaccgtaaattcaagaccaacctagaccacatgtagtaagtgcaaggctagacagggatatgtagtgtgtacgtatctttataaaaatgagaataaagaaaagactgaaacccttctgatttaggagtgtgtgattcttctctggcccaggcttgtcctgataggttgatgctggataagacacgatcagttgggatgaccaccacatctgctagctgtggctactacaatatcttaagtcttctcttaacctttgataacatcctagaaatacagtagaaattacataatatttctctgatgactcatataaactactgttagagccaggctccaactgatattatagattggggaatttagctgaaagatgttattgggagaaactgggccaaagatgctcctttttgccagttcctgtgggtctagaattattccaaaagacaacagtgttgttgttgttgttttgtttttgtttttgtttttgtttttaatttggatgtgctgggattttgtttgtgtatttggttgggttttttaagatttttgatgcaggtattgaatctacaccaccagccttcctaggaggaataagtcacagtttttaacttgtgtgggaatacactgaggctctgagctggttttgtttacattgtggcccttgcttggtagaaaaccagggacagtgtcagtgatgaagctgaccttacagagtcggtgtgcaggacatacctaacctctgagtctctgcttgattgtatcatagacttagtgctccaaactcggttggggaaatccagatgtggttctctgtgaaatcaagtacggagagtgccctgagagctcttctcactctctgctatctgatgctcttttcttggagcatgcaattcctctatgctaatcccagccctgtgctgggtcccttcacatcacaccaagtcgcagcgtctgccctgcgagtgctccacccgccatctaggacaggcatcctctcacagagtcatcttttctggccttattctgtcatctgtagatccaggttcttgtgtcagccacacagcgagatggctgatttagagaggagaagtctgaagtcaaggagtcaagaccctcccacctccacccccaccccccccaccgcatgactatcaccacagaaaagacaaagaactttaagagatggccgtggggctctttgtctatctatggaaaattccatcagaccatccacatgtcgtcctcatttagggaggctccttgggggtcaggaaagggcatgtaggatggattgcgggagggctcatttatctatggatgtaagaagtgagtgggtgtttattttttttaactgacatgtttaggtttctgcaatctggacgcattactaatgctatgttttctcttttctttgcagctggtccttcggggtgttaatgtgggagatctttactttagggggctcaccctacccagggattcccgtggaggaactttttaagctgctcaaagagggacacaggatggacaagcccaccaactgcaccaatgaactgtaagggctgtagccacccctgctgacagtgcagtgggctcatcccatctgtcctctctccagacatgtcttgggttcctcaggctcccattttctaagcatgctaagaagaatggctggagctgcctgggttcaatcccagtactgagatagatacttacacagacaactgtggcttatccaaaagaatgagcagcatcctgccaaagtgtgtggagtgggccttaaatctggctgccatgggaagggaaagccacacactgacaggagtactccataggtcaggcatgctaggatgctttggggctgcccctgtaaaatagacatggttgttcacagtgctggcaatcccaagtaggaaatgggctccttccaaagcacccttaaccacggatgatcgtcacgacagctaagcacggtggctcatactataatcccagcattatggaggctggagcaggaaggcaaagttgaggccagcctgggccacaaaatgagacccttttttcgataaaataaagtgaaaaaaagttaattttttacaaagtgatggggatgggaaggtagcttatttggtaaagtgattaccacacaagcataaggacctgaattcattcctaacatctacatcaaaagctgagggcagtggtgtacgcacctgtaatcccacagacagcagaggtagagccaagcatccttggggcttgctaggcaagcagcctagcctaaaccatcaaacttcaagtctcagcgagggactctgtttcgaagcataagatagatggtttttgaagaacagtatccatggttgacctccaactcccaaatgcgcatgcaggccagcatgtgtgtgcgcgcacacacacatacatacacacacacacacacacacacacacacacacacacacacacacgagagtgggcaagaacaaaaaatatgaaaagaaagttgccattccatcaaccacacttcctcagattgaatgggttgctgtgtttgcttacccatatttgagagctgggaactccaagtttacctggatgccatcattggggtaccatttctgagtatgaaagtgtgggctggtttctaggaatgcctccctcacactgtaagagaaattgtgttgtgttaatgacgcgtgccttgggcagtgaggtgctgccccctcctctggggcaaactaagaaagcgattgtccctgagaccgccttctattgtgtgtttcttcatggggattttagagcagtaatcccatgagcgctttctggtgtacagtggaaggctaatgaatggccactttttatagcgtattatataaaggcatttattgtgtgcctcgtgttcctgtcgctttttctaacatagagggtctgtcgaaactcataatcaagataaggcgggaagctcggactgccccgagagttgatcaggaagttagtgcaaagctccttggtggcagattagttggcacaaaccttcaagtggtagtttctgatttttttttttttttaaaaaaactgaggaacttttgtcaacagactttttaaaacaaaacccaaagtgtagttcaagagggagcatttggggaaggagaagggaggcaggctgtaaacctgtccccttccactctctagaggattctgaaaagtatccaatgctgtggtaggtcacactgtcacagagatagaggtgaagcctctatcacacacacacacacacacacacacacacacacctacctctgtctgggtacagagccaccctcctataacattctgtctacagagaagtttctgtaatggtagtgtttgtgtagttacattttcttatctagggcttgtctccatgccacctgttagaagtaaccacatctgtatgtcacatgcttggtgacaccagttgaccagagaaatcctttctgcaggtacatgatgatgagggattgctggcatgctgtaccctcacagagacccacattcaagcagttggtcgaagacttggatcgaattctgactctcacaaccaatgaggtaaaagcgtccctccagaagctcagagcccctgcttagctcaggaattgcctgtttgttgaatacaagctccagtgttggagttgggagcccccaccatttttagggtcaggcagagttaaactgtgtgctccttttcagtcagggtttttttttttccttctcagaacggaactttgagaattctgactcacaagactggaggctgaggcccagggtgtctgtgtaggcagagggagaggtggaaatgttttgtggtagtgttttggtatgcgtgggaaggtgctggcatgtaacatgcgccccggatcccatgtcctgttggttagtgtgaatgctgcttgtgctcagcggctgaccaacttgatggaaggcagtgacattctgtcctttccacatgtcacttgccttatgtgatcctgtctgggaaggcatgtggcttggatctttctgtgtggcatgtgtgtcatacatatcatgtgtgacttacattgtataattctaagtgacagaatttttaagtgacagttggtgtctgtagttaaaatattgatcataggggtggggttgaggggtggggagctagctgccagcagtgtgcttaccacacaaacatgggtttgatacccagcactcatacggaaagcctggtgtggtggggttttcttgttatcccagcactggggaggcggagactggtggacccctagaacgcaatagtctgctgacctagcctagaaggaaagcttcaagtcccaagagagctcctgtctcataaaacaaggcttccgcatgcatgaacacccaaatccatatgaatacacacataaaatattttattttctctataatttatgcccaccaaagatagcattttctgttactctttgcctatataaagccctgtctctggcttcaacataaattgaacaatctttagggttttagaaggaatattctatgagcagttaggcccacacagtccagggaaactctacatgaattttgagatattctctgaaccaaacaatatttcctcccaaagaaaaggtagatgcagctgttttcacaccaataaagaaaaggttttgaatctcccagatccttaaaaggaaaagaaagaatacagctgatttctgatttaaaaaacaaatagatcgcataaaaagacaaagaaaaccggcccaatgtagagatataaagctttaacgtggcagccctttcttgtgctcttggctgtggcttgtactggataaagggagagcttgcatttaaatgaacacagctgaccttcagaagttgaaaggaaaggaatagttcaagggggggagggaaaaaaaagccaactttcttctcctgccaaaactgttgtttctagcctaagttcctttaaccctaggcttggaatccagtgatacttgccccccacccccagtcagatctgaaggttacagcttcatttagaaactagaagggcattaggctttcatttaatgatcccaggtccgtactcaaagttacgtattgatatatttatgcttaaagggggacccattcctactgaactttatatgctttttctaaaataagaaagcagaatgccatattgtctaacggatataaaaatcgaagtttctttccttcttaaaatcattaccacatgcttaagaaaaatggttctatttaggacaaaatttcatttttatcattgtaagcaaaaagtcctcttttgatgtggtgggtgtgtttgtttctggttgtacagttaatgctgatgttgttggagccgatacatcccccttcttggatggcgactctttctcttgccaaccctagtgatgaattatagtgggtttttgtcttttaaaccctatgatcgccaacattccatgggctctctgctgataatgctgaggctgtttgtgctgtagtctgcgctttttgccccctctcagaaaaactgtatgtcataggagttgctggctattgggtacataagcaaagccaccctattgtgccagtgccttagacagtgagacaagaaaggcccctggttagaaatcttatcaggactgggaatgtaactcagttgataagagtgcttgcttagcgtgcacacagccctgggttcaaccgcctagtactacagaaactgagtgtggcttcacacacctgtaatcccagcacttggagagatagatgcaggaggattagaagttcaaggttatctttagtcacatagtattggtagccagccagcctggaatacttgagatacttacaggaaggaaggaaggaaggaaagaaggagggagagaggacaggaggaaggagatagatatacacagaaagaggcagagaaacagagattcaggagacacaaagacatacggagacacagtgagagaaacagaaagacacagagagagacagagagacataaagagaaatcccttctagttttgtccagggtcagttagtaagtactttctgtaaggcccaaagagtaaacattttcagcttcaaggccatatggtctctgtcgaagctgccattctagcatgaaagcagccacagctctatgtaaataaagagggtctgtgttccactaaactttatggactctgaaactgggaaatttatataatttcatataaatttatatcatttcatgtcattggctgccaaaagatatgactcaatttgatttttctactagccatgtacaaatgttgagaagtcgccttagttcatggaccaaacagaaacacacatgggtttgagccttgtcctgagctggaggaagagagtgacccaaagggaccttggtagcagccagggatgtgttggggagcagagaaacttttatgaacttcagtttcagtactgaaacttccctttccctagacttcctttgacagcccattacgggcttaacatccatgagggtagccacacctttccctaacccgtttctgttgcttactctggagctcctgagggtaatggattatatctgttaaactgtgcaacaaacggagatgacttctcccctaaatgatcctagaaatgacaactgtagaatgtgattccgaaaatacatattcatgtcctggctttgtaaagggtcctgctgggtttacttcactgggtcttaaactccgattgtgagccgtagtgaagagggctgtatatagtgggtcaccgaggtcctgtagcagagtgggcaagctcactgcctgctaccagcagttcactatgttttatggtctgctgcctgctggtggtttatagatgctgtgtcgtaagagaaaagttcagggtagcctggagtgaatggagttggggtatcagggaggtctttgtacactggggtgagctaggcctctggaaagcttcctgggggttccccgtcccttcccaaatctgatagagatttttcaggagcttctgtttaaaatgagattcttctcttcccttcttgcaggaatacttggacctcagtcagcctctcgaaccgtattcaccttgttatcctgacccaaggtgaaataaaacgtctctcttcccttcttgcaggaatacttggatctcacccagcctctcgaacagtattctcctagttaccccgacacaaggagctcttgttcttcaggggacgattctgtgttttctccagaccccatgccttatgaaccctgtctgcctcagtatccacacataaacggcagtgttaaaacatgagtgaatgtgtcttcctgtccccaaacaggacagcaccaggaacctacttacactgagcagagaggctgtgcctccagagcctgtgacacgcctccacttgtatatatggatcagaggagtaaatagtgggaagcatatttgtcacgtgtgtaaagatttatacagttggaaacatgttacctaaccaggaaaggaagactgtttcctgataagtggacagccgcaagccaccatgccaccctctctgacccaccatgtatgctggctgtgccccagttggactcaaggcagacaggtgttctgccttccttgttaattttgtaataattggagaagatatatgtcagcacacacttacagagcacaaacgcagtatataggtgctggatgtatgtaaatatattcaaattatgtataaatatatattatatatttacaaggaattattttttgtattgattttaaatggatgtcctgatgcacctagaaaattggtctctcttttttttaaatagatatttgctaaatgctgttcttagagtttcttaattttcaccgagcagaggtgggaaaatacttttgctttcagggaaaatggtgtcacattaatttattaacgaattggtaatatacgaaacgattaatcatctatagtttttttttttttgtaatttaagtggcatttctatgcaggcagcacggaggactagttaatctattgcttggacttaactggttattggatcctttgagaagagaaatatttacgatatatgactaatttggggggaaatggtgttttgatttatttgtgtttcaactctgctgtccgatgagcatgtctagacaccctaatgcccatgtttcaagaaacctgttaaactctgtcaccccagggtaacaattaaccagacttcccaagacaaatggtaccagcatcctcatcccaagatgccttaatccacttctctggagaacagacttccatgggaatgatagcagggtcctctcgtccggcagctggccttctgcccgggttacacattcatcacgtttgccttgcttctcagtgagttttaataacagcttcagattcttcagcaccaagagccctttggggaatctccatcctctcgaaggatggcaaaagcccagcatcattcggttgagagtctgggacctccttccatcttcttaagggtttgcttctggcttctacccacttctgacaagacctcacctcacaaaaagatctggcctaatagctacatccgacaagataacgcttattgttgatttccgtattcaagtattgttttgctttggatacgcccactcactttgctacagtcatgcgacatgtatgcagattacactgattttatgtgttttggaattggagaaagtatttaataaaacctgttaatttttatactgacaataaaaatgtttctacagatattaatgttaacaagacaaaataaatgtcacgcagcttatttttttaatactcgtgtcttaccaaatggtttcctgcgcttggaggtgtggacagtagttggtggtgtggatgcacaagaggcaaagctggtaggccacacatggggatgatttaccagaggggttgcctaggaacagcagcgcctggaacaggttaatcagtgaggaaccagaagttgattcaaccctggatcgatcggctacttgccgtcatctcaacagaagaagacatcatttcttcctgggtccttcagactttccagaggagcagcacagaggagaccttaaagatgacttaaggatggggaggtatcaatgacaagactcagattggctgggtgctgggacctgccactttccaggctaccgtccttgtaatgcacacagaattcatttcctgccactaaaaactgagcatttttcttgtctgcacatgcagatctaggacctataagctctcattatatttacttaggaacagcttcttcacctagacagggagatgatgcaaagatggagctgcagtggtgcggggctgatggtcactaaacagggctgtcctgctgtccctgttggacttgggtcatgggtgaagcaaaggcaccaggagagtggcatttggttctggcctgtgcttctgtttcttattagcagagcaaggtaatgaccccaccaaaagaatgtgagtaaaaaaataaagtatgtgggctgggctggagctcagctgtctgtcctgtgtttgctttacaagctcgaggcactgggctccatctccagcagtgcattaagaaaggtgtgaaaacagtccctgggtgcaggccgcttatgctgctggccgcctatccccatcactggatgccctcggcatggggtggagtgcacctactgctgatgtaggtgttttaaagcccaggttcaggatctaatgcacatttatctccagcggatcagccttacacatcttccaggacgctggcttcaaccctggagactacagtggaaactgctctacttcctatctgtttcagggagctgggtcagcaggaatcctaaagcagttattggcgattttagttctagaattactttgaaagatttgtcacagagggaaagaaaacagggcattcgtgaaaacgataggaaacaccttcttttctttttcttttttaaaatctgcccgaaagaaatatacacagagcttgttgaggatcctggagtttagggccaccccccccccctaatattgaaggaaagctttgggaggtagatggttgtcagtgaaccaggaaaccagtttatctgtgaagaactgaaagatggcaggtatttgaggtgtgtcctgggccctgttgtttccaggtggaaagggcacattcagaagggtctcttgaagtcctgtgataattgtggcctgcggtggtgatgggaagatggacagttgggctacaaagacagctctttgggagagctcagtgggtcccttgggtatgagggggtccccttgtccatagcctcttccctggggaacgtctcaccatctgatgttggagaatgctcctgaacttcacactcagggaatgaaaacaagttcacggtacagtgtcattacagatgtgtgcagctgtggatcaaggccccaacaccgttctgaagtggtgctgccagcttgtcctggctaataaaggtttctagaacattccagagagcttagctagtgcagatagaaacttgaaactgaactgcaggcttctaagagtcacccaaatgggaaatagcctaaacaactaagaccatggttcttcctggtgccatagaaaggcctggcaagcaatctggagtagaatcaattggcatgcttcgtacaccttggttgtgctgggcaagtcccaggttctatctggacatccatagatctcatcataaggattacctataggcgcttatctccagcagatggtctctctcttcctggagaattttttttacgcatgctagtggtttttgtaaagtatattcacagtgtcacatggccatcattaccctaatacctaaatgtcttcagatttaatttcaagtttccaaggagaaacccagtacccattagcagcttttccaaactctcttcctagcaattttcatctgttctctgatgagatacttcacacacattgagtcctacagtaggtgacctttgtgtcttgtttcgcttgtttagcataaggttcatttgtattgcagcatgtctcagtgtgccatctttatttctaaattatattatgttacatggatatattgcattatttgtccacctactgatggattttatgaataacagtgctttttaatatccatctatagttgtttgggttgttttgttttgtttttttgtttcctgttttttggttttggttttggtggtagtgatggctgagggcagttcatgtgtttttctttctcttgggcatagataggcctaggggtagaattgcttggtcacaggcaatgaactccatgtctgaacttttgaggacttatcatctcaattcctaagcagctgtcctgttttatgttcccactaacatttgccaatttttccacatccttgataatacttgctattgtctatgtttttattattgtacccttgtagacatgaagtgtttgctttctggacttcatagttgaggaagtgggtaccattcagatcacggaacaaaggcatatactatcttactgggcttttcagaaaaggttattgccttccaaatggtttggtctgcctacagcacttacaaattactattcggtaattgggaggtcttgtggcttctcatggaaaggaaaggctgagtgttgctgatcctgtcttctgacataggagccatcaccaccttaaccagagtggttgtggcttaccctcttccccagagacactcacttgagtttccagctcttcttttcctcctgtatttgtctcccagctgtatgtagttctgccccggctgcacatggtcttgggagagtatggaaggttaactgaaggggctattctgcagatttgaggaagccgttatccatgctgggtgactttggtgatgtggccggctgatggagttcactcaaactcctgtaaggaatccttcacccatgttcctataagtgagcccggtagatcgtggttaaccaagccaggcttgggtgagaatgtttcattggtctgttgttggtgtagtctctggggtgaggaggcatttggctgtgtcatcccaggaaagtcacgcaatactgagatgtcaaataactccatccttcccctcctggctgagagatgaaggaagaagccagcacttgacagtaagagactctggttcatctctacctcaaatccccagttttcttccaaatatagcctggcaaccttgagcagcctgtggggactgataaatgtgccgttgcttatgcatgcacatgggagtcctccagcctgtgttttgatgttatttatttattattttgatgtttttaagagatgaaagcagggcttatctcctctcgcagttcatcctaggaagccttgaagggacttggcagacttctgggcaaggtcaggagaagcctttcacatcttacatatcattcggaacagggcccctttagctcctgttttcctgttttgggggaagttttgaataggcaccttaaaattactttgtagtgtggactcaggagtcatgagaggcacagtacagacagtggacatacagacagtgccaaatattacctaagtggagccttaggccacggagtagttcagagataaagtttagtttaaaatatatatgtggacaagtgactttgcttctccacaaagaaccctgtgtcctcctgggtatgtctattcaggttcttggtcctcttgcagttcctttgttgggagtacttgagtgaattttgcctgtatcagttgtaagtcaaactctatagcatgatggacttggaactagaacacatcagtagataaaccaagaagaaaggaggagcttagaatggcgatgtgatgtaatgaccccagcattccagaggtaaggactgaggtaggactatctcaaggctgaggtcagtctaccctgtctcaaaaaccaacaaacaaaagccccaagcttggcaagatggcttagcaggtaaacaaatgtgcttgcccccaagcctgccagcctgagttcagttgccaggacccacgtggtaaaaggagagagctgatttcttcaagttgtcctctgacttacagatgtgtgacacatatacgtgtgcacacatacactcacacatacatgcatgcaataaaaagttagaaacaccaagccaattaaaaaaagagaaccctggggctggagagatggctcagtggttacaagcactgactgctctaccgaaggtcctgagttcaaatcccagcaacctcatggtggctcacaaccatccgtaatgagatctgacgccctcttctggttcatctgaagacagctacagtgtacttagatataataataaataaatcttttttaaaaagagagaatgataatgtttttttgatccctaaataggataaatagtggtccccatgttaaatgaaatttgggttaaatgagattttatctgagatgaaccaaactgtccctgctacgtgacactcaaatattagtgtgctctctctctctctctctctctctctctctctctctctctctctctctcgctctctctctctccctcgctgtatgtatgtatcgagataaatataaagataaaataagcactctctctcctctcccccccccccaacacgcacacaacatccttactgctatttgattgtgagtatgaccaggaccatgtccctctcccatgtctaaagggactctaagacactgcatatggctctggcaggccttgtccttctccctgatttcctctgccttactaaaaacctaaagttagctaccaggatctattcccttatttggccacttctgcctcctgagactgactaccaaggtctagctatcaaagtattgaagttctacaatcaaaagccccctttggatcacctagttaatattcccaatcaaaatgtaaaatcccatcctaacacagggcttccccttttatctttataaactgccatttccctatgggccatgtttgtctccggactatccaaggagagtcctttggtcaccgtcatctccccactccatgctgggacaaataccccttccccccccttactcctcctccttgcccctcccccttgctccctcttcttgtatctcctgtctttgtccctcctccctgccctctgcctctctggggcaaatcaatctcctttatgtggagaatttggtcttagggtcttgaaccaacttcagctacctataatgcctcttttttttttctttttagtttttcgagacagggtttctctgtagccctggctgtcctggaactcactctgtagaccaggctggcctcgaactcagaaatccacctgcctctgcctcccaagtgctgggattaaaggcgtgcgcaaccacgcctggctacaatgcctctttttaaaaatgtatttattacttttcaagtgtcatgtgtgtatgggcaagcacattccatgacacacttatggaggtcaagggaaaactctgtcgagtcgattttatctctcctcctttacacggattacaacggtcacactcagttgtccggcttgggggctttacccagtgaactacctggtgagctcttcttttaaaacaagcaaaaacatctactatgtgttaaattattgaagataaagatcaaaatctcaaatgatcatgatgtctgcacatcccacctgctctgctcacctttttaagcaagccataggcaagcaacgggccctccatcaggttgttaaaggaccattgtccacttttaaaatggaacagaccaagctggtgagtggattttgtaccatggtccaaaagccagacgaggtgggatcagtagttctggaagattctagatccaggtgtggtgttgtgatgagcaaaccacagtgactaccatgacaaagggagattctacactgaagcactaacagcctggcattcttcaagttaaaggttgtctcagctgtgtgggtagactgtcatgtgtcaggcaggggttggagaggctggcataagctgtcctctctacagggaagtcttctggctcctggttaacagtagagtaccttgttctttctttttaaatacaaggcctcatatatccaaggctggctcataacccctatatagccaagaatgaccttgaatttctgatctccctgccccttctaatcttctaagtgctggcattataagtgtgtgcctctgtacccacttatgtgtgatgctggggactaaaccacatataccaaggcccctgcatgctagactagcactgtaaatccctaccctttggctgaattttcaatggaaaaagacagctgggctggagacccacacagactcagggtggctccttgcacatgacgcttgctgcttcctatgggaaaggttgtgtgtttctttgcacaggtttttactgcagaaatcctagtaggaaacttctttcctggcatggtctcttctcaggggcccagccctttggtggtggtctcttgctgcctttaggtcaaagcaaaatgtagaaatctcatgtgttgctgctgtcacccacgagcagccagaggtgcaaaggaaaaggtaaactcaaaacgttaacctataaaacccatggcaagtcacagggctgggagtgtggtagtgagagagcctgtttgtcatgcttagatcagacagtgacaaacggaggtccttggacccaattggacctcttgcctgcttttgtgtttcctgtacgctaagcaacacttaatttttaaatgggtaaaaagtatgtaatttgtgatatatacaaattacataaagctccagtttcagtattcataactaaggttttactgggagccagccataccctctcatttacataatgcctaaggcagctttggtggatgatggcagtgtggaatggttgaacagagatgacctggataggatgtgccagtgcaatgctggccccttgaaggtggctcataggtgagggctttagaggtagcaagatgctgaaactggatgatgcttcaagaatgccatccaatcaaaagagagagctggtgggacagaagagatggctcagtggttaagagcacttgctgcagaggacctggttggttcctaatattcacatgacgtggctttcaaccatctataactccagctccagggtatcctatatcctttcctggtcttcatggagatcaatacgcaaatagtgtacatatatatgcaggtaacacacttacacattaaaaataaataagtctaaaaaagagagagagagagagatctgaggggtgtggtcaaatcaccaaacatatcctctgaccaggcagatttttttttttttttcgagacagggtttctctgtatagccctgggtgtcctggagctcactttgtagaccaggctggcctcgaactcagaaatccgcctgcccctgcctcccgagtgctgggattaaaggtgtgcgccaccacgcctggctcaggcagatgtttttaatgtgctttggcactagcagacggcccgtgtatgtatctagcttgccttcctgacaccgtttcatcctcggagtgccacatagcaacatgacactgttcttccaagtagggttgctacagagctccacaaaccaagggctaagtaaaaatgactgttctaccagaaggagagagggtgagaggtgaccattcagcttgcttgtttgccaagaagaaaaccaggcctctctattgaggggacaccctgccctgtaacgctatcttccttgactggtctggaatagcagggacacaagtctgagggcttggggatgaccctctcatgggcttggggatgaccctctcatgggcttggggatgaccctcttatgggcttgctggcctagttgtggtttccatcacttggtgctgttgtgtcaattcagatttctatggcagagaccttttgttgccttccattcaaaatgcaaagatcacacggatccttgctctatattggagccactgtagttcacctggacaggtaactaggaatgatctttttttctcttctcttttcttctcttttctcctcttttcttctcttttctcctcttctcttctcttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatcaaagtgctgggatccagtttcaacaaccccttgtcttctaaatgaggatgaaagccgatcaagccctcagttcttattttac

SEQ ID NO: 1130 - DNA, 1978 bp, Mus musculus
tcagaacggtcaccacaccggcccatcctccaagctggactgcctgcaaatgcctccacggtggtcggaggggatgtggagtttgtctgcaaggtttacagcgatgcccagccccacatccagtggatcaagcacgtggaaaagaacggcagtaaatacgggcctgatgggctgccctacctcaaggtcctgaaggccgccggtgttaacaccacggacaaagagattgaggttctctatattcggaatgtaacttttgaggatgctggggaatatacgtgcttggcgggtaattctatcgggatatcctttcactctgcatggttgacagttctgccagcgcctgtgagagagaaggagatcacggcttccccagattatctggagatagctatttactgcataggggtcttcttaatcgcctgcatggtggtgacagtcatcttttgccgaatgaagaccacgaccaagaagccagacttcagcagccagccagctgtgcacaagctgaccaagcgcatccccctgcggagacaggtaacagaaagtttcggccgagtccagctcctccatgaactccaacaccccgctggtgaggataacaacgcgtctgtcctcaacagcggacaccccgatgctagcaggggtctccgagtatgagttgccagaggatccaaagtgggaattccccagagataagctgacgctgggcaaacccctgggggaaggttgcttcgggcaagtagtcatggctgaagcagtgggaatcgataaagacaaacccaaggaggcggtcaccgtggcagtgaagatgttgaaagatgatgccacagagaaggacctgtctgatctggtatcagagatggagatgatgaagatgattgggaaacataagaacattatcaacctcctgggggcctgcacgcaggatggacctctctacgtcatagttgaatatgcatcgaaaggcaacctccgggaatacctccgagcccggaggccacctggcatggagtactcctatgacattaaccgtgtccccgaggagcagatgaccttcaaggacttggtgtcctgcacctaccagctggctagaggcatggagtacttggcttcccaaaaatgtatccatcgagatttggctgccagaaacgtgttggtaacagaaaacaatgtgatgaagatagcagactttggcctggccagggatatcaacaacatagactactataaaaagaccacaaatgggcgacttccagtcaagtggatggctcctgaagccctttttgatagagtttacactcatcagagcgatgtctggtccttcggggtgttaatgtgggagatctttactttagggggctcaccctacccagggattcccgtggaggaactttttaagctgctcaaagagggacacaggatggacaagcccaccaactgcaccaatgaactgtacatgatgatgagggattgctggcatgctgtaccctcacagagacccacattcaagcagttggtcgaagacttggatcgaattctgactctcacaaccaatgaggaatacttggatctcacccagcctctcgaacagtattctcctagttaccccgacacaaggagctcttgttcttcaggggacgattctgtgttttctccagaccccatgccttatgaaccctgtctgcctcagtatccacacataaacggcagtgttaaaacatgagtgaatgtgtcttcctgtccccaaacaggacagcaccaggaacctacttacactgagcagagaggctgtgcctccagagcctgtgacacgcctccacttgtatatatggatcagaggagtaaatagtgggaagcatatttgtcacgtgtgtaaagatttatacagttggaaacatgttacctaaccaggaaaggaagactgtttcctgataagtggacagccgcaagccaccatgccaccctctctgaccca

SEQ ID NO: 1131 - protein, 394 aa, Mus musculus
QKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPTNCTNELYMMMRDCWHAVPSQRPTFKQLVEDLDRILTLTTNEEYLDLTQPLEQYSPSYPDTRSSCSSGDDSVFSPDPMPYEPCLPQYPHINGSVKT

SEQ ID NO: 1132 - DNA, 126266 bp, Homo sapiens
  misc_feature (1)...(126266): n = A,T,C or G
acacactatgagaaagtttaatttctaaattaggcacagtaaagtattaataataggccaggcacggcggctcatgcctgtaatcccagcactttgggaggctgaggcgggtggatcagtcaaggtcaggagtttgagaccagcctggccaacatggtgaaaccccgtctctgctaaaaatacaaaaattagccgggcgtggtggcaggcacctgtaatcccaggtacttggggggctgagacaggaaaatctcttgaacccgggaggtggaggttgcagtgagccgagatggcgccactgcacttcagcctgggtgacagggcgagactctgtctcaaaaaaaaaaaaaagtattaataataataaactaattaaaaaaggacagttataataaaagttatatgaatatggtctctcaattaaaatatcttattgtactatgctcacctattttcagactgcagctgaactcaggtaactgagggtaactgaaaccatggcaaaggaaactgcatatcagggtggactactgtgtatggatagtaatcctcaagagacttgctcgtgtgtcaaagtttctccaaaccatgaggaccacctgaataaaaatgtctaagcgaggctgggcatggtggctcacgcctgtaatctcagtgctttgggaggctaaggagggaggatcacttgaggccaggagtttgagaccagcctgggcaacataatgagacccctgtctctacaaaaaatacaaaaattagctgggcatggtggtgcatgcctatagtcccagctactcaggaggctgaggtgggaagcttgtgtgagctcaggagttggaggctgcagtgagctgtgattgtgccactgccctccagtctgggtgacagagaaagatcctgtctcaaaaaaccgaaccaaaccaaaacaaaaacaattaagtgccgggtgcggtggctcacgcctgtaatcccagcactttgggaggcaggtggatcacttggtgaaatgccatctctactaaaaatataaaaaaattagccgggcgtggtggcaggcgcttgtagtcccagctacttgggaggctgaggcaggagaatcacttgaacccaggaggcagaggttgtagtgagccaagatcacgctactgcactctggatgacagagcaagactccatctcaaaaaaaaccaaaaaacaaaaacaaaaacaaagacaaaaacaaaacaaccaaaaaaacccgaacaaataaaaaaacaaaaacaaagaaaaactaagtgcttgtcacgtcctaactcatttcatcctcttagtgatcctattaaagatctaggagaggccgggtgcggtggctcacgcctgtaatcccagcactttgggaggccgaggcgggtggatcacgaggtcagcagttcaagaccagcttggccaagatggtgaaaccccatctctactaaaaatacaaaaaattagctgggcgcggtggcaggcacctgtagtcccagctactcaggaggctgaggaaggagaatcatttgaaccctgagggtggaggttgcagtgagccgagatcgtgccactgcattccagcctgggtgacagagtgaaactctgtctcaaaaaaaaaaaagaaaaaaaaaatccaggaaataagaaccattattttccccattttacagctgagaaaatggaaaactcagataactcaagcaactggcctgaggtcacacagcgtttgtttgtttgtttgttttttttgagacggagtttctctcttgttacccaggcgggagtgcaatggcacgatctcggctcaccgcaacctctgcctcctaggttcaagtgattctcccggctcagcctcctgagtagctgagattacaggcatgtacgaccatgcccagctaattttgtatttttagtagagacggggtttctccatgttggtcaggctggtcttgaactcctgacctcaggtgatccacttgcctcggcctcccaaagtgctgggattacaggtgtgagccaccatgccaggcctttttttgttgttttttgagagggaatcttgctctgtcacccaggctggagtgcagtggggcgatctcagctcactgcaacctctgcctcccgggttcaagcgattcacatgccttagcttccagagtatgtgggattacaggcatgcgccaccacaagcggccaatttttgtgtttttagtggagacggcatttcaccatgttggtcagcctggtctcgacttcctgccttcaagtgatccgcctgcctcggcctcccaaagtgctggaattacaggcgtgagccactgcgcccggccacaggtcacaaagctattgagtaaagaaagctgcatccagcctctcaccttaagaaagccattcccctttgcctcaaagtgaggctatacttccagaaggactttgtctccggggaagccttggctttggaattcaggcccagttctaagtttaaaatcattgatgctgttcagtagtgggatcaatgattttgcttcacttaaatgccacaagctccctgaagatgggctggagctgtcagggcatccagcccctccccttacccagaagtaaatactcttatcatagtcctccgactattctatatccttccatttgagtgcttcttttatgccgagggcactattgagatgtagcttagagaatgaaattcctggtgttgcagggagctcagatccacccgggaaggttcatgagcacttcatgtcagcagcctttatttcatctaacgtttccatagagtgaaggaacagccacccattacaaaacaaattattaaaagaaaaattccaaatcttcaaaggagagaggcccatggtagtgagcgctcccacccccttctcctttctcttcccatcaccaacgggctagcagcacaatttgtttcttgaaacttttgggggcatcggagttctggtgtcctcatttttcttccttcccattgatgtatcattactagagtgaaaaaagaagggcgtctcgagggcttttgaaaaaaaaaaagggtgactactcaagacattttgtaaaggggggaaaattgcgaagaaaagagacctcagtagggggtggaggaactgtgaatgtgtccttgtctggcggttctttcagctgaaacctggtgctggcgttcgcagttcagttcaaactgtcacctttagttcttactggcttttctgcccttgccccagaacctcaacagattggggcttatttacctattcacactccgccgtggaagctcattaataggctttattagcaacaccattcatgggaggccattgacgaaaggggttccagccacttgaagagggaagagaaaagaaaaaactgtaaagagattattttctcattcagaagcctcagtggtgtgaaggttttcctggatggtctgaggtcacttgaagactaaatatggggacataattgattttttaaaaataattctaaacatacttccccccctccccaaaactgaagagtttcctgttgtggtcttgtgggtttcagtcccttatatatgagccctctttagggaataaggagcttttgatagattggtgtcttttcatttctataaaaaatacattctgcaaactgtgcctggacatgaaagtaggtgttcttatttgtcattttcagcggaaagcttcctttccattcaacatgcataaagctattgatgaatgggggatagggacagcggcttcctgcaccattaatttatgtgagaatgtgttaacagcattttcaatggctgatggatgcggtgtaggatgggaaaggaactgtcctgagacactcgagtttcccattggtggggaatataaagatgtaagtggcagcctgcgagcaggcagacacgttcagctgcatcccttttctgagaacttgaaaacatactgctatcagaacaacccgtgtgggagtgaatggctaagtgtcaacctgggctgaggtgtccgttaatgtataggctctggggctaatccaggttagaggacttgaccaaaaacataccctcccaccaagcatatagagggataattttgcttaagaaccagtttttattttgttgctatcaaatttccaaaatacaatgttatagccttttgcctgaggcagttaaatggatttcttacttgtgtggcttttaaataacttgcataaacgttttctgtgctatatttgtgaataaaaatgattttctaatcatgtagcaccttgaaaaatatttttgtaaatgttatgaagggtgcaatgttagtgacacaggtgcaaatatgtttctaaatccaggaaaagtctgttttccaagtcaggtttgttctcaatgcttcatctatcttcaggcctcaaaaggattctaaagcatttctgggtttagtgaccttttctaaagaaaaataattaaggttttaatctatatggtcttgaacttaagcacggctgctcaggagctggatgaataaggagggagaaaaagcatatttaaaataaattattccgaagacacggcttagtgaaaaggtaaatggacataggaactttaaccagttacagcttggtgtgcagttgaagaatcagattttgcatttatgatttttaatctaagattcagagggaggaattactttgttcaaggtctatttatggtagagttgtctttagactcctttgaatttctttttattaatccaaacatatattattaaacactttttttttttgatgcaattttggctttttctgagagagccacattcaaagtcaggctgtcctagtagccagctgtgtggtcctaggcaaattacttaacctctctgatcctgtttccttatcagaaactgggaatagtactctgcagggtggttgggcagatgaaatagaatcacctatgtagtgtgaccctcccatagtagggcctccattaatattcagttttttcctctcatttctattgtttagaaggacagaaacatgcaatgtcctgcgaacatttccaagtggcttcctctcctccaaaagcttcagctgcctggcaaccctccccgcagtatcaagcaggcgcattttaaagtctctttagcgggagggcagggttagagccttcggtcacttgttttctaacttgacataaaacaacgtaacgcagtcgctcagcgagccgttggccagcctcgctcgcccggggaggagggaggaggtggcgcggggcgcgggaccaggccttattcggaggctgtcgctgcatccctacggccgcatcgcggccgagccctcgcctcccgggccggtgtctccggctgctcggaaggcgtcgggagccgcgcgggactcggggcggcccgggcgcgcggcgctgattggcagagagggcgccgccgtccaggaaacggctcgggtttcagtgggggcgtgacccaccgcgagaaggcgggggcggcggcggcggcgcgggcggcggctggaggagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccacaaccccgggctcgtcgctttctccatcccgacccacgcggggcgcggggacaacacaggtcgcggagtagcgttgccattcaaggtaatcgccgcgcaagacgcctcggggagcttcgccagccggggacgtgggcgccacgggagcccgggacgccgggtgcaccgtcctccgggcggggggcgcggaaggactagcattgtggaggacgctccgtgtcctccctctgtggctgcataggtgatgggggaggtgggtgcgtgctgacggccggcgttctggaagttctgcctctgctacccccatccagatgctgacatctgcttctggcgttgacgcccccctccctgtcaaaccctggcgggcgcattcccgctgactgggcgcgtttctccgaccccagagcagacgggcggaaggttcgcctgcccgtggcacagccccgcaggccggttcccggggtcatctccgaggtgccccatccgtgtgtcctgggaacttccgtaccatccaggccctgcggagacccctttttcgggagggggccgctggggtggggccggtgacatcccgtaggggtggcgatggccaggggtggcactgctggggaggcgacggctccggtgcctgggcgcccctcgcccgcagccgccgtcggcgctggagggagcgcagtgcgcctggggctagggggcgaactggaccgactttttctagttcgcctgcctgctctgccgcagcggctgggagatgtcgaaagcgcaggcgagttctaacttgcgcgctcatttttttcggccacggggccgcgctggggaaaaaagccgagggccctgcgtggcgctggctccgaccctcgcggaccacggacctggcgcaggaggcccgctcggggaccaccagcctccgtcgctctcctcgcaccccgctcccttgcagaccgttctccagaccctccttcctttctcccaattcaataaaacctacccttaaaggcaaacctgctttcaaactcagggcacccattatgtgtttggtgtgaaacgctatcaacatttaaaactccattgtctccctggtcccaaatccctgtaaatcttccaccgggctcgactcattttcatctgaaaagcctgtttagtttgaatagaaaagcaatcaggcgcccctctctctttccctggaatgtcaattaaaatgcagatttctctgagctctttagcgccccgagaagggggagaaaaacaggatatttcaggcaaacaaatgaaagaagtgctgccctgaaagggggtggtggtggggagcacccccaagctgctcgcaagttctgattggacgcaagcattaaaccgggagggcattgtggtcctgggtcagtgtgagttttttgagatttcaatttgttgaggaatttccccctagccttgaccccttgacagctcccgctcctactcagtgctggggagaagtagggaggccttaagcgaagagatgggtctgcactttggaggagccggacactgttgactttcctgatgtgaaatctacccaggaacaaaacaccaggtgatcccagtggccgagccagcagtggacagatcaccccttaggtggaagcccaaagcggagggcactgtattggtctgccttcttggagggcgggggttttgggaatgtcatggtaaattgaagagcccagcacaggcctggcatggggaccgctccgcagccaagcccttcctgcttgtcactctgcctgtctttgggggcaggcttgtgccgaggtgaaaatggaccggggggcgggcggccgagaagagccatccatcagagggagggtgacaactcctcccgcgtgcaggctgagaagagagttccctttcaaggggaaaaataaacacgctggggctttcactggggctcagactccaggaaggattatggtattgaaggcaggaagccgggattgtggccgccagcggcatgctgggcctgtattcccaacaccgagcctggggacctaattatcctgcctaggaggtcgcaccatacttttgtccactggtgtgaggaactgtgcagacctgtcgccttaggtctccgccttccagagttttggggagggggctgccgtggggtttggacctggaaatggctgaaatgcaaatttctagtgccagctagcgggatgatggaacggcttgagattcagcggagcgccctgtccacctttctctgcctggagccaaggaggctcctctgggcagggacaggtgggcgagcaggccggggaaggagcctggggtgaaacctctgcgaggacttaggattgttcctgaagtcgtgttagaggtagaaaattcccctgcattctgcaaatgcttagtaaatcaatgagaatgtttgtgtactttcctcccacatgtatgtagaaatagatccgaaattatcttctgaggctcttgactaagaggaaagaaaagttaagaggaaaaatctttcaagctatctgaaagcacatgcacacaccgtgcacgcacacaccatgtacacacacacaccgtgcatacacacacaccatgcacgcacacacaccgtgtacacacacacacactgcacacatacttttcttgcttttgctgtgaatcacaccgtttcacctgtgctatctttgaagcagaggttttctttattcctcctttggaaatgatgtggcatattcttttccctcctccatttttgtcctcagtcaaagctaaaaggagcagtttttatgatgagatttggggaggctccagcagtgttgaaatcctatgacataacttgaaacatcgagtgggtacataaaaaatgtagagtttagagatttttgtattaaaggcctccctgccacccccagtcttagaaaatgtggttcattcctgtggttcacagaatctgaagcctgagattgatgagccccttcttgtgattgttttaatcattctctaaagtttgtgcattttactgtacccttagtcacagagagtactgagtgaatttaaagttgcttggaatatattaagctttcttggaaaattctctttcccttggatcaaatgggtgaacagaatattaagttgagtgtcctcttctaacttatactctgaaaatttagccagtaggtttgcatatggaaagttattggtccaatcacataccatgactataatttacataatttacatcatcattattaataaattcctgcattattcatcagaatttgcatctgctcagtttcctcacccttctacagaggttgaagacatttagcagccctggactgccatttagtcacaggggaagggaattcaggcttcgaagtcctttttggatcagctgcgttgaatgcgctgcagttgtgttcactcttcgtaagtggctgcttggcggaagactgaaagacacttctccatttgaaaatgaatcctgacaagtgtaaactggtgggaattttctgtagccttcctgggattcttttgattttgctggtctcctttcttcccaagagcgacagtgagggtgggagactgctcacctccagcccagcagaaatacggagctgtgagcagactcctccaacagtttagctttctaaagcccagttggactaagagaagggaacgaggttggttatgccaacccaagcatttttaacttgcttttgtagttgcccttgaaactaaggtcacgttgcttctgctcattgagggcggtggaggcgatagtggatagtagaagagagcacacattgcctcactgaagtggctgcacgtatctgagtcctgtagctactgttttatctctgtttcttaaaagtatgcttttaaaaagattagcctcacacatttctgtggaccggtctggtggtatcacctgggactctgaggtgaggatggaaggatttagcagataatgaaaaagaactctgtttgcgcacatttgagaggctgaaaaatggttttatcccacttgggctggagtgatttggcattggggaagattccctgactcgccaatctctttcctttagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggtaagtcatttaatttcacttttcaggtttgttttgggatttgtctgggggcagattgttaaggcctgttttagaatcagctacccttgcattgtaaatggggcttctaagagcaccagatcgtggtctcttggctcccggcaaggcagagctgatgagagaaggtcctttgccgcagcactgcaggcaggatggtatagtttggtggtttcttgctgtgtgtgtttctctgtgctgggtgagggagacagctgggagttggcctttatccagtgcccgagagagctgtggaagggatgaaccttgggaggatgaatgtcatctctagtctcccccagcatcattcctactgcttacaatgtaaagaattgctattttcggacaagatgaaccactaaaagaaattgccaacatctgaaatgctgacatcttattttcattgtttaaggagaaaagaagtttctgaagtttagcacagagagagaggcttgacatctcagaatttttttttagccattgtaattcataatacttaagcaatgcatcatcacagagtggcagattctagtttaggtaaacttgaaagtgaatgtgccaggggatctcctccagctccgagaacctccaagtatcacagggcatgcgccggtgtcacagctttggaaatttaattttcaaggtgtaagtccaattacgaggactacatgaggctgaattattcagcttagcagatttggaacctctctcccagccctttggagacaacgtgagccaagcctctacttggtgctgcactgaaatctgtcatcagtagggaatattggtagctgagttatttttcgagtggtaatccgagaataaaacggcagatcccagcactcatcgccacttaatgaacctgtttgcggagagtccacctggtgcctgcctggctttaggaacccgcagcagtccgagtggtgtctggggtaagctgagctgctctgggaacacatctcgtgcgtggggtgaatgaacagcacacttacccagtggggtaggctgggagaggacagagagcccagcctccttagctggatcaggacagtttaggaaggagggttgcgtccatctgagatgagagttctgagagacatgggctccccaggaagaccccaggcacttgtcattgaaggatgaggaccgaagcacttatcacctgaagcaatcgtgtgagactggggaacttttcgttacacagagggatggcagctctataattaacaggtgtggtgacatctccctacgtctctgggaagggaatctggtaggagtttgtgtctgaggcttgtatagctacagctacaggccgattatggaactgcctcttggtgatttgtgctgggacaccaggatgagtgtaatttgcagtggtgatgcatttttacagggctttcatgtaagagggaaaaagttcctggtttctgaaagtcatgcctgtacgtctttaattttgctaataattaaaatggatgtttccgtgattgctggttttcccttgagtgcgtggctcggcaaaaactgaggaagctgagctgggatttcctacggtgtgggctttaggagcaacccaggttagggaaaaactgtcatttttcattttggcttttcagggcagcgttattgtgagtttatttcaacataaagtgtaaaatggtcccagaggatttgttttactgtatttaattcttgaaggaagtttaaaattgtgtatacatgcagggagggacaggtgaggcagagggaagaaatcgtggaaagggacgaagttccccgagtgagtctttgtgtaagaatttacatccaacaatgtgggtattgttggaagcaggcctgctcaacctgggatctgtggatgcgcttatggatcaggaaggaggttgatgaagttctggaaattttaggtaatattttgttaatgtccttttgtgcatttttatgggtttatagtttccatgagctatgagttcatttgcatccagaattatgagatggaaaagaaaagatgtcttagaggaaggtgcaaaacctggcaaagaagaggctttggaaaagtatacaagtcccaggcctcagtttccctttctgtcgtctgagggcttaagaagatgatctttagggtctcttcattaatagtcattgaatattaatgtcctcagaagtcttctgactcttccaccaaaaggttgttaggagatttccatttgacctggacataaagagcaattagcacaggggctggcatccagtaagcaccgggtgcatggccttgtcgccgttgtcgccagggagctgggaacatgggtcttcccagtcccgtgggctggctgtgccaggtgccacaatgtcaaaaaacatctaggcttttggagacagttgagaagaaagttgtttttggatggaggaggcccttggtgtttccaggaagctgtgtttgctttctgtagggtccccacttcccctcatctgttagtctaatactggccactgatttgagccctaagaccagttcttctgttgcaggagttcgctttggtgtcagaggtgattaggaaggtcattgaattatagatgagaaaggagtttttaacagctgaaaatgggctcaggtttaggctctgtgctggtgaattggaagagagagagagagagagagagtgtgcgtgtgtgtgtgtgtgtgcgcgagtgcgcgtgcgtgcgtgcgtgcctgtgcccctgtccatcagttctccatgattagaactactatagctttggttagcagtaagttccaccttgaccttctgtgcaccaaggtcttatcttgtaagactttttggtttgctaatttatttggaagctcagtttagataatgtctattggataggagaaaaatgtgactgagaagttccaggaagaagcctgggccctaacactagagggtccttttcttttggcccctcagggaaaggttatgtttagtcatcgtggctttgtgcaatatcgtatcatatcatatgtcatatcatatatcatatatatcatttgtcttctggacacgttctgaaatagtagcagtggggttgggcccactcaattgacttaagaaaataatctctagaagattttagtttttaatatttcagattaaatatgagttttccagttggtcattcattgttaatttccttttggtcattcattgttatagggcaccagcagaggagtgaaaacatggttattgactcgaaggggggcagtcctcaatgccaagtactattctgttgattaacattataaatatttgaagtctagtcaagcttgattaccctgagagggggcaactcttactttcaagttcttcctgacattgtcacctactctggttaattaagtcattgttgacattaatggcatctttgtttacaccaacccagtaggagctaaaatgaaagggcttttcaaccctacacccttaattactttcccaccctccacagagtgtgactctgaaaagtaacaacctgaaaaaaaatgtagtttgtgtagcaattttttgtcaatcttctgagaggtgatgctctcctggaccaacgtgagttggtccagagttcagtagcagaaacgtcgaggacaggatctacacagagacctccctaagtcagatttttccagtatggtttaagtcctttgttagaagtattgtaaatgccataatattaaccatacgcatttaattgcaagttaaaagaaaggaagaaagaatatatccgcataccaagagtgaatgatttaaaataatcttctgtttcgtattatctgcatctttgtttttcaatatgagtgttaatatttaagagttgactgtaacttgatagttagctttggaacaaggacttattcttggtcaattaaaccaaatacaggcttacgcagttaaatacacaatgaagtacacattctttattagtatataaagtgtttcacaattcatagaccaagagccatgtttaatattacttatagagcagaaatctggcaagcccagagaactggtacttgtatcattttatactggctctctctgattcaaatttggggtatatgtgtgtgtttctgttttgtctgtttatttcaaccagttaaaagacagagcacttactatgccaatggccccgcatcaagccataagtaaagactttattcctttcaagtctttctgacccagttgagggtgagaattcacaaaaccacagcaatccaatatgagatgtttttaatatcagacttaacaaataattgcatggctatgaaataactggggtcgtgtttaaactggaagtgttttgtttaatgttcgtagtttcaataaaatgtatccactagtcttccagtttgcagactgttgtttaggtgtttgtttagccagggtaattgttaaaaactccctctaatctagcttacccttacatttccatggaagcgaattttagtcattaaaggaaaacatgggaaattgatttttgggtgcctggctgttacgctaggtaggaaatatagctggtgtgctactctccactgtactggtccgattctcgccagggggacatctctgtaggcagttcagaaattattttttggaagttttttaggctattccacagataattctgatccagtaggttttatgcaactgtgcaaaatgcttatggtctctatttttttttccttgagagatgattttagcctttggttttttgtttgtttttgttttttgagacagagtcttgatctgccacccaggctggagtacaatggtgcaattgtaccctcactgcattgtcaaacgtggctcactgtaccctcggactcctgggctgaaggggtcctccaacctcctgagtagctgggactacaggcctggataatttttaaaaatatttcgtagatatggggtttcgccatgttgctcaggctggtctccaactcctggcagccttggcctcccaaagtgctgggattacaagtgtgagccaccacacctgtcctagccttaagttttgcatttttttccatctttttgctgtatcccatatgatttagagatttttgctgtatcccatgagatttagagatggctctactttttttagctttcctagcattgaaatgcttggtgttgctaatcataccccatctttaccacaccatcttcctccctgacttgccttcttagtgtagtttggtcaagaacttgaggccaagttcttttttttttaaatttagcttttattttaggtttgggggtacatgtgaaggtttgttatgtaggtaaactcgtgtcatgggggttcattgtacagattgtttcatcacccaggtattaagcccagtacccaatagctattttttctgctcctctctctcctcccacccaccctccaccctcaagtagacctcagtgtctgttgttcttttctttgtgttcatgagttttcatcatttagctcccacttataaatgagaatatgcagtatttggttttccgtatttggtttattgctaaggataatggcctctagctccatccatgttcttgcaaaagacatgatcttgctcttttttatggctgcatagtattctatgttgtatatgtactacattttctttatccaatctgttactgatgagcatttaggtagattccatgtctttgctattgtgaatagtgctgcaatgaacatttgtgtgcatgtgtctttatggtagaatgatttatattcctctgggtatatacccagtaatgggattgctgggtcgaatggtagttctgcttttacctctttgagtaatcgccacacggctttccacaattattgggctaatttgcactcctactaacagtatataagtgtttccttttctctgcaatctcaccagcatctattattttttgacgttttattaatagccattctgacttgtgtgagatggtatctcatcgtggttttgatttgcatttctctagtgatgagctttttttttcatatgctggtgggacgtatatatgtcttcttttgaaaagtgtctatgtcctttgtctactttttatgtggttatttgtttttctcttgtaaatttaagttccttatagatgctggacattagatctttgttagatgcatagtttacaaatattttatcccattacgtaggttgtctatttactctgttgatagtttcttttgctgtgcagaagctcttaagtttaattagatcccatttgtcaatttttgcttttgttgcaattgcttttgatgtctttgtcatgaaatctttgcccattcctatgtccaggatggtatattgcctaagttgtcttccggggttttatagttttggatttgacatttaagtctttcttccatcttgaggtgattttttgtatatggtataaggaaggggtcagcttcaatcttctgcatgtggctagccagttatcccagcaccatttattgaatagggagtcttttccccattgcttgttttcatcagttttgtcgaagatcagatggtcgtaggtgtgcggtaggtgtgtggccttatttctgggctctctattctgttccattggtctacgtgcctgtttttataccagtaccatgctgttttggttaccgtagccccacagtatagtttgaagtcaggtaatgtgatgcccccagctttgttatttttgcttaggattgccttggctattcagaggctaagttcttttaaggagaggtctgattgaacaagatgctggacaggtcattgtggtgatccttcacgtcttgaagatgtctccttctgtaatagacaaaagtcacactttttacaagtttctctttcctcactgtgatttgtatgtggtagctgacttctatttatataacttcaagctcttaccatttaaatatttatacacaagtatgaatcattgggacaagccatggccatccttgaagagtgtgtgtcaagtaaaataggcgtgctttagattttcagtaattttggttttgggaaaccggtaccatggaagagttttcagatgctgaatgtgtaatttactccactttggaatactgtaagtaattctgcgccattgtggactttggccacatcatgccactctcaaaaacttctgattctttttgacagtaccaagtcagggggctaagctgttgtatattctttcctttaaccccttgtctaactaaagaatggtaaattccaattcatttcagaatggaatgcacacatatagagtttcaggttatgctgaatgtgttttatgaggaggctaaaaatagcttataaggaaaatgctgatagattcaagaacgagaacaagggatgtatttatttgtatgatttatgtagcgcctttcttggagaggactcaattctgagctctaacgttaataaactctatatcaattatcgtgattattttcgaacccttgagctcctatattactatatgtgacccatttgtatacctgacagtttactgttaaattttccatagtgaccagttgtaatattttaaaagtatccagacattgaaaaggccaactgtgtgtatctatggtgtgtgtatgtgctcaggggggtgtactataaaatgaatgtcaagatcattgcaatggttaagtttaggttttaaactctttgaacacccttaaagttcagattttcagttgacagtgggattgcccccaaagatgtgtggctgccttaaggagccttcttgtcctgctaagcctcctggatttccaccaatgcatgttgcatttctacctggctgcaatagacgcacaactgaatatatatcgtggacatttataaatgtttcaaatttaaaaccactcaaatttttaaaagaacaagaatcttctgtgcatttaatctaaattctgtatcagccattcttaaaaatagaattgaataaaatcattttggatggcatgtggtatgctttctggagacataaactaacagagggaacttgaccttgggaggtaggtttgaatctctctactatctactgatgctgtgatttcagaaaagttagataacctctctgagcctcagagatagtatctatcttgaagggtgaatgtgcagattaaatgcaaatgaaatgtaaagcccctactgaatttcctggcccagagtaggtgttcattaaatgctgatttcttccctgtcccacttcctgtcaacatttcctggaccaacaagatgtttactctacaatattaccaatatttcctggaccaataagatgtttactctacagtgtatagtgataattgtctgatgagaagcatttacattaattaaaatgtaaaactggctctaggccctggatttgtccaaccctttttattatcttgggcttttgcaagtcccatggattttagaaatgggatcatcctgctgcttgcagtccaaatggttcaaggttgaaattttttttcccctctgttgaaaaaagtcagttgcagctctgtaataataacagcagacacatacttcatgaggaacaatgtattttggcaaaagagttttctgtttgaagcttcaaaatacaaaatactctgccacattgccattaggcccggtgaagaacattggagaggggttatggaatcggttggggtggggtgcgggatggagaggggttatgggatcggttggggtggtgcgggatggagaggggttatgggatcgtttggggtggggtgcgggatggagagggttatgggatcggttggggtggggtgcgggatggagaggggttatgggatcggttggggtggtgcgggatggagagggttatgggatcgtttggggtggggtgcgggatggagaggggttatgggatcagttggggtggggtgtgggatggagaggggttatgggattggttggggtggggtgcgggatggagaggggttatgggatcggttggggtggggtgtgggatggagaggggttatgggatcggttggggtggggtgcgggatggagaggggttatgggatcggttggggtggtgcgggatggagaggggttatgggatcgtttggggtggggtgtgggatggagaggggttatgggatctcttcgggtggggtgcgggatggagaggggttatggcatcggttggggtggggtgcgggatggagaggggttatgggatcggttggggtggggtgtgggatggagaggggttatgggataggttggggtggggtgcgggatggagaggggttatgggattggttggggtggggtgcggtgtggtgtgttctgcttttggccaggctggagaggtgagctccataacatggtatggtcatccttgccatgtttgcctgtagtgacctcccctgaacactcctagatgagatttttgtctgcatggaagggagctcaaggaaattgtgatgggacccacagtactgaagtggacaggagctgaacaagcatttgcacatgatacccctatggaggttacttggtaggacaggctatgaagtaggggcagtatggatgaggtcacgtttctttagcccattccttgagatgatgatgatgatgatggtgatgatgataactggctaccatttattgagtgcctgtcatggttggactctgtgctaggtactttaacatatattatctctcatcttaataacccagaacatcttgggttttcctgttcttattttatggacaaggtaactgaaattcttggggatcaagtgactcctccaggacctcatcattagtgagtgtgggcccaggtctttgggtgaatgtgttggtgtaagaaaaatttcccttcttcctgagcaggaggattttttttttttgctggagaatgtggtgacccctcattctttcctaaatctgtcgtttgactattaaacctgttagggacactgctggttgattctgtttctttctcacacatccataccgaattctcctaaagacatttgaagaaaaattccagacaataaaaatgtttaatgattatactttgtgattcttctagaatggcttctggtggcatgtgacttattggaaagaggctaaccctgactgctgccaaggagaccaatgggagactgggtcccagttggtggtccaggctgcgccacaccgtaggagtccataacaagaagggctggcctctgttgcccgttgatgcatgagccatctcagcagagcaggccgtccccagttattccttgtcccagatgcctctgctggtttgtcctagtgcctgctaaccctcagctgttgccacttggatattatgtcaagcttttcttcccagaatttctgatttacgactgggtatgaagtcaaggcctacctgcatagacagacccctgtacttgggactcccacgaactgtggtcatggaaacaagcaccaaggactacctgacccttctaatgtcacttttctgcagagattaggaggagagactaagaaagccaaaaaagaaaaaattccaagaatgaaaaggccaaaagcagaaacacctactcttcttccagtcttggccagaaagggtgtccttaggggaaaaaaagaggccagggaatggagcccatttttaaagcaagcaaagatcagtttggtatttaaaaataaaaagtgaactccagtaccagctaatgtgtaggtgaatcgaggctggtttaggcagctgaactttgttcttggctacctgtacagcagttgcagaacactcaggggttccaggcatttccaagtgggagttgagttttggaggaaagttgtagaattcctttttcttttttttctttttttgtgagacagagtctcttgctctgtcacccaggctggagtgcagtggtgcgatcttggatcactgcaacctctgcctcgcgggttcaagcgattctcctgcctcagcgtctagagtagctgggattacagatgtgcaccaccacgcccggctaattgtatttttagtagagctggggtttcaccatgttggtctcgaactcttgacctcgggtgatccacccacctcagcctcccaaagtgctgggattacaggtgtgaaccaccgcacctggccgtagagttcttgactaggagatgctgcaaatttccctcttaaatttgcagctccccgtgcgatgacaactttcagagcttggcagaggcaagatggtataaacatgatttttagattgcagggtaattgctgtggtttctttgagttttttcatccatttgctccccaaataatttttgagacctactatgtgccaggttctgtggggatggaatagcaagcaatgaacagttgagtgggggagacaggctcttgtcaaataattgcaaaaatgaagggctaggactgggtgcagtggctcacgcctgtaatcccagcactttgaggggccgaggtgggcggatcatgaggtgaggagtttgagactagcctggccaacatggtgaaacgtggtctctactaaaaatacaaaaattagccgggggtggtggcaggcacctgtagtcccaggtacttggggggcggaggcaggagaatctttgaacctgggaggcagaggtttcagtaagctgagatcacgccattgcattccagcctgggcgacagggtgagactctgtctcaaaaataaaaaaaaaaatcaaaataaataaacaaaaataaaaaatgaagggctaggtccagtcaaaggtgaagattctgtgaaggaaaagcatgggccggaggcatgtgccccatgtttaggagttcccagggactgggactatgaagctgctgctgctgctgcttttttttttttttttttttttttaaatgcagggtctctctctgttcactgtgtcacccaggctggagtgcagtggtgcaatcacagctcattgcatcctggacctcctgggctcaagcggtcttcccaccttagccttctgagtagctgcgactataggcgcaggctgatttttcttttttctttctttttttctttttttttttttttggtagagatgggttctcacttgttgcccagcctggtctcaaactcctgggctcaagcgatcctcccaccttggcctcccagagtgctgggatcacaggtgttagccaccacacctgaggctggtcttccccttaaggaggtggcacccacctggattccccagcaaacccacctgcattgcaaggttgacccttatcagtaccagccaccttgcctgctaggttgacccttgtccagtgaggtgattttccagggcctagcctctctgctgtcccttgctggcttcacctgttgatgttgatggaggtggagcagaggccgttgagtgaatgcgtgcagctgggctcagaggcccctcttctcccctcctgtgaggtgcttgcccttgaaggtgtggcgagtgaggaggccggtcaagggcatcctggcggcctccaggccgtatttgagtgggtcgtttcagcctgcttcctatctcttttctgttactacctctaattggcagagtttcttgccaggtcaatgtggaggcagagagatggccggagggcggccaggggagtcaggccaggtgtgggcaggatgggattctgcctcctcccaggtgcctcgcctgggggatgccctgtcccagaaagcctacattcgtgggagccggcgcacagcccttctgagatctaaagcttccctctgaatgctgctttggaggattgtgagaggtagtgactcttcaaagtttgtttgttttcttgaagcttttacctctatgcaaatatgcggtttggagcagggaagaaaggttaactgtgatggcgccggctcttaacgtggaatgtcctgaattaatgtgggtttcagtcctctggctcaggatcccctgagggagagtttttctttcctctgcaaaacacaggagaaaagtgatccctgtggctccgacctgccttccttgggtcctgcggtgcaaaaccagctgggaccgtgtcccgcccacccgaaggcagtgtggggaacctttcctccaggtcattcccattcagctgattgctgccggctccccaggccacaactctgtgccttcaggcgtctgcacgggtttcgatgctggccaggcctgaacttggtgagcctcaagcagaccgttcaaacccattcaaatgaggaagaccatctgtttcccagtctccagctgctgctgcttcatttgcaaatggctgggatgctgctgaggggatcaggcggggacacatctgcagactctgaaggagtgttggaaccgagatcctgctgagagaagaaaggccgagccctttaaatcaacttgccaaacagtacccccagaaggtcctgagttgagaaagcaggaggcagccttgccctcctggaataactcttaaccttcccttttcttttgtagccttggccactttaaaagtatttctttattcagaaagtgcgcagtgtgggagggcctgctctatgggcttgggggaaaatgtcaaacgggatctggacatctatctgacctttcagggccatacagggcaaacgtatccgctggagtatgcaccatttattgaatgtttacatcaatatcagggaggtgagcttgtcccagcagcagcttctaggagccacaggtaacagtaagtgtggcaaggtgactgtccctgaaaacctgcttctggaatgagtcaggctttagggtatgctctctggaatgcaggccagccgccccaactcgcagtaacgcaggcccttagctctgtggactgcgtgaggcacagctgtggggactcttgcccatggtttggtgtttgcagggttattcccggcatgctgtggggctagggtaagttatccggctcctgagccctgctggggttctcatctcaagggaattctgtggtgtgttactgtgccccacatgcaaatatcagctactctcaaatgtgttggatggatgaatagtagaaggtattttaagaagccacaggcctctttgtaaattaaacaggcatcatacatgggtgttgataatgatgaatctcacaaaatcttcagatgtttagtctctgggaacattccaggaatcctcatttaggtaacttatatgtgatgagacctatttgttcacttgaaagaaaacctgttttgaagtcagaggaatgcgaatagaggctctcacatggttggaaaaagcaatctgcaggccagttacgccccgtaaacaggaacccaggactgccctcctggccagggctgagttgcaggatggggaccccccactacctccaaccgcccgccaggatgaggagtgcttgctctcagacgtgcccctcactttaaatatacagaggccttcctaggcagcctttgattgtgtccttgtggtgaccttgccctgcagcaggcagcactggagatgtttttttcttctctaaagcatgactctgaggctcagcggtgtgaggctgtccaagctgacacgttcactactggcagaggcgggtctcaaagtctcatccttggacactggagctgaacttcttgtagtgtgggtcttggaccagcagcatcaggcctcacctgtgggaaataaagaatgtcagcccgcacctgcaggcctactgacccagaatctttttttgttttttccttttgagacagacttttgctcttgttgtccaggctggagtgcaatggcacaatcttggctcactgcaacctctgcctccgaagttcaagtgattctcttgcctcagcctcccgagtagctgggattataggctcctgccaccagacctggctaatttttgcatttttagtagagacagggtttcactgtgttggccaggctgttctctacctcctggcctcaagtgacccacctgtcttggcctcccaaagtgctgggattacaggcgtaagccacagcgcccagctgacccagcatctttggaagtgggagcaaggaagctgtcttaaactgaccacgtggttttacgcacagtaaagtctgagaaacattgcattgatccctactccagtccctctccgtacaccttttgggtggagtgggctggggacgcagactgtctttggctgtgcatgtcctagaggctgaacaggacgagatgggagcagtgcagtgtcttaatgggaatcgggattttcacggaggagctgttggaactgggctgaataggagcctgccaggcagcagagctgggtgggcttgtaggtagagggaacagtgcccatgtggacaggtaagccagagtgtcagagagagggatgtggggcttggagcaaccaagcctcaatgcgcatgatgttctttgggttttattctctctgactttggagtggtctgtgcctttttaaaagagtagagatcatgtgcttttcagaagattcctctgggggtctgcggtggctacaagaggcgcaccatgggtgatgggttaggcgcattgcagaggtcttgtggaggactggaggagacctgtgggatgcagttttgcctgtactttctttcagagctaagctttctatcagggataggcctaataggtgaaggggtgtggggactgatcagaggaagggccagaggaaaagaggggcttcagggccgacttggagcttgggcggcagttcagtggtgtgactcccttcatcgtgtaagagaagaggctggtggaggaggaggaggttgaaggtcacttgcttgttttggatacgacctctgcagacatccaggttatgtatttcctccccccgggcaggtggaaatatgaacctacaagcagggacttgagtggcatctgcggggaggaggtgggaaaagccacacgtgcccaggagactggaatgcagggaaaggaccagaagagccagaggtggaattctgggtatatccatggatacaggaggggtggcagggaaggagaaatttcctagaaaggcaagaagtcctccttgacatgttcctgtccataagaacacatacgcacatgtacgcaccagcaggaagcagaatgctaaccgaagataattaacccccaattctgtgttagggattgagaaatagaccaggagccctgccccctcctctctcatttcctgaccttccacactgagaagacctggctaggcagccttgctttttttcctgtttagcggaggagtgaggatttcagccggaaggtctttctgatggcagatgtgtaagtgccagacattgtgctgggtgccttctgtgtcctatctcatttattattgttcctgctccgaggacttgcctcaaggtcatacgatttgtaagtggcatagtctcggtgtcagtgacaggtctgtttggtgtctctctctctctctctctctctctctctctctctctctctctctatatatatatatatatatatttttttttttttttttttttttttgagatggagtctcgctctgtcatccaggctggagcacagtggcgtgatcttggctcactgcaacttccgcctcccaggttcaagcgattctcctgcctcagcctcccgagtagctgggactataggcgcctgccaccatgcccagctaacttttatatttttaatagagatggggtctccccatgttggccaggctggtctcgaactcctgaccttgaatgatccacctgcctcagcttcccaaagttctgggattacaggcatgagccaccatgcccggccttggtctgtacctttaacacccccagccttttctgaagagtcaccagagaagggacaaaaatgaggccatagccttactgctaagggaccatgagaggcttggggtatagctgtctgttgagacaggtgctttactactttgtaagatgaagagagctgcctctggctgagcactgtcattaggactcagggaatggaagtgttttgagaccagagggttcagtttcaggactggagatcacaatgcattcattttacagagtgacaactctgtagggccactcttcaccctaagattgggtcattaaaggccaggcacatcctattcactccttcacctccttgtgagccccccacatgccttttgatgaaagggttttccccagaacagtgtgtcccaagaagccctgaagggctggagatgtaccagctttctctgctatgtccagcaagtgtattttcagaaggtaggaggctcgggctgggctggccaggcagccaggcacacagactcctcattgtacatccaagccggggcgtgcaggacttcaacatagcttgtaacgcaagtatctatttcctgggcgctacatgatctaatggcctgtcgctttgggaaatgctttctgaacaaaagactcgatttatttatttatttattttttgagacggagtttcgctcttgttgcccaggttggagggcagtggcgtgatctcggctcacggcaacctccaccgcccaggttcaagcgattctcctgcctcaccctccttagtagctgggattacaggcgtgtgccaccacgcccggctaattttgtatttttagtagagacggggtttctccatgttggtcaggctggtcttgaactctcctgacctcaggtgatccaccctccttggcctcccaaagtgctgggattacagatgtgagccactgcgcccggccttttatttttttaaattattattatttttatttatttatttatttttttgagatgaagtctcgctctgtcacccggctggagtgcagtggcacgatctcggctcactgcaacctctgcctccctggtttaagcgattctcctgcctcagcctcccgagtagctgggattacaggcgtgcaccaccatgcctggcttaatttttgtatttttagtagagatggggtttcaccatgttggccaggctgctcttgaactcctgacctcaggtgatccacccgcctcggcctgccaaagtgctgggattacaggcatgagccaccgcactcggccaggactcaattttgaagttcttatgcaagcaaagctgcccatatctaggagtttatgcacacagtactgattcaatacctgcgtcttagtggtccatcaggaatttttcactcatgaaatatgactttaatacacgtgttgggaccagagagaaaaccttccctctgtgcatctttttttggagaacactgtcatgaacagccgaaaacatcagatcaaaagcgagagggatactgacaaaacagggagtgcggatttccactgtgggtggggacattgggagacacggtgactcactcctcagtaagtgcattcttaggctctttactctgtgtgcatttttattttctcatgggcaacaatataatttctttcaaacatgaagagccatccagcatgtttctcaaaggcagacttaaatgatatgaggggtgtgcctaaatatataatttttaatggttaccatattggaaacattagccatgatcccatctgatgactaggaacatgagccagtctggagtttctggagaaatccagctaccgctgcagaggcggctgttagctgttgttaccggcatccttgttagcgaccagggaggtttcagtcccgacttgtgtctaccagataccctgacaactggttagaaagagaggactgcaccctttcatcctgcgtacttatctgttgtttgttgctttgacttctttttgttctccgtttttatgttggcagtatttctcgaggtagagaactttcacctttatattgtgcggagtatttgtcccttcctcgcccccttaaagaacacgtagtacctatgccttataaggtctctgtttgatgtgaggaatttggtcttcttgcaagtcggctcttgcagaggggaggctttgaggatgtctgggctgcagcaggctgtcttcgttgctgtgtacacagccctcatggcagggcatgcaaaggtggttggttctgacttcaatggcgggactccattgcctttattttttaatttaattattattattattattatttttgagatggagtttagttctgtcacccaggctggagtgcagtggcgcaatctgggctcactgcaacccccgcctcccggattcaagcaattctcctgcctcagcttcccgtgtagctgggactacaggcacacaccaccatgcccatctaatttttgtgtttttagtagagacggggtttcgtcttgttggccaggccggtctcgaactcctgacctcaagtgatccacctgcctgggcctcccaaagtgctggtattacagacatgagccaccgcacctggcctccattgcctttatttctttctgctgataagttctgatgccagtgatacccagattgtgccataggaaagagggggctgggctcttccagaaaccctatcttgcagaaatctctcttctgttcctacggacagagaattgggtattgaccagtgaggacttcttactgggactgggcgtggccactacaggacatcttccagactaagagggccagttgggggttactggaccagggaggacagtggcggccacttacttgccatgtgctttgtgtgcagtgactatgtagcgacatttgcagccggactgtgtttctcctgtagagacactggcagccctacagccctacagccgtgacatttactctgtacaaggtggcaggaggtgtgggagggcaccgggaaccgaaggccattttactacccttcccgcagcgctcctgttacagtgcttgtgggagtcccagctgtgcctccaggtacaaacgggtttcttcctgcaacccacaaccctgacaggacatgcctcccgggtgtgctcctaacctgcctcttctctctgcccctccctctttctcctctccccttcccctctctttcttcctcttgccttcctcttctttcctctccctccctctgtttctctcccttccttttccttgtctccgtctctcctctcctttttccccctctccctctctttcatccttctgtctcttccagaggagtctgttcagggatttctttctctctttcttcttcctggaggaatgtgtttagggattggacacctctgactttggaggagggagaaacctcagtgggatgggttccaggacgaccccaccgcatccttggaactaggatgatctagacgttggaaaagacaccatccctgggaaaccccagaaaaggcttaatttgtgaaaagtaatggagggagctgtgccgttggtagaaactgcttttttcttccttaacagtttaaatctgtcgtccattctccgtgaagtgattggacggggcaagactcaggtttcccatctgttctctgtttgcatttgggcgccatttcaaaaaccacacgggaaaagtttataggcaaacattataaaaagtgacagtctgaagtgctgctatcgctggtttggcaacgtaaagtgttacctgaaatagcttaccatttccaaacccttttgctgtttcaactgtctcaagacaaccctcccgctgagatgggtgagaagtccagctggatgtgtgcagtgaagtcacataagtcacagccttttttgacttttacaagatttccccctcctggggctatcttcacacacagcgaggatttttttctctctgtttacttatagagaggtaaattcatgcagcttgtggctagtggcactctgtgtgatgtcaaatggtctgctgaggggctcggagagtcaggcagcccctgcctcagtttctttctctccccagtcagaggtcctatgagctcccaaggaataacaggatggttttcttagggaaggaaggccaggtcaaggcaggaattactcacagctcatgtgcagatgcctgttgttattcatactatttatttatttgtgttttttttttgtttgagacagtttcactcatgtcgcccaggctggagtgcaatggcatggtctcggctcactgcaacctccaccttctgggttaaacgattctcctctgcctcagcctcccaaatagctgggattacaggcacatgccaccacgcccagctaattttttatatttaatagagatgggtttcaccatgttggtgaggctggtctcgaacttctgatctcaggtgatccactcgctttggtctcccaaagtgctgaaattacaggcatgagccactgtgcctgggctacttatttatttttggagacaggttctcgtctcgctgtgtcacccaggcaggaatgcagtggcgcgatcatagctcagtgcagcctctggggctcaagcgatcttcctacctcagccccctgtgtagctgggactacaggtgtttatcatcattcccggctttttttttttttttttttcattttttggggagagaggatcttactatgttccctaggctggtcttgaactcctgacctcaagtgattctcccacctcgacctcccaaagtgctgggattgtaggcatgacctgctgtgcctggcccatttattttttgattagctgtacaagtacctgtctctctcatttttaaagtatcaaaacagtcaatttttttttttattttttttttgagatggagttttgctcttgttgccccggctggagtgcaatggcgtgagctcaactcaccacaacctccagcttttgggttcaagcgattctcctgcctcagcctcccgagtagctgggactataggcatgccccaccatgcccagctaattttgcattctcagtagagacggggtttctccctgttggccaggctgggatcgaactcctgacctaaggtgatccgcccgctttggcctcccaaagtgctgggattacaagccctaaccaccgtgcccggccaaccactttgggtcgttggttggttgttaggtagatttaaaaaaagctttttgtggccaagttcggttgctacagctcttggttattaccacttttggattactgacgcaattcgccctaccccgaagttttatacaattttggattggctctgcaccaccctgaaatgcaacccccctgagttagcctggaacttgcggatcacaaaacccccatttgtttcccggggcctcctgtatcgcgaattttacctacttatgacaacaatattgtatatccacaaacccttctttaaggacttggttcaaacaagtgttttcgaacatccattggatagagccagagatacactttcgtcgttggttaaacttatggcaatgagatatgcgagtcagctcttccccataactattaggcctaaccacaaggggatatatggctcctcttaaacttttctagaaaacataaaacagattttgtaaaaattatctctcccccgtagagcctattgctcaatcttnnnnnnnnnnnnnnnnnnnngaagacaccctgtctctactaaaatacaacaacaacaagagaattcccaggcgtgatggcatgcacctgtaatcccattactccagaggctgaggcaggagaatcacttgaacccaggaggtggagcttgcagtgagccgagatcgcaccactgcactccagcctgggcgagagcgagactccgtctcaaaaaaaaaaaaaaaaaaaaaaaaggccaggcacggtggctcacgcctgtaatcccagcactttgggaggctgaggtgggcgtatcacgaggtgaggagatcaagatcatcctggccaacatggtgaaacccaccccgtctctactaaaaaaaataccaaaaattagccaggtgtggtggcaggctcctgtagtcccagctactcaggaggctgaggcaggtgaatagcgtgaacccgggaggtggagcttgcagtgagccaagatcgcgccactgcactccagcctgggcgacaaagccagactccgtctcaaaaaaaaaaagaaaaaaaaggctgcttgctaacacgctgctggtacttcccaagtatttgaaacttctgggagaaaattcacgtggatgcaactgagctttatgcagcagggctgcagtagtgtggccacggcagtagaaacgagtgttgagctgtgtcccaggaaggagacttggtgccttgtttgtttaccagttttaggaaacagtgacaaagattggccaatactactgtgaagcttgcttgcttcttttcgacttttaattcatattgtgaaaaatacatggaaacatattctctgtctgtggaagcctctgaaagagcatttgtgcatagcaaggcggcttctggaaccttctccccattgcgttttggcaggagatgagggagatgttgggctgtgcacccctggtggattcgcacaggaaaggtgaaaagtatgccacagcaatgggaaaaagtaaatccaggaagtgctcacatgactataaaaggagttatgtacatttcctggggaattctttgctctttcacagagcaggctgtgcagcctggtggagtcagggagaggttgtccatccatggggggtgaccagagttagggaggcccctttgcacatgcaggcacaggggattctctgattgtcctggctccgcgcagcctggggccaggtcagtacaactgtggggatgaacatggagggctcagggagtgcatgtttgcagggagtgggcagcgggtcaggtcacctgcagcattcaaacccagaagagaagctaagccctgtggacggcaaatggacccaaggacacgggcagggacagagctgcttccactgagccagctgttgtgcttgtgttcttggccccctggccggggttgtctttgatatgtgtcgtgtgtgctgggccctgcaggctgggcttggggggccactgggtggcctgggaggctaccagtgtggcatttggcccctccccagcgtatggccccaccccatccctgcctctcttcttacttacatcctcctctttttattctccccaacctctttctctcttgtgtgtttattcatgcattctccctaccatgtgcttgcagagtcttctgggatacccaggggtattactggcatgtttactaaaggcaccgctgatccccaaaatgggccctttgtgaaatgaccactgaaggggtggagggaggagtccttgctttctcagtttaccaagacagcagttactggtttgagactttgaagacaggatggcttgatttttatggataaacatcattatctcattggtgtattttagggggtgatattttactatccttgaagcttggatatctagatgacagttttgatctggttttactgggatcaaaagcagttttagtacgtcaagtcatcttaactgtccattgagatgggactcctgtaaaatcactttgtatctggagatagcaatccaagtgttctggctgggcgcagtggctcacgcctataatcccagcactttgggaggccgaggcgggcagatcacgaggtcaggagttcaagaccagcatggccaatatggtaaacgctgtctctcataaaaatacaaaaaagttagctgggtgtggtggtgcacgcctgtaatcccagctacttgggaggctgaggcaggagaatcacttgaacctgggaggcggaggttgcggtgagccgagatcgtgccactggattccagcctgggtgacagagcaagactctgtctcaaaaaaaaaaaaaagaaaagaaaagaaaagaaaagaaaaagaaacccagatgttctgtgattatcctctgaaaatcgtggtgcttaaaaaatcacggcaagcatcttccgccttgaagagtaacagtaatagtgacagtcattagcccgacatgttgtagttgatgatcaggttcatcttcgttggctcattggaatcttaccaataataaaccagtatttgggtactcttaccctgcaacagatggggaacaccaggccaaaaggttaagcaggaatggagaggcgtgggaactcagggcttcatcctcttctcgtccagggcagcacccttcaccaggcatctcccatgtccagctccaaataagacacaggtcctcgctgtcccctgtacttccttctagaacagcacgtggtagtccagcagctcagatacccccagtttcagcaagattttggggtttactgattttaggtgaaggaaaggattctcaatgaaaacactttcatttaaaaacaggaaatcatacatcataactcctcctttgccgggagagagatttttttctgcatcacaattgcaaatgccttgcttatcttttttttttctttttttccccctaatggagtcttagagcattcctctgcgtgacatagggacatggttgcaccttatctgagggtcaggatggagcagattggtgtgtgggtcccaggtgccttccctgtgagggagggaagctttgctgcttctgctcagcggctgccctggtgatcaattctggctaagaggaaagtacattccataacatttctggtgacttgctgatcatgtgatgttgtcataatagacattgatcattttatgacccagactgatccaatgtaaattcattctaacatggtgggtgctgtttcagcaatgagttgttggagacctgggactcaaaggacatctggtccttgccttagccagctgtcaaaggggttggaccaatagcgtttggggccccttcagctctcatgttgagtgaatctgtgactctaggatgttgggagtgggagatgggccaagatttgggaccagactgaatccctgccgtcttctcctccttctcatatttctcttcctttcttttttctgtttggtctccatagtttaaagtatttctattagtcactcaattcagccgcattttgacttaaccagccttgagagacctgctctaagagccttcaaactaagttcccaacatcttttaaacttcgctttgtccttcacttctcagctcaaatgcctgttctttggagaagtctctctgattgtcttatacaacagggattgaaacactttttgcaaaggcaagactgcaaatattgtagggcttgcaggccacagggtttctgttgcaatgactgaactctgcccttgtaacacacaaaagcagcgccagacaataaggaatgggcatggccgtgttctaataaagctttgtttacaaaaacaagctgcggctggcttggcccgcgggccatcatccgccacctcctgccaagggaccagccctcctctgccactgctgtgtgtgcccgtaccttgccatgtccttcttcctaatgcttaagcaagaacactgtattttttgtagattttgtatctatcgtctgtcacccccaccataatggacgctccacaagtgcagggtctttatcttgtctcctcttgctgcggagcttccagaataggcttgttgtatagtagacatgcagtaaataattactgagtgagaaaacaaatgttagaaacataacctgcccgtcagctgggctttccttgctttggggtgcatttgtccatgttacatttagcttctattttcctccttttgttgtgattctctctttgtgttcacgtgctagttggcatctggggcttggcatgcatgcctttggtgatgcccccttgagaagccccgggcctcctgtgtggctgttgatggtggtggtgagggggatttcttgtccccaatgcatgtggcccttgctcctttcacagtgggactgaaacacagattgacttgatttcagtctcctgtgggagatttgttcttctgaggggtgtctaggcaaaacagttgcctttgatcctgccctgatttggtgctgtctcagtgctgggaagctttgcattttctaggcctggaactctgggtcccattcacacttctcactggagggatgaaagcctccttcttgggccctcgtggccatcccagctggccgctccagctgttgttattaataaatgccagtggtgtcctctcaactccagtggagaggttgtgtgggttggatccttgtgggtccaatcccgtgctgcatatctgggaactgtgaccttgtttgacatggccatgtgtctgccaagcaggatggggtcggtggcgggaagcacagagaaccatgagacccacgccttttctctagggtcttggtgtctccgtggggagatgggatgcattcatgagaatatggtgcatcccatgagctggcaaagtgggcaggtgtatggtggagggggagggagccagtgctcttccgcccagggggactgatgcaaggtgactcccatcacggaggaccctgcttgatttgggtcttggagggtggatgacagggaagagagggaggaaggactgtccctacagaagaagcctgggacatgtgtggtgggtgttggtgagcagggtgggactcagctttgtcgtgtggagtcgggggcacacagcacccagcggcttcatttcaggacccctgtaagtgcaacggagactgccttgcagctgtctgggcattttgctctttttgtttttggtgttaaggcctctaggcttttatcattttgggaaaacagcaggtctcagctcacccagcacagaattaggtctctaaaccggcaaagtactgatctgaacatgagagctcatgaaaactctggatggcaaaaaatcttgtagagggatcccttagttttccttgagtttgagacatttcattttaagaagcttggccttggggcaacagaccaagtctagcacaaataataaagagtgtatgtgtgtgtggcgcacagtcacgtttcacgtacaaatgtgtaaaactcggcattcttacaaataaaacataccacaataacagatttttgcaggtattacagtgcaagcacgctttggcaatcaatttaaacattttcttgtggaatattcttccatgctatggtttggtttgtttctaaagccccataggatgtggaaactaagtcaggacagattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacaggtgagttggcccgccagcactatgctctctcttctctgtagccattacatttttttggccaagtgaaaaggtagtgagatctctaattgtaattggatgccaggcatacagcttcatagtttttgaaattcttctttgggacctggtgcaccagaaaggccgatcattaagaatgatagaattcttgtgcacaaagtaacatttttcttaagatagtacgcttttatttaagtaaatacatgcttttttttttttttttttgtaccactgacatctctggcatttagaatatagggttgaaatttggatactcaagatttctgattcatttattagagtttgagtttctctccatgatttccttctatgcagtgagcgggacagaacaggccccctttgtggccgagtttaaagttctgctttcagaatgttagttgacgatgagaagggccacacagggactgagttttgttagggatcaatttctttcttcaaggagaccccgcatactgaaaggttaatgttggaaaaagagtctttgggtgctacacaattggtaaatttgtcaggggcttgaatactgtttgaagcttgaaatccagttctcatatatccaattttatagcctgtttaaatagcgtgaaagcagaaaacattgagaatcataacatagaccaactgtcatcatggagggaaaatttaagccattaaaactatcttaactgaaaacaatcccaggctctttgcgagggttcctgggttgttgactttgctatggagaaggtctcagttgtagataattgcaacctttttgctttgcaaaaaacacatccatggaatatgttcttttgcatacagatgccatctcatccggagatgatgaggatgacaccgatggtgcggaagattttgtcagtgagaacagtaacaacaagagtaagtaactgcccggctccgatggtccccgagagaggagcatggagggaagttctgcctgtcacctgtcttcttgtcgactcttctgcgccatgctgtgtcccgcggcccttgcctttccccgctgtgtctactttcctgactttcaaacctgagaataaaccagtgttgctgcacagccttctctatcgtttgtcctttcttctcgtgtcactggtcattcgtttttcaaagcagttactacttttctttccttgattttcccttttccctttgacttctccctattcagagacataagaatagtagaaccatgtaacatcttggttttccttgtaatcagtgattgtgcttggtttaatccagtggtgtgtgactggggcaattgcctattcttgctctcccggcacattgggcaatatttggttgtcacaacagagggagggggtgctggtggcctttagctggggaggggccagggatgcagagcacagccccataacaaagaattatctggtccaagatgtcaatcatccctagggtgagaaacccggcctcctacaacacacacctcatgctgagtgaaaatgaaggacgtgtgccttactttgtagaccacgattgaaaagggagccaagggtggcttgcttaatgagggccatgaacactgagcgctaacatgggagaggccatttacttgcgaggaagaacatggcgtagcctcttggagctgggcaacctgggtttgaatcttgctccacaacttctgagttgctcatttcacttctgtgccttagtttctttataaaatgggagtaataataataatactattttctggggttgttatgaggattacatgagttcctagttgtatagtgctcagaagagtggttgcttgcaaatgtttattcaatacacaaaatacaatatagcattacttgcattttccaatgacttggctagaatgttcctaaagtgtttgtacatagggtattgggattctctgcttacatggtatattctacatttttcttaaaaggattttagtcaatttggtacatttaaacaaggcctaagtaatataccacacccggctaatttatgtatatatatatattttttcccgagatgcagtcttgttctgtcacccaggctggagtgcagtggcgccatcttggctcactgcaacctgcacctcccaggttcaagcaattctcctgcctcagcctcccgagtaactaggactacaggggcctgccactacacctggctaatttttgtatttttagtagagatggggtttcaccatgttggctaggctggtctcgaactcttgaccttgtgattcacctgcctcggcctcccaaagtgctgagactacaggcgtcagccaccgtgcccagcctaatttatgtatttttagtagagacagggttttaccatgttggccaggctggtcttgaactcctgacctcaagtgatccacccgcctcagcctcctgaagtgctgggattacaggtgtgagccactgcgcctggcaatactttattttttcgagcagtttcaggtccacagcaaaataaagaggaaggaacaaagatttcccatataatcttccccaacacatgcatagcctgtcctgttatcaacatccccaccagaatggtacatctgttccagttgatgaacctgcactgccatcattatcacccaaagtgtgtggttgactttagggtatgtaatcatacagtgtgtagcctttacagattggcttctttgacttagtaagatgcatgtaagtttctctcatgtcttttcatggcttgatgggtcatttgtttgtagcactgagtattccattgtttgtatgtatcaaagtttatttacccgtttacctactaaaagatatctcggctgggcaccgttgctcacgcctgtaatcctagcactttgtgaggccgaggcgggtggatcacttgggaacaaaagttcgagaccagcttggccaacatggcaaaatccctgtctctgctaaaaatacataggttagccaagtgtagtggtgcatgcctgtaatcccagctactcgggaggctgaggcatgagaatcacttgaacccaggatgcggaggttgcagtgagtcgagatcacaccactgcactccctcctgcctgggtgacagagtgagactccatctcaaaaaaaaaaaaaacaaactctgttgcttccaagttttgacagttgcaaataaagctgctacagacatctttgtgcgggtttttgtggggacatagttttcaattactttgggtaaatgttaaggagtgtgattgctggattatgtgagaagagtatgtttagatttgtaggaaaccacctagctgccttgcaaagtggctgcaccattttgtattcccaccagcaatgaatgagagttcctgttgctccacatcattcgatgtgcttggtgttctggattttggccattctgataggtgtgtaatggtattttgttgttttaatttaaatttctctgatgacagatgatgtgaagcatcttttcatatgattaattgccatccatgtatcttctttggtgagatgtctgttaaggccgttggcccattttttaattaggttgtttgttttcttactgtcgagttataagagttctttgtatattttggataacagtcctttattacatctcttttgcaaatagtttctcccctcacctgtggcttgccttttcattctcttgacagtgtctcttgcagagcagaaatttttaagtttcatgtagtctggtttttcttttatggatggtgcctttggtgttatacctaaaatgtcatcacccaacccaaggtcatctagattttctcctatgttacctcctaggagtattattgttttgtattttgtatttatgtgtgtaatctattttaagttaatttttgtaaaggatgtaaggtgtgtgtgtggattcactttttagcctgtggatgtccagtggttctgggactatttgttgaaaagactgtcctttaggtttttttttttttttttttgagatgggagtttcgctcttgttgcccaggctggagcgcaatggtgcgatctcagctcaccgcagcccctgcctcccgggttcaagcaattctcctgcctcagcctcctgagtagctgggattacaggtacatgctaccacaccccgctaattttgtatttttagtagagacggggtttctccatgttggtcaggctggtctggaactcccgacctcaggtgatctgcctgcctcggcctcccaaagtgctgggattacaggtgtgagccactgcgcccggcctgtcttcttaaaggaaaaagataaaatagatattggtaggtgcctcggataaatgagttacttaagtgaagacttagatttgtccctgagtctcctagcagctggggcaaaagagaaatattttggttggtgcagtttttactttttgtcaagaggaagcttagggcagtggttctcaaagtaaagttcctggaccagcagcatcagcatcacctgagaactccctcgaaatgcagattctcaggttcctcctcagacccactgcctcagaaactctggggctgattctgattcacactgaaatgcgagaaccactggcttagaatttgcacgtggaggtctgccctgaatgggagcttactgttagtggtcttgttcgtaaaacagtggataataaggtgagtggaagtatcttctgtgatttgtaccagccttctaaagaggttatcattattgttatttaataaaaagcactgataagtggagcatgtcactcgcctctttttttttttttttttttttttttttggggacggagtcttgctctgttgcccaggctggagtgcagtggtgctatctcggctcactgcaagctccgcctcccgggttcacgccattctcctgcctcagcctcccgagtagctgggactacaggtgcccaccaccacacccggctaattttttgtattttttagtagagatggggttccaccatgttagccagaatggtctcgatctcctgacctcgtgatctgctcgcctcggcctcccaaagtgctgggattacaggcgtgagccacggcacctggcccactcacttcttttggccagtggctctggcatgaagctggaggcaaagatgctgagggcctgcactagacaggctctgtgctggctgctggttccgtccatgccaccaataacccgatcaggtggagagagtatttattcttgctttattgaatggaaaattgtggcttagcaagcaaaagaagggctgcgtttcagttgtaggcctgttgcctgagagcatcctagggtcacgatgggggtggagtgagaatgcttgtacaggtgtttacagctctccagttttactgtatgtgggtgccctcgctatggattgagacatcagattctgtcagcttggtttttggatgcctggggaactgcgttgtcctggttgtcggctacctgcctaatagcaggttaccgtgaaaccatgtgaagcaatagaatgcaacagcaaggtatggattacatgacaggcaggctgagtggttcagaaggattatatgctgtggaccttatgctttgcattgtgaacagtgttcctaactgcccagcgcccatgcagaagggccagggggtagagcacccatgtgatgaatgccaaccaacagtgtacttgccatgccttcaccttgcaagcagggttcttttgtaattagctctcgaatgacagcaactctgcccctgaaatgggtgctctgcagtgattaagggctagtgttagctgtaccagggagatactgctgtgaggaggtgcctctgtttggtgtctgtgaaacattagatgctatttaaagtgatagcggttcttagctggctacttggcctctgccatctgttagtgtgattaggctggtctgattcacaggtgcagcctggggcggctgagattaagcagctgtggcctgtgtggacagaggaatgccacggccggggtaattggcaaggcaggaaaggggacgttgccattaaaacaattttttgccacctcaagtgtcaaatgcctgacccgattaatagggaaaattgcagaagcaccaaattctttgtattttcagccacctggaaaacactcatgtgtccagattgatttctttggtgccttctgattgtctgaaaatgccactggggtgtgtttgtatgttcttctttaggaactttgacaaatgatgctccagtgaccctgtgttgatggtgacgtttttgggcttttttgagttttttttttttttttttttttctccttttggattgagacattgaaaatttagttctgtatcttccagttggaaaaatatattgcaggttattccctctgctgatttgctagattattgatctaattttgttggttaacataagaaggcaagctcagctgcctgctagagtgttttttagattctgtacagagtacgaaaagcttgggtgccaaatacaatggcaaaaataacaatgaagaattaaagatcgggcgcggtggctcatggatgtaatcccagtactttgggaggccgaggcaggcggatcacaaggtcaggagttcgagaccagcctggccaatatggtgaaactccatctctactaaaatataaaaattagccgggcttggtggcgggcgcctgaggctgaggcaggagaatcacttgaacccgggaagtggaggttgcagtgagccgaaattgtgccactgcaccccagcctgggcgacagagtgagactccgtctcaaaaaaaaaaaaaaacaaaaaactgtatctattaacatcatgttgtacatgcattgaaaaacccagccatgggctgatttgattgatctttttaagttggtttcttcatcacagatgtgcagggcattctctggtcatattttagcagctgactagctgatgacctcacatggtaccagcactagatgtttccaagtggaacagtcctgtgatgtcattacaagcctggttgccaggaaataatgctgttacatatgcccctcggtgcaacacattttctccagaaagaaagttgcagtttcatatgctaatttttgaaatgcatccaggttgagggttttgaagggttgagaatttatcctttcgcatagaaaagtataagttaactagttcttgccttccctaggtgctaggtatgttaatgggttatctggcagcaactaggtagatgcatatacccatttgttcgagggatttttattgtttccagcttgtttcggtgattaatgtttctgaagagcttgagacttagtttttgagaagatcatgatggacgaaaagttcaggtccattgcttaactcgagggaagtgatggagagacagttgcatcaagactcttgctgctaaagtggttctttctctcgagtgatgagagaaaaagtaattttctattttggtttcattcctgttgagacctgcagatgcccacactccatgtcagggagaaaggctattttttttggaagtacctagggaaaatgaaggtagttagcctgagattccaaactcatttcattgattaacctgccgataacagttcaaagtcacctttgttctaattgggatttttacttggtagagatcctaagttggtaacagcaggcttcttagttgtgttgaagtttctaggaattgaaaagaacaatatcagtaataaaaacaacaaaaaacccacacaggctttgcaaatttttagaaattccctttgtaatgaaaacatcatcaataagttggtttgggccagcatagcagctcgcacctgtaattccagctagttgggaggccgaagcaggaggatcgtgtatacccaggagtttgagactagcctcgggagcatagcaagaccgcatctctacaaaaaataaaagattagccaggtgtggtagctcatgcctgcagtcccagttacttgggaggctcaggtgggaggatcacctgagcccaggaggtcaaggctgcagtgagctgtggttgtaccactgcagtgcagcctgggcaacggagcaagaccctgtctcttaaaaagaagaaaaagctgcttttggtattttatcacaaatactgttgatggtgttccatccaatggttggactgaatatctttctcagtctcctccttggtcaaacagcatagccaatgattggagaagtttcctttgaaggcagatcttgggaattcccatgggctaactggtctgctagtgggctcagttctttcacttgtggttaacttgcttggttttgaaaacatatatttctgattgaatgcctggctggttagcaagtttttaatgagatttctcaaagccacagacataccccctcataatcatatcctcactcacatctccgtattttgttagatttgttttctcttagtttataccaaactgaaagcagaactgcagggtagtggggagctctgagacatttttcccctgtcaggagtcaaagcattcaaatgtcctgattagtgatatttttaaaagccctaattatagactcgagacagaggctttagtggggctttagagagtttgtgagacttaatctaggagctggaacaggctgtgtttttaaaattttttgcatccataaaaatacagttggcagtcattggtggccgcggctcacataaatcttgaacttttgacttaattaccatgggagagttcaaagggcaggctggagtggttgaaggaacactgctcagggagctggagatgggcctggcctcagcccggcctctggctgtgtgaccttgatcaaatcacttaacctttctggatgacattgatatcatcagtcgttgggccagatggtcaccgaggtctcttttggtacagcctggtaatatgattccatgtttctcctttaaatcattgggccgtgttctctgttttttggttccagagagagagagagagagagagagagagagagagagtagattataaaccttaggtgtcagcattgagatgtgcaagggttttggtgggggcaggcccagcagcctatggtttctcactaagtttaaattgcagggtcaaaagaaatcacataatcctaccatttgttgacagaatcaatacctgtctagcacatagatacctggaaagtatgttcgaactggcggggaccttaatcagtgcaactacttcattttatagctaaagcttttaatagtcatccatccgtccatccatccgtccgtccatccatccatccatccatccatccaataacgcttgagtgcctactccataggctaaagacaactccagctgtaccctccaggtgccctactgttgttggtcagcatcagaaggagtatttttcagtacagagacactaatgttggaagcacacatctatcacaaagaaggggccctgagaaagaataacttggctctagggtgggaataataaaggctgtgttggagtcctttgaaggaagtttctgtgggtttataaatctctctttaactcattgcatcttaaaagacttctgttgtcttaaagtaaaattctacttaatattattactaatgtgcaatgactgttacagtgtagaaaatgataatgagtaggtatgctatatgctggtgatgggatttaattgatgggatgggattgattgattgtggctaggtctgactgttctttaaccagctcattcttagtatttgatgattaggagaacatcattcttgtggtacctattacatcagaaggtctaagaatgtcagagccaaaggaaccatacctctcatcgaggttaatttgtttcctttacaggtggattagtgtcattcattttgaatgccattggaagtttataccacacgtctctattagctgactttaagcccgctcttcatacacctctaaggtatataaagttcagggaaactcatgtgtccttagcttgcagattcatattgattgattgattgattgattgattgagacagagttttgctcttgtcgcccaggctggagtgcaatggcatgatctcggctcactgcaacctctgcctcctgggttcaagcaattctcctgcctcaccctccctagtagctgggactacagccatgcgtcaccatgtccagctaatttttgcatttttagtggagacggggtttcaccatgttggtcaggctggtctcggactcctgacctcaggtgatccgcccacctcggcctcccaaaggctgggattacaggcgtgagccaccgcgcctggcctgcagattcattttagataagattgttgagtaaacatccctgttaagcatctactatggacaaggctgatctctgcttcagtagatctttaatttggtacatgagttccttctccaaatgagagttgttaaagctgttcacgagccttggtataaaaggggcttccttaggtagaggagcccgttctaagtgcctggatggtgtttgtctccagctgttttgcagttcttgggaggccctggcatttccatgtgtgtcctttccaactgcaaaaacatacagaggacacaaggctgctgatgaaggaaacacagtagggctatcttatagtattattatttttctagatcttacagattcaaggttcacataaagctagtgtattttaggaagagctattgtaaaattataaaagagttccagccgggcgcggtagctcacgcctgtaatcccagcactttgggaggctgaggcaggtggatcatgaggtcaggagatccagaccatcctggctaaaacggtgaaaccctggctaaaacggtgaaaccctgtctctactaaaaatacaaaaaaaaaaaaaaaaaaattagccgggcatggtggcgggcacctgtagtcccagctactcgggaggctgaggcaggagaatggcgtgaacccgggaggcagagcttgcagtgagccaagatcgcgccactgcactccagcctgggcaacagagcaagacgctgtctcaaaaaaaggaaaaaaaaaaaaaagacttcctcccctcccgtatcaagttcattaaacatatttgtgagcttgatatttaaagagaggctgtgtgctggtgtgatgttagcagtcaccagggtggggctggtcacacatgggagcctgggtggagggttgtgcctggattttttatggtggcccccaaccttggatctctgagacctagatgagcagcactgcacccgtaccctgctgtatggctgtgtctgtgttttgcagaagcagattttataggtgtagctttgatgattgaaatatcacccgagggaagtggctacctgccagaaattccagcaacattatttcaccttagtccttaaatcactcccgaggcaccaagacaaaggtgcgggttgcccatgggctgttgccacaggtcaggcctgcataggtgcgcgtggtctgggccggtccctgggctgttacagactcacccatggcttggcccagtgagggcagaaaagaacaacattcctagttccttcagctaaatcccactttttttttagggaacataaaaatcatgcctaatggtatgtaagcacatatctgttgatttcttttatgtaaaaaagaaaagacattccacaggatcagctcagcagtaattgatgttatctgaaagagttactgcattaatatttagctaattcatatgaataggctattgtgtttacttaaacaaatgacatgagtgcagacacctgacagcatgaggtatgcttttcatttaggttagatttgtaaacgtctttgtgtagtgacaaagctcattatttgttttgtgctctcaatggtttctttttagtggctgtggctgtggatggatttttctaagtagaagcttttaaaatgaaagtttattgaaattgtttcagtatatgccaggccctgagagtcttgggatgaatgggaatcaagtactccctggtgaaccctcaaaagaataggtgcgtttatgggcattcaacacccagagccaaatgtctacccaggttgcaaatgcaactggattcaaaggaaggaattcagcccctgttccttctttctcctccttcctcttcttctctcctggcttcgatagttttgcccctcttcccactgtttcagcatcatatgggtgcacctaaatcccatcactttgacacttagataagcacagggataaagatacagcatggccttgtaaagaaatctcagctctacctttgacaacaggtttcaagagcaagcgtgaaggctaattggggtaggtgtttggatgcagcgatttcaattcctgattgtaccctgagtctggctgctaagtgaaggggatccttatcccccagggacgtgctctacacccgtagaatagaggagacttctaaatatgcatcagagacaaagcccctgcctagggccattttgccttgggtttgtgaactgtgtgtgctgttgttcagtctagccttcatcagaaataagcatagttatgaattagccttctacaatgttcaagtccctgttggtggctgtttcagaggaatacagggattttggttactactttgctaagacagaaacatatatgtgaatagttaaattgctgtacagtagaggttctggacaggaaaaaaggaggacgtgtgccttgacccaggctggctttcccggacttcagccttaaacatcagattggtggaaggtacggattccaacctcgtggagaagctgcatcttcttagcagtggagagtagggttgaagatagtgggctctggcatcagactgatgtggttcaaatcttggctgcacctcttccaagctttgtggcttttggcaggttacttaactgctctgtgcctcagtttcctcacttggaagccaagattatgatagtgcctttcttgttgaagcattgtgaagattaatgtgttgacatgtaaaaactctttgagcagtgcttggcaaagtagaagctttcagtcggtagtagtcattcgccattattagcagacatgaagaatttacagtggtattctggcttgatgttgtggcttttatttagaaaaaatatactttactttgtgatttaaaacttttttcttgactttaaaaaatcacttgtatttatgactttcggggacatttggagggcataactttaacatatcatttaattggtagcctcctcttaagttatcattaggtggggtggtagggttatggcattcataaccaccattggaaagaaattttttttttaattaaaaaagttagtatgtatttagtgatacagttttttttttgtttgtttgtttgtatataagttctgagaaatgtacgaatgactctctgggttattttattatattagaatgacaatttatactattgattgcccttaaagtaaggctccaatggataagttgatagggcttttgagaacaacttgcttttactagtgtgtatatgtgatcatttaataggtgtggcaatccaaaatgatctatttttggaggactgagctgtcgcagttgtatatgttgttcatatgtttataaaatagcattttaaaacatgatttggcatgaaattattttctggcatcaagaacaagagagagaaggggcctcaaacacttttttttttttcttcctgttggtagacatgaaccatccctctctgggaccttctgctcagccagctggattagacttctgaaaatattttccaaatgtaaatattacccaaagatttaaaaaatagcctagcatttacatgcaaagcgaaatgatcttacctgtttggagtttactcatggaggggaagctgtccatcagtatacattctaatactgttttccaaaacaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtagaattaagctttcagaacatcacatttcttacatttttgtttatttatttatttacattttttttttgcgatggagtctcgctctgtcgcccaggctggagtgccgtggtgcgatctcggttcactgcaacctccatctcccaggttcaagcgattctcctgcctcagcctcccgagtagctgggactacaggtgtgtgccaccatgcctcgctaattttttgtatctgtagcagagacggggtttcaccgtgttgtccaggatggtcttgatctcctgacctcgtgatccgcctgcctcggcctcccaaagtgttgggattacaggtgtgagccacgatgcccagccctacatttttgtttattttttgaagtgctcaaaagttagcaggaattagaaggaatactttaacaagaatcaataattgtcacaattgcccatgtcagggtttgatattaaaaaaaaatattaccccggacttgcgtgtaattttaaagtacaattcccgtttgtgttgttcttcatatgaggagagtttaataacagaagggtcgaaagttgagagtctgttttctatatgctttatagtgtataaaactaaaacgggtgtggagtttgagaagcgtcagtatagtttccctgtcagagcaggattgcatgaatagtgaggggacttggattagagactggagtatgaaatatgatgcattaagggagagtgcgtggagatgacagtggcaatctgctgtcctccttgaaggattcttgagagcacgtcacacaatgccatgaaattttagtctcatcactccctagggagtttgaaattggcagctgtctccctgcagatgcccgcgcatgctcctctagcctttgttcatccacttagcagacattgattgagcaccctgtgtgccaggcacactcctgggctctggggagatgagagggtgaggcatggccccagctccaaggggctcttagtccagtccagcaggagaggcagaggagaactctggcaatgggagggacacaggtttggttgaagttgcaggaacatgttgcatcccatggatgtacatggaaaggtgatattggattggcgtttggaagaataaggagaaaggaggtcaggaaaggattcaggtctgagttggaaggaaagatgtctcagaaagagagagatggaatttccaaattatttagtatggaaggagagaactgtaataattgagcatatgaaaaggactgaaggaaaccttatgatgaaattctctgatgcatttggaacataagtgggcatattagttacctgttgctgcataataaattgccccaaggtatggtagctttaagcaacatttattacctcattgttgcctggatcaggaatgaaggtgtggcttagctgggtcttccatctccagctgtctcacaggactgtaagcaaggaagggttgaggctgaggtctcattggaagggttaattggggaaggaactgctcatgtggttgctgttaggattcacttccttgcagagggcctcagttcctcactgactgttggctgggggctgcccactgttccatgccacacgggcctcttcatagggcagctgctgtcatcaggttgagcaaaggaggagccagagagagagagagcaggatcgcagaagtcagagccttttgtaacctagtgttggaagggacagccaccacttttgcttttttccattattaagcaagacactagggaggaggttgcccaaggacctgaatgccaggagacaaggggatcaccggaacccatctgggaaaactgcatggtgggaggaatagaagacgctctttagctcagacctcaggtcctttacagccaggtagggaggattcctcagtagcagcagtggggtgtccaggactgtgtctcacgtgtctttaacacaccagcatcactttagctccatcattgctgtaggtaaatgagcctcctttccacctaaaaatgccctgcaacccttttctgaaatttcttagacagttattcatctttaaaggattattttcttctgcaaaagtttttgcctttttgttttaacacttagaaattaacatctagaggccaaaattcagaggaaaatggggacagcctatgagtaagtttctaagaacgcatggtgggcagtgaacatgtgaaacagttatgaggcagatctgctagcaggtgggtactgttgaagcttgaaagtagaaatactttggttgtttcccacaactcctacttggtggtggaagcaggaggcagggggtgatttgtccttctgttcttagttcagtccttagaccagatacgatgagattcaaaggttggcccttttaaaagaaatctttttgaaaaaaaaaagttaaggatttcatggggggatgctggttagaaaggaagagttaagccactaaaatcacggcccctgggattgtttttaaccaccaaatgctttctgaaactcacataattgatgcagttccaatgatttatttaaatacaatctgagtgtgagaatggtggtcaaaatcctggtggttaactaattttgtcaattaagacagccttgtaaataagtacaaagaggagctgatgaggctccagagacccctgggctcaaaataaatggaaccgacatcattattatggggaaggagctttttgcaaatctgaattagtgattacaaatatgctaagagactaagagggcctaatgagaaaatgctgcctgatttttaacaggtgcagttcagtgttaattattgattccaacatttcgctagatgaagagcacctatgttctaaaagcaaaatgaggactcccagcagaaagcctttagcctgcccctgtggagtgcagatgaccaaagtgattttgttgtatcacgctgagccgtttctggagggaaaaggaaatggaatttcagtgtgtgggacaaaaacctaaaatatattttgctttaccaaaaaaaaaaaaaaaaaaaaaaaaaaaaggccaaaagcggcagagggccacacatttggatgcagtgtgctggcgtggtcctctcctttctggttctctggtggagaaaggctatggctgtagggtggggcggcctgggaggttggcccgctagttgcagaggtggtcagcctaggttgatcaagggcttttcacaacagcagtggcattgaacgttcattttggagatgccagaaactcttagaaattccactgagtcccaagggcttccgggacttgaaaaggaaagacacatttctcatctcctgggaaggttccttcagttacctaaggcatcatcttcgctaatgatgtgttaagccaaccccaggtcctggagtcactggagctcaaagaggctcattcccacctgtgggcctcccccatggggagctccttggctggctatggcctgcgtttgcctcagagagtccttgttggggcctgaccaaggcagactttggggagaatggtccctggtgttgggttttctctctgatattttcttcgttacctacgtagacttaaagaaatgtgcctctgggttgggcacagtggcactgtaatcccactgctttgggaggctgaggcaggaggatcatatgaggccaggagcacaagaccaacttaggcaacatagtgagacccccatttctgcaaaaaatttaaaccattagctgggcgtagtagtgctcacctgtagtcccagctactcaagcagctgaggtgggaggatcgcttgagcccaggagtttggggctgcagggagctgtgattatgcctctgcagtccagcctggatgatagaggaagactctgtcaaaaaaaaaaaaaagaaaaaaaaggtacctttgcacatttgacttcagggaactatattgttattttcattcctcggcacttcctcaaaagcaaagagacctaattgaaactcagagggcctgacatctaactgattcattcctgactcctgtccatttgccactttgctttattttatttttattttttgagactgagttttgctcttgttgcccaggctggagtgcaatggcatgatctcagcacactgtaacctctgcctcccgggttcaagcgattttcctgtctcagcctcacaagtagctgggattacaggtgcccgccaccacacccagctaactttgtatttttagtggagatggggtttcaccatgttggtcatgctggtctcgaactcctgacctcaagtggtccaccctccttggcctctgcgagtgctgggattacaggcatgagctactgcacccgtcccatttgccagtttatttaatgaagaagcaaaatgtcaagttttccaagatacatttttccagaaagcaaatacctgaaaaacttcttcaaacaaatgtgtgttatttctgcaatttttctttttcctttataattctgttcattccataaactatgattgtgctttggtggcctgtccatctcattctttctacccgtttatggattgggcacctcggcagccatcccctgcattacagcttgttttgaaatggcatgcatgtgcggcctataaagggaggagggaagacaaaaaaagcaaaacaaagtcaaagagaattatgaaatgtgacagaaagctcattttcattcaaatgaccaatagaactatttggaattcggcagttcagtcttgtttatcaaagaacccatgctgagccatccttaggtgattaagaatcaaattattatttttaaagtgcatgagcaaagtcttgctggatgttattaatatgtgattgatataatagtaaaggacttgaatcataactctatctccctaatcatacttattcctgggcttttgcgtcagtcttgaccatgggcaagttttttcagctctctgtgccccagaatcccttgccttaaaatgggaagattggctgaataatcctgatcccttcaggctctgagaaccataatttaatagtatcaccatcgtgtagcatcagccatttctcttcttaaacaacagcacagattttttttttttttttttaataaagaggttaccttcatggctagatatttcacagggctcaggacagttattgcaatttaatgcagaaaagcaagaagctggctgagataattaatagaccacctcaattctcacctccttcgtaggtaattatttaggcatagggggttcttaaaaaccatcttttatgccacttcgaagtgcctgcatagaccaagagagatcgcaggacagagggctcattcaacgtgactgtgaaattggcacagaagccctcagcgttgggtattacaggggttcaggttcccctggagcccctcagcagagagtaaagcattattgagcatgaaccaagtatatttcagatctaagaaaagatgatttttaaaacttttgttataatcactactaaactggttgttttgaagcataggttaattagatttacattttctaggttagttacttagatgtcattttaaagactttttgatgaaatgttatgcttaatccacaagtatgtttagggggagaaatcatgactaatgtacttatcagcatgtttatactttatggagattttttttcagtgaagacatttcagctttaatcccacatcaagcagtctttgatgaggacacaggtatatgtttgtattagccaacgtttatggactgctcccctgcgtcgtgacttaccaggtgcctcccatggagcaagttgctcagtccttccacagcccaaagaggcagacactgttattttgcccttttacatttgagggcttgccctacccctacctcataggtggcacagctgccatttggacctacgtggttttgcaccagaatttatgctcttgctaaactgcttgcttcaaatgtagttccgtgttttgtaaaaacactgttgctgttgaatgagaaacataatgaaagtaatggctccccaaaagcatgcaaagatctagcccatggtatacagttgagagcaaagttggggatatgatgctgttctttcaacttccaagacctctgtgggttatttatttgtttgtttttgagacagagtccctctatattgcgcaggctggagtgcagtggtacgaacatggctcagtgcagtcttgacctcctgggttcaagtgatcctcctgcctcagcctcctgtgtagctaggaccacaggtgcatggcaccacatttggctaatttttaaattttttgtagagacggggtctcacttggttgcccagactggcttcgaacacgtaagctcaagtgatcctcccacctcaacctcccaaagtattggaattacaggcttgagacactgtgcccagctggttatgaggtttttacatttattgtggtaatatatgcataacataaaatctaccatttaagtcattatcaagtttagtaggcattaattacattcatggtgttgtgcaaccatcaccactattttcaaaactttttcatctctccaaacagaaactttgtacccattaagtagtaagtactcatttcccctcccccactgcacctggtaacctctaacctactttttgtgtctatgaatttgcctattctgtgtaccttatataagtgaaatcaggatatttttccttttgtgtctggcttatttcacttaacaaaagtccatccatattgtagcatgaatcaaaactttattcctttttatggctgaattatattccattgtatggatataccacttttttttttttttttttttaagacggagtttcactctgttgcccaggctggagtgcagtggtgcaaccttggctcactgcaacctccgcctcccaggttcgagcgattttcctgcctcagcctcctgagtatgggattacaggtgctcaccaccatgcccggctaatttttgtatttttagtagagacagggtttcaccatgttggtcaggctggtctcgatctcctgaacttgccatccacccacctcagcctcccaaagtgctgggattacaggcatgagccactgtgcccggccccacattttgtttatccattcatctgatgatgatcacttgggttgcttctaccttttggctattgtgaatagccattgtagcaattggtgtacaagtatctgtcccagtccttgctataagtttctctggtatatacctaggagtggaattgcaggaccatatggcatttgtctgttttgcaaaagcaaaaatggggaagatcgtgacatttttaaagagctaagttcaacaggcggtggatgtcctgccgcagccacctttgtgagcaccgacaagcaacgggcctctaagaaaacatggcttgttgtaattcacttcccacctcctctggagagatccagtggttgtttaccgagcagagggaagagtttctgccactggtcccgaggatcagattgcccggccctgttctctggacacctcctgaaaagcaaacttcttgtatcaatgttggagtttaagcattaacaggtgtttgcctccacatctgcatggtggtgagcaacagcaggtacctctgtccttgacatgcaaggttagttggcacaaatgctttcagaaaggatggcttcaagtcccccaggcacctgctgaaagtgggggactgggatgggagaataagattttatgcattttttgttttttgttttgttttgagacagagtctcactctgtcacccaggctggagtacagtggcatgatctcagctcactgcagtctctgtctcccgggttcaagcgattctcttgcctcagcctcctgagtagctgggattacaggcacctgctaccatgcctgactaatttttatatttttagtagagacagagtttcaccatgttggccaggctggcctcgaactcctgtcctcaaatgatctgcccgcctcggcctcccaaagtgctgggattacaggcgtgagccactgcacctggcagattttttgcattttaatggcaactcacctgttgaatgaactgatctgttcatggggtgggtgcctctgtgaaggccaggattacaagagattgctgtcttcctgggaaaattgggtgctgatactggcgggagaaaggcttgggaatatctttctgatatcacatggacacagcgttctacctggcacagaataaaactttgtatcaccttctgcatgtttattctgcttgttatcgaacacctgagtatttggaaatgtctggatttttttgcaatgtggaaggtaaatatccaggtgacagcctgggtctttaacctttcacccttcacctttcactgcggtgttttggtgtcaacaaactaaatctacattcccagttgtcacctgagggtagcctgggatttaataggcattttgggggaatgaaggtaacagaagaattccgaaaaacctgtctgggccaccttgtgtctttgtgtggatagggtgtggaatgttcatggaatccgcttcttgtattatacttgggagtttaggccattttgcttcagtctgctttgtttcaatattgaaatgttattttaaaaaagtctttagtgaacatagttttgaagtccatgctctcctgttctgttacttggcagatgaaaaataatgatgaattccacaaagatttggccatgagcaggaaagaaaaagagtcgtgcttgtgttggttggtgcagaatttcttctctcactggcttttgtgtttgttttgccagatccattggttctgcagggggtagctactattgaatgattatctaaggatctgttttattatacttttttgttgtgtgtgttgagatttctgtttgtttgaaaggtagaaataagaaaaaagtaggcaatacccataatcccactgcttaattatataaagtacattgctaacaatttggtatattttctttctgattttagctgtgtttatagtcaggcttatactttcagttttatatgcatctttagggtggtaaatgtgtctgcttttttcttttttttaaataaattggaatcatgaattaactgtttttcatttatcaataactgtttaatgataccttaccaggtctgaacataatacttcattctttttatgactatagactacgctgtttgaatgaactttccatcagttcatacaggatgaactatgcattcttaatgtctctctccttgacagttttttgctcttacaagcagtgcttgaagcagcagttttgttcatgtgccttgaagtaattgtgctattttctgtgggctagctttctagaagtagaattaactagatcaaaaaaaatgtgtgctgctaattttaataggtaccagcaagttattttacacaaaggtttttctcaatttatgttcccattctcaattggaatcttttatttccctacacattcaccaagtactgaataacattgatccttctaatttttgttaatcagctggtgaataacagtgtctcattattgttttaatttgcatttcccggatcgttaatgaggttaagcatcttttcatatgtttattgggtatttacattccctcttctctgaaagcaaagacggtgtatgtgcatttggcctaactggcaaaagaattgtagcactgaaaatctgaggaatttagaaacacgcgttgtatatattacgtcggaagagtggtttctttaggtttattctgaatctccatatggaaatagagtaatgaaaaaaaacccccaaactttgtgcttttgtttgccatctttataaagttaactattgtagtttcttagcttgctattaagcaaccactaatcaatggtaggatatcccctacaaaagtgtccagcagtcccactgttggtggatttaagagcatccatttggaaaatgctacagctcataaaatttgggtcaataaatcaaatactggagcaatggtgtaagaaaataaatattaacagcactgcatggggcaatattgatctagtaccaagatttctggatggacagaaacaccctgtttggtaattgtgcttctcattgtaaaaacatttttataaacgttaacttattaatatttgtagtgcatctccaggaagtaaatattcagagagcacgtgctcttgaagagggatcttgtatggaatgccatggccccagtgagagacttgagctgaccatatcccctggggttaaaaaaagggagcagtgagccaagctgcatatgccaagatttaatgtgtcagccgagtcaggcgatgtcccctccctgtgcagttcaggttcagctccatttggaatactccatgtgccaaatctggatccaggcacaagaaagacattgacagtttgaatggggtccagagacaggcactagccgtgattaagggcttatgggcatgacatttgagcgggggctcaaagaactgaatatttacagcagggataaatgctggattacatggcttggtgacgtggggacccgtggctacatccctaagttacctgccacatgactggttccccgtaggcaaagagagaatcatttctgttacccttgagagcttgaggtgaagggagggtctccttttgggtctgtggacctcaagtaaaatcaaggagcttatacctatgtgtcccatgctcttagcataacgatgccgttgtagcacccagggatccaggatttaggtagggaattctcattgcgctggaagatttagcatccatatctcctcctccttcagaagacacattctgcatggaaggtgcttatctctcttaaggggagacgcgctagcatgttgtctgggtcctgttacaagtctacggctcaaccaagagcagaaagcgagtctttgtcatacagtaaagactctccactgtcgatcagatgcccgtagattcatttttctgccagacattttacctgcgacagtgaggatcagtttcccatcaccagctccaggctgttagactctgaaactaccttcgtagttgtcgatgactgcagcagcccagcaaagtggctgaccagaactatcttaactcactgcttgtactctgttaaggaggaaggaggccaaccttcatccagtgatcctttctaagactgtcagtgatgagcagcgacctcgttttagaactcagcagcagtacctccaccctgcagtcatggcttgcatagaactgagtggctgacatgaaaaccgtggcactccagtgtgctcttcgcatctcttaactctgttggcaggctaatcactggcgctgctttgcaaagtggacagctgctctgccctcctgtttttatagtggagtggttacgagatgattttctttattctctagtttcttatatcactcatgtgcttgcagatgctctgcctgtatttgttttttatgtgattaacccaaaaacacttgcaatgcccagggcatggctcagaaggtcagttgaaattcctgaaatgatagctaaggttagtaggccttgactgtttattttttcatttcgtttcactggagtgccttgtccaaaacacctgtagagaatgacttggattcagatagaaatactaaagcctcaaaccctgaagatacaagatgttgcattttgtggtaaggaaaactctcgcaagtttgaaaatttgagtctatggaaatatttgaaaagcagggggagaacataagaatggcgtctctttgtgtattgatggtaccttgggtaggagtcacaacagctgattttcacatgtgctgcttatctttgaaaagtctcaagaagtttgtgaacggacggatatacaacttgagttttgtaaggattcattgccgccatatttggaattctgggtatttctctgaggaacatgtatatctattcagccacaaccagagatgggaagggcagactgatgttcccagctgaaacttcttgagacatccagacaacatctgagaactatgagccccttaggagaaatgaattagctacggcagcacagagggcttggagcagtgcctggcatatagtaaatgctcactataaatgttagttctacatggttctgtgatgccatagaggctgaggcttcctagtggatgggcaaactggtagctcgcctgcccgtggccattggtaccaggctggctggtgttcaggctccctggccagttggcctctcctagaggagccctcaaatccattatggtaacagacccacgctgtacactgccgaatactcctgcagatctgaatatgtcaatatttgcttcacaggtgttcaccatgatgatgatgatggttttcatttctcacgattcttaatgacagttatcaatttagaatttaggtgattcttccatacctttcttgcctccttcagcttctttttaaatcaagaaagcacagtacttggtattctgtgctaggattgttaaataaccgcctttgctttgatcttttcaggtacgaaaccagcactggagcctcattatggaaagtgtggtcccatctgacaagggaaattatacctgtgtggtggagaatgaatacgggtccatcaatcacacgtaccacctggatgttgtgggtgagtttgcctctcctcgtgtggcggctgcataccagcccattcttgcttgactcgtttgaaagcatgaacgttaagtcctgtttctcccataagtttcaggagaattggttcattcttattctttctactatcattttacaaggctgcttctgtcatctgacaatattctgttttccaggcagccagggtttatgagctttgcatgatcctcatggttcccaagcgtcatctgtgtaaagtggacgtggtatgaaatgtctgacattttggaagctgagattactctgaaaatgttaattgggcaggtgaaaagggtacagatgtgctgtagcagacctttggttttaaaagagaagcatcatttccccaacagggcaactgtagaaggccagctgaagagtaaaggaaaaggtctgaggactgagcctgtggctggctggaaaaaggtgaatgttgagggcccttcacttccatcacaagaaagtcattagacggtaccaattcagtgtctgttcctggcatctatttcctctgtgcaaagggaaccatgtatatgagcttataaatacatttttgtcagagtgcacagataagtaggccattttaattaaacattgaagaccacctcgcctgttgtcttggaaattcaagtttcttcccaggttttgcctgtgatgatggggctttgttgtaactaatgaagaaaggaggtttctgtgtcttggaggattgctaacatatggaactctacccaagacatacttcattgttgcaggatggcaggttaagatcccttccatgtaggggccatcttttctctttcctgtcatgtgccttgactttcaacctgccaccttgagccctttcttttggtttgtcctcccctaaatacaggttgctatcttctgctgtagactcaactcagttcacactcacgttttgccgtaatgtgactgttggtaattccacaagcccacaccacccactgtgcctctgtaaacgaagtgtctcctacatcatagcctgtgcgtgtgtgcctagtatcatctcatgtgtgggtctccttcaataaaacatctttgaagagggagaccccgttacatattggaattgcccaaaaagccactaaaaaaataatccaaaagcttgattaaccaaattgcaaagatttggttaattaaaattttaggttaactgaaaagtaaacaaaactattttgattttctgtcaagttaaatggaattggatctacgagacactctgccttagaaagcatgatataaccattacttccatttgcatataagcattcagggaaaatagtgtttattcgaagatttgagttttgttcttcagaagccttcatgtgaaatttgataggtccttgaataatgttgatcctatagatattcataaaagagtgagttttagagctctttccccatagagaaaacatgtggcatgtttcttagtgagaattaccatgttcagatattttacaaaacaaacaaaaagagaagtaacactcaaatttgagaagaaaatgattaacatttgtgttggcattgatacactgtaaatccattgatcaaagagcatatgacttggcctttacctgggttcctgtgtgtaccgaatgtgacgtaaaactatttctatttagggaaagagagattttgggctaaatgttctaaatacctaattttgaaattaagtaatttattgtgggaaaaaataattgagctatagcagtcttttgggattatagctttgcataggtctacaaatcattcattaggctgggctggggccattctaggcatcgtggagtcagatggcggccactccggtctgggctcttgcttaaagcaagttttaggttgagttgttatgtaaaacattcaaaagcccctcaccccacctcccctttgagctttctggcggctcatccctgtgaagccctgaaatctctcttagagtttagggttgggatttgaattgggctgctgaataatggaattgtgctgtctaatgttaatcccctggcaatcagtcttgttgaaaagagcgtatgattcagtggtgtaatgtagagagagcgtggagtgtatggagtaatgcagagagaggcctgattatgtcacaaatttgggagatcgcccagctaaacacgggccaataatgacacaatgctggttgggaatatccattaaagctcaactccaataattttccaagccttgaaccttctttataaatagaagccaaaagtcagtggagtaaaaggcattttcagtaaagatggaagtgtgaaatactctcatctctgctcaaaaccctagtaattgctttgcgaagcactaataaaataagaattgagtcagctaaagaggctcatatagacgtacagggttggcagtcattctgaacatctcagcaagtggaaacaaaaaggattcaagcttaagcagtgaatttctggtagcccacaggcccaaatgtgatacactgctgtgtgataacagcttttcagccacctctctgtttcacagaaaatcagaaaccctttcccagtgaaagcgaagtcccattcttgcccacattctttggggttttatttttgtttctatgatacatagattgtggttcagatattatgaagcatcaagatgggtgagatctttttattgaaattcttccttggaaaggcattcccataagcactttaatgtaaaagccgtgtaatttaagtgacattcttgtgttctagaattaaacggcaagccattgttgtgtgtaagggaaatgctttcatttatgggagcccttttaggagcctggcttgatcctcattaaaattgacaccattacttttcagctatttactgcaagggaaaattagtgtgatgctccacgttttggtaattgtggcgataataaaatgggctcccctaaagtagctgtggctccgggaggtggcgagccttcaccatcgttcatcattgagtggtaccagagccctggattctgactgaggtcctgtcactgtgaagctacaatgctgggatgactcattgcactttccttgtgtccaaaaatgaaggaactggaactcatgaatgttagaacaaaaaaagcggcttatgccgtggaatgaacagcaggtttgtccgtggccatacctggggcccctagtgaattgggacaaattatttagcttttctgaggctctgttttatcatcagtaaaatcggaatgatgatacttacctcattcctatgatggttgtattaggtttcctagggtacccctaacaaattactataaactaattggcttaaaacaaaagaaatctattctcttacagttctggagcctaaaaattcaaaattaaggtgttggcaagttccacgcccctctcccagcttctggtagctgtccttggcttgtagaggcaccgctccaatctctgcctccatcttcatgtagtcatgttctcactgtgtgtctcaaaatctccttctgtcttcctcttgtgaggacacctgtcactggatttagggcccaccgtaaatccaggatgagctaaccttgatatttttaacttaagtacttttgcaaagacctttttcttcaaataaggtcacattcctagtttccaaggcttaggacgtggacgtaccttctcaaaggtcacccttcagctcactacattagttacgaggcatcagttgggttagcagatgaaaacatcaggctggcaggtaggtggccagcaacaaatgctggtttcctcccttccaaaccaggattcttttgagggttagaatggatctttaatagcttttattagtctcaatcagaagtcttattaaacaaacagaatgccattttggggctgggcatggtggctcacacctgtaacctagcacttggggaggccgaggcgggcagatcacctaaggtcagcagttagagaccagcctggtcaacatggtgaaacctcgtttctactaaaaatacaaaaattagccgggtgtggtggtgggcgcctgcaatcccagctactcgggaagctgaggtaggagaattgctttaacctgggaggtggaggtggtagtgagccaagatcatgccattgcactccagcctgggcagcaagagtgaaactccatctcaaaaaagaaaaaagaaagccgggcgcggtggctcacacctgtaatcccagcagtttgggaggccgaggcaggcagatcatgaggtcaggagttcaagaccagcctgaccaacatggtgaaaccccgtctctaccaaaaatacaaaaattacccaggggtggtggcaggtacctgtaatcccagctactcaggaggctgaggcaggagaatcgcttgaacgcaggaggcagaggttgcagtgagctgagattgtgccattgcactccagcctgggcgacaaagtgagactccgtctcaaaaaaaaaaaaaaaaaaaaaaaaagccattttgggacctacagacgtggccagaggctgacattgacatttcctgctgaggtttccacctttgattaatgctgtcatcaaggccatcctgagactgatttggctgttggacttgcaggagaggggtgtggagtttgaggacttgaagttcatggagttggcttctttacgcccacccctcccctcccccactttgcagtggaggaagttcaggttcagctggggtaagtgatttgctaagtaagggcttggagcaggcattctggagctggggcctccatctgggtgttctccacgcctatctgtatgaatgctccttgctctccaagcggacttcttcatttgatgttcactgtggtgtgtttcagtagtgactgccacagcccgactctaaggaggtgctgctgtcaccccaccctgctttcagttctttgctgcagaagacagaatgtgcgggagaaagatgggaccttaaaagactagttgctcttcctcactcatgtagacgatttggctttgaatcgtgaattattgcttcttttgggcattccagttctgcatttccagagaccctcaggtatgtcaagctttttgcctggcatttgatattttgggggcaaagtacagtggaagtggaaatggtgcctctggttttgtcaaggccagatatgtcttctctccactccttgtgttttttgagacagagtcttgctttgttgcccaggctggagtacagtggcatgatcttggctcattgaaacctctgcctcccaggttcaagtgattctcctgcctctgtctcctgaatagttgggattataggcatgtgccaccatgcccagctagtttttgtagtttttagtagagatggggtttcaccatgttggccaggctggtctcgaacacctggcctggagtgatccgcccgcctcggcctcccaaagtgccaagattacaggcatgagccaccgtgcccggtcttttatcagtttaactttccagaaatttgttccccctgcctgtccgcatcccttcaaatgaaagctgtaagcagcaggcagttgttgtttgggggcccatcagaggccgcatgtcacttctggatgggtcaggcatcactaccagccctgacttgatggcggcagatcagcatggcactgtcaactagcccttgacataaatctgttgtaactcagccccagacatgataggacacagcctgaaagcgcacaggaatccgtaccagagcgaagtcccccctcaggtgtgtgttcaagaatgaagcgtcttttattccaagcactgactgataagctcgaatgtggagttgacacctggaagggagttttgggagcttttggcagcccatccccagtggaagaaggaggaatggctgaaattgttgactgcttggggcagcctctgtcccaggaagacaaaggctccagtgtgatagctgagctggggccaggggacggaggcacggcggagtccctcaaaccacagctggagtgtgaagtttggactgtctcctgggttgggaacaaagtagtggttaagtaaatgaagaagcggtggcctagttaattaattaacctgttaattcattactgaagctgtcaagattcagtcattcctgctcacttgctcgtgatggaaggctgcatctcagtctcggcttccatcacactgtggcttctggatggaatttttgtttctgtgtgtgataaggagtggctgtggtggcatcatttaaatgacatgattctgcacgtccagagacgttaggatattgaaagcctgaccattaccttttaggttgtcatgcttgtacctgttcctggcacaaggtctcggctccgtagagccctgtggggttctgaacttgaagcctcttgacttagaggcttcctggccagggctcatttgattttccatactcctgactttgctgccagtgaattcttttccatttcttgctctgagtgtaagacttggtgtcctaccctgacacgggctctgcatgccagctctagagttgcgaaatctcaccggaggggggcagaaagcccctctgttgagaagggattggggtggcgtgccaggtaatgggtcacagcgacagcctttctaagtgggcttatttagttgacagatcacggaaccggagcggagttgaggaggaagcaccttccttttgccgctttcgtgtccccagcagccatctcatcctgttcttataaaccatcgctgtcacagacaacccctaagggtctctactctgtgccagatgccctctctggaggttcaggtggaaattacgtggagaggggtgtcaagttctgtttccacccttgctaactctatggccttagaaaaggcatggaacctctgagcctcagtttccttgcctgtaaaatggggtgatgactgtttccttgtagcactatggggaggaggaggtggtaggagaggcagcgcttttaaataatagtaccatgcaactgttagtcgttattgtgcgttggtcccatacttcctcttgcatctccagacagagccgtgcaccctgagcccatcctgatgaaaggaggggtcagtcctgtcctttcctccaggatagagatttcaaaacttcctttggtagctactgtttaatgagcttttgattgctacaaagcagcttttcattcctgtttcacaacagggatcccggggggcaaaggctggttagtggcagctagatcactccaaacgtactgactggcaaatacagactctcccgcagaactgaccccagcaagaagcctttgggagcaggtggtattctgcgggtgccagctccctggggtgggagcaggcacacgccagcctggatggggcatggtagaactctgcgatgtcagcttttttgtcacattctctgcaggctacccgttgtcctttgccccaccattgaggaaggaagccttattgattgctttcgattcttgcagggggcctgggtgaggtggctggagagagggctaatatttggtctggcatttaatcttggcatttcatttatggtgtgggcaaagaggatgtagaagtgttaaaatcaagttaatatcttacagttttatgtaagaagaggttacctggagattcaggtgaggatggggcagagagaaagctgcttctgtcagagcttgggcaaataaacttgccatgaaatgtcaatttagtgatggcagtaagagtgtgcagtaatgtgctggaacttagcgaggtttctatcagcgtgtgctgaattgaaataatcaaaaaacagtttaataagttgcttatatttggagttttgtggttcttaacattgcaaattctgaagcaagaaattagagtttctctctaaactcatttactcatgtggctttatcaacggctgcctttgtaaaccgaaagacctcagttgggaagttttatgagacggagtcttgttctgttgcacaggctggagggcagtggcatgatcttggcccactgcaacctccgtctcctgggttcaagtgattctcctgcctcagcctcctggtagctgggattataggcggacatcatcatgcctggctaatttttgtatttttagtagagatggagtttcactatgttgcccaggctagccttgaactcctgacctcagatgatctgcccgcgcaggcctcccgaagtgctgggattacaggcatgagccaccgcacctggcctgccaactcttgttaagatgtgagtgtggaatgctgtgtgttcttccccttttaaaagatgtgtctgttggtttgctttcacggattccctctcccttaggagacccggctgttgtattcatggtcttcatgcttggtttgttttcacagtcagagaaggtaggatgctgtagggttctacctacaggtaggatgtgctccttacttagagatttggaagggtggcatcagagaaccactgtgcgtctttcatgatagctggtcaaatgtgggtgtctgtgggaaatagatggccaagggtgtcggtgttgctgtggggaggttgttctgtttcctcttctgagaagagacagatgaggcgatgaggcaatgggagcctcattgctttggcttggagggagaaaatagagcagagctctctagctgggattttgtgtatttgctgagttgcagtggttaattctctatccttgaagcacgtggcacgctcacgcagcctttatgtggtcgagagggtgacagtcacttgaatgaggtataaggctttgccctcatggagttcctcaggtcacattttgaggtcgaagaccataaattgggatggaaatttctagatcttgatggaactccaactttttctctctttctcaaagcctctggattacaggattctctcaaacaaggctggcaggaattctgtccatcccaaataagtatgcaaatctacaggtcaaatggtgccccagacatattccccactggatcagggagattgtggtcttttgagagacaaacattgaatattattctagtaggatcttttggaaattatgctctattagaaaaaggaacttttcattttactggttcagtgtacactctggactgaaactgaaaggtaaaggacttagccctttaaattttacattttggccgggtgtgctggctcacgcctgaaatcccagtactttgagaggctgaggcaggtggatcatttgagatcaggagtttgagaccagcctggccaacatggtaaaaacccatctctactaaaaaatacaaaaattagccaggcgtggtgttgtgtgcctgtaatcccagctactcgggaggctgaggcaggagaatcacttgaacgtgggaggcggaggttgcagtgagctgagattgtgccactgcactccagactgggtgacagagtgagactccttctcaaaaacaaacaaaaaaaattaaaatattaaaaattagccaggcgtcatggtgcacacctgtagtcccagttattctagaggctgaggcaggagaattgcttgtacccgggaggcagaggttccagtgagctgagattgtgccattgcactccagcctgggcaacagagcgagactccatctcaaaataaataaataaattttacattttggactgaaaaaacaaaaccattctgtatgtgagactctcaccgagtgttcatagggagggactggggctggggcctgacttgaggcttcccatctggcttggacagtgagaagagcagtggcgtttggattgaaggcttttgtgatctgggtgactattttgaagtttctctttaggtcatgctgtacttagaagtatctagaaccgtgattattttcagtttctgagtttcatctccaagaaaacaaatgggatttattgttcagcctctcatgttattcctatcaaagggaggcatttcttgtttgctcagatgggctgaaagcttttacttctgctcgaaccgccctaggagcaaaacaaggcatgtgagagagatgagcatgatagattttctagacttctctagaagaaaggctttttagatggtgaaggttgatgaaacctgccagcatttttacaatggacatccctctatgtctgcacatctcaatctccttcattcttactagtggccaatatgctcttctttcacggatgtagtacaattcgtttaatcatattaaacaatatgattgttgtgcagatcttttgttttccagtaaaaaaaaccctacagcgacaagctttgtccacacttatttattgggcatctgtgtgaatatttttctaggacagatttgtaaaggttggttaactggatcgtttttgatagatttcagtcaaacgttttaaagctaaggggccttacttacttggagtggttgctgtctttgacggagggctcccctgtggtttggtttttagcttctttgcaaatcatttgagagaagatactctaattgggagttcacccattgtaataagagggtatacctaattcctggacattaaaaaagaacaaacttttccagctcgaaggaaacattttcttcccctgaaggaaacccagctatgcagacaccagctgataatcttgcattcctgaaagatgttgcacccctatggcaagtggcggctgctgaggctctgacgtgactcccaggcatgaacgctctcagctgtgtttacctcagctcctcgggagggagcctgggagactgacgcctgagttttacatcagtgtcaaaacccaagcacaacctagggagggacctcctgcctagtgtgtgtgggtcaggagatagaaaagctctcactgagtaaactggacaaggtcaatatacatcgctgattgagaaggtaggttttccatgaccctagaaattgatcttgttcactctgagatattgtcacctttgttatgtctcctttttaaaaaaaaatgtggtaaaatatacataacataaaatatacctctgtaaccatttttgaatgtgtaattcatttacattaagtacattcaatttgttttgcaattatcattattgttcatctccaggacttttccatcatccccaaaccatgactccttttagcaaaagagaccaatttcgaacgtaaatttggcataataactctctggttaccaaagaatcttcagttctggtgaaactttttgaaggcagagagctcagagtgtcttaaacacttggggtgtaaataacacacagccctactcctgtaattcgcccaagaagacccaaattgatacccagctggtagaagccactcaaccccaagccaaataatacagcctgtaacattaattagggaaggtactaataatacagcctgtaacattaattagggaaggtactttgcctccacctgctttggtcttcccaggccctgagcccagccagcactttactctcttcttcacttcatcgagcaagcacaaaggcattagtggtgttttgcttctagcatttcacagggtgcagcctccataagtcactttgtgactttagtgctggagggaggacacttcatttttacccaaacaagtttgttccgcagacttcactctctctgcaaagagacgtgtgtgttttagaggaagtgggagccccagccgattctgcaagacttccgagagtcagatatccagacggaagatgcggacacctgggtgaccagacagcgaagaggaaagaacaaaacgagcatgtgccaagcctgtgagggagaaagggcaacaaaccagtgaccttccacagaaatgtgtttaaacaaaacaaaacaggtgattctgggtgcccagcatcccagcccactcatctattctaggaggtgacaagccaagatactggctgtgggcacctgggctctttctgaaggtggtcttcctggccgtcatagcgttccctttttctgctaatcatttttagttctgaccttcctttgtgctgatcttcagaagctggagaaagcttcgtatttctgggaaaacaaaacaaaactcagaacccaacgagatttagcctgtcaggcttgagtgcgttaggtggagtcttgacaaggcaatgaactcattctactaattgtaattagcgtggggcctttagcaagttctgggctcctcagacttcagagagctttgatcggcctcctcctcctcctaataaccatgcctcatgctaactggtttagtgcgtttttatgcaacaaaagcaaccaccgcctactctttagaaaaaagctaggcaggctttagaaaaagaattctcagttgttttcacttgtcctccaaatcgcagaatgttctttcccttttcagctctttggcgttgctaagagactgccattttggaggaaaggtaattaaattttgattttaatttaaagacagagcaagcgaggttatccacgctccttacatgaatgggggcctgagagcaggagactggctgtttccagatcaatactgggaactccgtgtgattcgagtctcttggtgtgtgactgccggagagaggtggctttgaaatggctctttgtggcaagtactgcctaacttttggggagaaatgctcaggagaccagtgtgagccgggaaaccagccactctgtgcttgattaatttataggtgtaatttaagagcctggttctccttctgatccccgggatgcatgtttactgagcctgtagacatgaggcctctcggctcggtggacattttttatggcctttgctatgtcagagcaaaagttgtagatctcttatgagcaaacatattactatgtccagaggaggactggcatgttataaaatttcaatggtcaattaacaaagatttattctttgtcactcaggtatttttttcctctctctctctctctctccctcaataatgacctcttggaaggaagcaggctgtgctttcctgctgcagtctttaggtgggttatggctcccagctacagagcagggcttgacagagcccatcctgatatttcaattcttagcagctgggctttctgctttagtagagtggacacttgaagaaagggggcgagaccgagagtgagagagagagaacgctgggagagaatgtattttttaaagcacttcagcctgtgtttactacgcgtttatttggtggaacctcattccagcagtgcagccaactgtcccggcagcagtggccgcaccctttggactgctttccattccgtcttaatttggaattcacacagccaccttccaatcactcttttgaaggttctcatcttgttccaggtccatgcactgtgcatttgcaacctgctgaacctcagaacgtctattcttatatgtgtatatatgtaattaaaattacagtaaacagaggagctactcatcagcctattttccatgtgtttatctcactccctttgtaaaaaggaaaatctgttttatataatatctgagagttaaacatgctagaagagaatcttgcctaaaactgtaaatccttcctgtccttcctggtggagaagatgtgatttttgttatcacatagaagaagagatgaactagcactgggctttagtctctcgcccagagataatacatcaggggattctttttatatcagtttgttgcaaaaaagttgcaaacttgaggggtttggtttgcccagggaccggggaggttcctggtggggagaacacatgagctctttgggtcatcgtcccctttgtctctgccgtagtgcccgctgggccaggccacgaagggggcccccactctgcccagcctgcatcctcgtccaccatctgcaccctgccatcacctcggtttttcagaagttaggaaaggagtccaggcgctgtcatccacttactgttcactgtttctgaggttcttagggattccgaggggtggtggatcgctgaagggttcgagaggaggagcgcagcgttcggcagatgctggcatcctgggcccttttccaagacgtccaggcctcctcctccgacttgtttaagggcagagaataaggttgcaaaggaaatcaaagcctgatgtggagaaatgaaacatgagacctactgactttttaaaaacattttaaataacattctctaaggtttcattttatactgaaggcagctgtaataagtttggaagacagtgtaaggtttctattacagaacaatcctgcttgcagtttttctaccagaagtgagaaagggcggagggggagtggaggtggttaagaggttattttgtataaggtgagaaaatttgaaaagatgaattcaagactgcaagcgtgtaacatttggtatgctttaatttgcaaatgcaataacattaaaccattgcaaacttggggtgtgtgtgtgtgtgtgtgtgtgtgtgtgtgtgtgtgtgtgtgtgtatacatagccgggatagcattggaataacttaataactggagctcagcagcactttgaccacaaggaaaacaagactgcagctctgtagtgggccctgccagtgttgcctcagtgactaaattccctgccgaagcctggcgcaggccagagatgtcaggcgggatgaaagcactcattgttcacggggcatcatggtttggtactgcatgcacaatgtttacttgtgaaacgatttattagaaacaaatatgtttaagaaagaggacttggtttgaaactcagttgatctggcttatgacatttaagattttatgacctttgtttctaagaatagatgtgtaggcccactgtaaatatttatcttaaaacgcacccacactacacacacacatgcatgtacaagtgcaaaactggaaaacggagccagggcatgaattgatactaaagttcacatttctgtgtgaaggaataaaccttcttactatttgctaggtgcataggagcatagtttgtgaccttgtctggcaggatctagcccagaggacagcttcccctcgtgctgtgaagtctcttggtaggaggcctggggaggagaggagcgtgtgtctgttcgtgcgcggacttaactctgcccttcccacatggatgaggccagctgggattaaatcagacctcggtcactgcccgctgtggacaggtccctggggtgtccagccagctgctaggcctgaccaggaggcttgctggggcccatccctgggtcattgtatgagccagagagcaagggtttcacctgacgtctgaaggggcccagctttgagattttctgcccaccaacaccagaagtcttaacttcaggttctttgctcagcctacatgggcaatataggggcagatgaatgatttctttgcggctccagtatccttatctttataatgtgaaaacatagatgtctgtaaagtgatgggagattctggaatgaaatgtgctaagagtaaccactagcactttttctttctttttaaagaccagcaacaggcttatgcagtaaaatcaatttgcacatggtctggctcttgtccaacaaattccactagatgatgttttaatctgaaaggtccaatgatgtagatatctattgttctaatttgctgtttccagcccagtgcatggggattctcaggtacagtgcagagacatccttggtgtgctgagctggctgagttctcctcatttccctcagttgttttttaacactggaggttagggtagtggtacccacacctaggggaggaagagagggaggaggctggtaagtgcaggcctgttgggatggagttgtattcatgaatggacacatgattgtgttttgtgtggcttttgacagatctgtgtaggaaggttccagtaagtttgtacgacaagatcaggtagcagtctggtggtctggtggttatttaattctttttattttatttcattttattgttgcaagaatgctaagcatgagaactaccatctcacctaagttttttttcttttctaagacggggtctcactctgttgcccaggctggagtgcaatggcatgattgtggctcactgcagcctcaacttcctgggctcaagccattctctcacctcagtcccaagtacctgggactacaggcatgcaccaccatgtctggctaacttttgtattatttgtagagatagggatcttgctatgttgcccaggctggtctcacactcctggcctcaagcaatcctcctgcgtcagccttcaaagttctgggattatgctcaaaggcatgaaccactgcgcctggtcttcaactaagttttcagtgtacaatacgttgttgttgactataggcacgatgctgtgcagcaggtctctagagtttgctcatcttgctttactgaaactttatgcctcttgattgcaactcaccatttccttccctgtcccagcccctggcaaccaccgttccgctctttgattttatgaatgcgatgaatttagatacctcatatcagtggagtcagtcagtgtctgtctttctgtgactatcctgtttcacttagcatcatggcttccacgttgtcacatattgcaccatgtcctccttcttcatggctgaatagtattccgttgtgtatatagccacattgtaaaaattaatcctttggcagacacttagattgattccatttcttggctattgttaatggtgctgcaattaatataggagtgcagatcctgattgcagttcttttagataaatagagaagtgggattgcaggatcttagggtagttctgtttttaattttttgaggaacctccatattgttttccatggtggctgcatcattttatattcccaccaacagtgtgcaggggttccagtgtctccacatccttgccgacacttgtcttttttttttttcctcccatcctgacaggtgtcatgtgatagctccttgtggttttgatttgcatttctctaatgattagtgacattgagaaacttttcatacacctagtggccatttgtgtcttggagaaatgcatagttaagtccttagcccatttttccatgggtattacttaacacttgaggagtctcatgtgtggttgctagcacaccttggcttgattgtctccacagaagttttgcagagaccgcctcttagctggagagaagcctttccaggcataagatgagagggtgtattctttgttgagaacgtgttctcgaaggagagagaggcaagacaagtgaagctaggaagtaattttgggataccatctctgcccttttatagggcagtctaaaacatagccaggagttggaaaccagcatctccttatgtttcattcagtgccatattggaataagctaagaaacatctacttgtgcatttagtaactggcatagagtaacacctgatattcatcaaagagctaaatgggtgaataaagaatgaatgaatggagtgaattccacaataaagaggtgaatcccattattaatcaaatctgttcataactttgggctttaggctttagtttaatttttaaaacaaaggttggaagtcttctcagagcatcttagaaatgtactggagccgagcgtggtggctcacgtctgtaatcccagcaatttgggaggccaaggcaggtggatcgcttgagcgtaggagtttgagaccagcccgggcaacatgatgaaatcctctttctataaaacatttgaaagtcagctgggcgtggtggcggttgcctgtagtcccagctactcaggaggctgaggttggagaatcacctgagcctgggaggctgaggctgcagtgagccgtgatcatgccactgcactccagcctgggcaatgaagtgagaccccgtctgagaaaagaaaaaaaaatgtattgggagacatgtgcctattgaaaccatttttggtattcagagtgtctttaaagttagtcttgtcatttgcctgtgatgttaagcttgtggttgaggtgagtttttgagattatctcaaataggataagtgaagaagcttccctcccctaccatttgtcacttagattgtcagagtagaatttcttcccgtattcatcaggtggcagtggacagccaataacctgggatgtaataagttcttttctcaattttctaagtaagtgttctttttacaagggtcgcgctccagcagtctcctttgaagtcgtttctgttattcatggggccacagtgttatttcaaaggtgtcagccagcaggcttgaggcttttctggcatgaggtcactgacagccctctggacaacacaacttatttattggtctctcattctcccatccccactcctcctttcttccctctctccaccagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtgaggactttctgaatctaaaggtacccacaactggggtctccttcatgggtttggccacaggttctttgatttcctgttggagttgagagaggatgattctcttttttgactagccagcagagagtgttctaaggaattaacagatcattacacttgctagtagaatttcagaagggaactatggagtaggggaagaactactaaacttggggaagaactactaaacttggagagagaatagttcagctatttatcagccctgagatcgcagacatttaggcttagctgcgcctctataaaagtagagatcatgatactctgtcccccatagggcggttgtgcagaataaatgggatggagtggatggaaagagctttgtaggctcaaggcattgtgccagtgttgattgttactctgatgttgttttctattaataggacattaggatccaattttagtagccacgttttagaaacaatttggattttttttttaacaaaaacaaaacaaaacaaaaccctgacctttgaaatccattcagaggtgatttagacaataaactctaggtcatatttatgcaccagtgaaatgttgaacaaggaaaatatctttccctccttatttcttatttgcaagcccccattttcatagcatctgcctcttttttagatctaggtttgctcttcaggagactgaggacaggggcagctaagtctgtacagctggctcttaactccttgcctaccacgcctcccatgtctagttgctcatggagaatgaatgtccttaagaagaacattcttccagtagaaccataggtgacccagctaagaactttcagccaatgaagtgttctcaccagctaataattccaaggatcaaaggcattgggaaaagatgaccaacctggggacccacccgacctatccagttagctatcgctcacaccctcctgcccttctctccaccaggtctttccgttgtccaccactggactgattttgttctttaaaatccgcagccctttaatgccgctgtttagacgtaatggagtttgttttcttgcggtgtgttggtggtgggaccatagacaatgctaagaccttcctggttggccgttatattgttctcctgtgtctgttctagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggtaacaatgctttcatttttgtctttttttaaaaagaaagctggatatagaagctgaaaagacttggtgctttgggagactgcaggcagcttataggataactcttgtggccttggtatatttataataatctttcttcggtgatgcagctggtatgatgccagtagccatggaaaaatgcccacaacgttcaaagtgcttgctccaatttcttctagagattagcctccacccccacccagtttttaagttgttccttctggttgatcttgtttaggctgcacatttcccatcattactgcacattaacaccatttaaaacacacgcttccatgcctgtttaatacggggcatttgagtatcagcagagtttgtctccttctacttcaagtttttagggaaatattggcaagatgcaatttgttcaacaaagcatcatttctttggttgcatagttgatccttatgagttgctgttcttgaccttgttgcaccaaatttgaggggagctcatcttaatgaatgtactactggacgctactaaaggcaaaaggttgactttttaggtttgtcatgactcacatccaaatgtttattaatgaaaagagaaaaagcccagtttttttggttaccaagatgatgcttgcttccatttctttttgtcaatgctatgtagggcaagatggtatcgcagaagtaaaaataaccagagcctggtaaccaagacaaccttccaccccaattggttcccacagggccaggaggatgggtgaggtgtccatctgggcttatgtgcagtgtgttgtcttaaaacacagcaatttagatagaactaccctttcctcttggtgggagtctgcagccaacaggaccagaaccagcttggccttctgggcaccatacttttggaaaaccacccctaaatgcaaaccaaagcacaggccaagagaacggacctctgtgggttgattttttccatgcgtttgattgcgtgcatgtgtaggaggtgaagccggtgtggtgacgggcctgtggaggtgagctggtcagtgttgctccgtgtctctcggttgtgggctttgtggatgggctgcagtcggaatctcccagtggccagcaccccctgaagcccccggtgcgacgccttgtggttccacagccccctccacaatcattcctgtgtcgtctagccttttcttttgcttcccttgttttctaggccgccggtgttaacaccacggacaaagagattgaggttctctatattcggaatgtaacttttgaggacgctggggaatatacgtgcttggcgggtaattctattgggatatcctttcactctgcatggttgacagttctgccaggtatatactgttctttctctctgggtttttttcccttttcttggttgactgctataaaattaacacagcttctgttatcagaaatggccccttttatccttgcataaagatataaaaaatgttaaaaatgatccctcagggataagaaaactgccttggaaattcacacacagtgagatcccacactcacatttatgatcaagggaaatttcacccttaaaacctgaagggatctcatatttttagtgagtcattgagccaatgtataaattagcccatccccctttctcttaaggaacaagttgccattactttggtaaaattcaaagtaatttattctcatttcaaattccattttgctaaaatcctgtatgtgtttttattgctttcatcccactttgtatttttaacgagatgtaaatagagggatgtgtatggaggagcctggggagcggcacctctgaatgtcagatgcacagaagcagtgtgttgcctaccttggggatcggtggcttgctgcatgttgcgatagaatggactttcggtttgctttcattgcaaagcatgctcctgccatcttgggcttgatgttatttctgcctcacagagaaataaacatcattgcagccctgttgcctaaacattgctgctgtctgaatctttaaccgacatctctattctagtgaaactttcttgaaattaaacactgtcctctctgatgcatctgcctctttgtcatttcctttgtgaaactgcagagactgtggtttgctagcttatgatgttccactccagttattaattccttgtttttagagtacagtgcttacctgcatgcttattttacatctagtaaaaataaaatagatcgtttcatttttgtgctgttgctgctgagagttttgactatcttgcaagtatttttctgattaaaatgtataagctttcaataataccattgcatccgtttttccttttgttgcgaatctgctctgtgaatatttgctttgaaacaaagagatgtctcttatgttgaagcttgcttttatttgcagtactgcattctgtggtgcctaactggcacttcttaaccagtttgcctgacagtgctagcacttaactaagaatgcagtttgagaaaaacactatttggaaatacactgcttgtaggtggatcatcgaggactaagaagaagtcagacattggaagttgatataaaaatgtgctaaattaagtaattatatgtatactcacacataatacctttatgttttttctttaagagaaaagctgtagtgacataacaatataaccggatatgtataaacttaaaaggttattaaagaatattataatctttatgtattatggatctaatggttctatattataagcaattcaatctgtgtatttaatgcattggtttgtttatggactagatggtattaaggaattcaccaaaactttttcagaccagcctactagatgaacatcagtttcatatggaattgtgttcatccgggttaaattatcctgtggagtcttcctttggaagagcctacccatgtaagactgaagcattgtcactgtctccttagaaacaaaagtgggcatcgttgatatttcagaattttttatttggtttgcattcacagacgatcatgaaagataatcctttcattgtgggtacagttggtcgtcctccactgaaatgtctaacaaaatgtggcctcatagcctgccctgtgcaactgggtgtcaaccactcactggattgcaggtgcccactgaggctagtgacagtgactacctgggtcctggtggtcaaatgatggacccctggttattcattttcatttgggagtttttgggaagcccaccttgccttgagaatggtcgtcgccttttggttcctttggttgtgctatgatgcgtcagtctggtgtgctaactctatggcctgcttatctgttcctcctcctgtgatctgcaatctagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagaaagtagataaagagtttaaagaaatttactcctcccccatgacccagccagcttgtggatcttgtcctctgctttgatgccatcgacttctgtgagcttccatgtgcgagtgattctggtgtgatgcttggcggtcacccagttagtgtttggagcttggagagtctagtcatggtgcgttgcttggatcaatggggtccagttccaagggcaagaaaggacaatactgtcagaatcagaaaactaatcagcaggactggaaataactggaggcaaatccccctgtgtgtgtttgatcagactcaagtacagcggtctcttcgaagctttagccacattcgtgtcctgtgatctaataccttttttaagataagcatgaacattcgcttgggacttatgccactagtacgaaagagactctaagttctctgacttattttttaaagtcaagatcagtatcttatgccctgggggtgcatctgaactgtttgatttaaactggtgcacaataactttctacacagaattttggcttaacctctttgcaatttacaatagaattgtatgcatctattatgtctcattgttagtagttcacaggtgtggctgtggatttattagtagaatatttgtatggaaccagcaacagattgtttttaaccaccaacttggtctttggtggttgctttttgcttgtgtgtgcctcctgattggtttaattttgctttgggggagatggggcaagatggagcctctggtgtaaaccaaagccctgcataggtaggtgggacaggaaatgcctcagctcttttctgcttattcacagagatggaagcggaaggcagatgtagatgcagaacgtttacaaaagcatttgaaacttggttctgataaaggtttcttttgaaatagcaagtaaaacagcaaactcattggctctatttcagtgtgtattttagtaaaatgtacggggtgcttgttaaaatttcagattcctttgtctcagccccagagattcttgttcagtcatcttggatagggccaggaatctgcattttacacaagccctatggtgattttagaatgcactttgagaaactccaggttaattccaggcatgcctctcccgggacttcaggtaggaatgacattttctggacaaggcattaggaaggattaggaaccagttggtcagcagtggttttggaatgggtctggttgttcacaacccagcttcaaactcctggctgaatgggtccttgttaacttctctaaagccatgtttcaagcaggtctttctttgtggagacggaggatagaatttaaagtgtgtgtcaagcgtaggcgaatgaccaaattgtgttaacagcatggaaaagaggggcctgttgggtcacgtctgccaccaagaatgctgttgtcattttgagtgacatgattatctttcttggggccaggaaagcaaagatgaggccagttggccaaccagtttctagaagagtccagtcctgagataactcttacatggtttctattattttttttctaacagggaaaaatggtaacttctggaggcaacttgtaatttggcatagctaggccactgccccttaattatctcatcatctttttttctgcaactgttaaaatgcttttctttttacttaatatagaagggtaagatgcccttaaaatccccctgactcagccacagtcatcgtgttttctttccccagtgccagctggcttttcttcactgtccatctaagaatacagtttgagaaaaatagtatttggaaatatactgcttgtggatggatccttgaggactaagaagagggcagacattggaagttgacataagaatgttctaaattaagtaattatatgtatactcacatgcaataccatttatattttttctttaagagaattcagcctggccgggcgtggtggctcacgcctgtaatcccagcactttgggaggctgaggcgcgtggatcacccgaggtcaggagttcgagaccatccagcctgactaacatgttgaaacctcgtctctactaaaagtacaaaaattagctgggtgtggtggtgcatgcctgtagtcccagctgcttgggaggctgaggcaggagaatcacttgaacctgggaggtggaggttgcaatgagccaagatcacaccattgcgctccagcctgggcaacaagagtaaaactccgtctttaaaaaaaaagagagagaattcagcctaagttggtcctttttcctctcttccctgtgttaccagagggaacatcagagttccttcctctttttcttccctcctttctttatttattcatcataatttactaagtgcggggtataaatcaggttacatgtaagacacagcctgtcacattcaccagtggttccaaggttatttgatggtaaatgcctgtaatcctagctccacaggaggctgaagcgggaggatcctttgaacccaggagttcaagaccagcctgaccaacacagcgagactccaactcaaaaaacaaaacaaaacaaaacaaaacaaaaacccaaagtgggaaaaaaaagaaaatgtaattggcttgtgttcagtagggccaaggagtataacagaagcagaggaaagggggcaaataccagttccctggaaaagtacatctctgcgagattaatttatttggggggaatgttgacacacctcagctccttctacatgtccaagtggggtacattattggatcttcacaaagaatgtttcatcagtacgcatggcccctttggtagagaaagagatgcttatcgggtatctggataaaagagggttattggactggagctggaatgaaaagccccagaaaggcctgcagatacgttgatgacagagcaaataccacagggatgccaagcatgcctttacctgagcctctaatcagatgtgtcaaggatgggttgtttctaggcatttatgaggccactttttattctgtgttggccagtctcctctaggacacagggatcactcagtgtctccatggccctgactctttccctctccaacacccatacacacacagcgtctcactcaggtccctcagtccatccttgttctcttttcaggacaagaaaagttgggttttcgttcctcctgtgagtttttccttcttggcatttattaatttgcactagacttactggtgtaacacagacgtttcagtttatgttatttttttgagcaaaaatatttttttccagtaccaaagaagaaattccttgcaatcatttcctagtaagcgtgaattttttgagactttgtatgcacatggttgaagaaggagaagcaacttttgggtggtgggaggcagatggcaggtggcatctccctgtgtcctttgatggaggctcatgtcacattcagtgtcagggcttgggcaccgtgccagacactgctcacccactcccactcctttggcgcccagcgagttaaatgagaccaacaacagccagcccagagaggggcatctttgtgagcgtgttggttctggtacaggtctgctggacagccagtgaccagtgtgaagcagcctttgtgagttaaagggggcagcattactttctgtgttttccacacatcaattgggtggtgggggaaggtgtaggggtgggtggaggatggagtgcagaggaaactgaggatgcctgtttaggagacgtgcggtgttgctgggtttgctgaatcagttttacatcgagcacatcagtttctttctctggggcttgaagcttccatagggtaggatggagatttaactgtcttatggttggctccgtccagataaattcatctcctgtgcagcttacaccctctctcactgccgtcagcatggtacaagaggctgcagggtggttttttttttgtttttttcagactttagtttcaccttctcagctgctgatataggtaggctgaaaaccagagaaaaatcaagagcagactgggtgccgtggctcatgcctgtaatcccagcactttgggagaccaagacaggcagatcacctgcagtcaggagttctagaccagcctggccaacatatagtgaaaccccatctccactaaaaaatacaaaaattagctgggtgtggtgatgcatgcctgtagtctcagctacttgggaaactaaggcaggagaatcactagaacccaggaggtagaggttgcagtgagctgagatcgcgccactgcactccagccttggtgacagagtgatactccgtctcacacaaataaaataaaataaaataaaataaaataaaataaatcaagggcagtgaaggctaccttttgtagcaatacttttgaggcaaatggcatattcctggggacgttaggaataggaccaagatgaagggggaggagcggagcgggtgcctcgggggaggaatgtgtgactcagtagccagttctcaggtccagtgttagtgatcctcaaacatatgccaaattccgggaagggggatggatgttctactcccagaagctcgtttactgcctggcagctgaacatcatgatctgggaatattctctgtattttggtcaatcaggtggtctaaaccttaccggctccagaaaacatttgggtaattagagtggtcacggatgacttaactggaatctgccctttcatgtgggcacctcaccctccctgcccctatttcgctgctcccttttctcctctctcagcctccaaaggacatgacagtttgcccaagatctgacctggaccttggctgatgcgatctctcgagcagagccagcgcatctggggctggtgcgtcatggctctgataggtttactcacagagtcccagggaaaggcctgcgggaggcagagactcgctgtgggagaaaagtgagtgtctgatgaactgccttgcctaattacctaaattttgttatggaggaattaaaaatgcaacttcagaagcctttgaaggtttatctcaggcacccagcttgcggtggtgaaagcattttgtttggccataggggagtggtgggcaaggcttatattagagcagaagtatgttaatgccagcctcgtgttcttgtgggggaaggtggtttgcagcctaagagtcacagggcctgtttggcaggctgtggtccaagtgtgtttgtcagtcctggggagtaaacacacaaatattaattcgtctcttctccctggaacatctttgcttctgcttgctctgttctctgagaaatcccctctagatggtaaatttaattcagtataaagagataacactgttagaccgggcgcagtggcccacacctgtaatcccagcactttgggaggccgacgtaggtggatcacctgaggtcaggagttcgagaccagcctgaccagcgtgatgaaaccatgtgtctactaaaaatacaaaattagctgggcgtggtggtacatgcctgtaatcccagctacttgggaggctgaggcaggagaatcacttgaacccggtaggcgggggttgcagtgagccaagatcgtgcctggataatgagagtgaaactctgtctcaaaccaaaaaaaaaaaaaaaaaaaaaaaaaagaaaagaaacagataacactgtttcttggtggccctttaaaaagaaaggaaaaaaaaaaaacacttcctcacttaatctcccatatgtactatggaaatgtacgaaaagcacatttacttaaaagcttgacttatggcacatgctggagagattccggaaagtgaggaaatggaattggagtctgtgaaaatacatgcttaaaaaaaaatgcctgccaagattcgggagtgggaaaacagtttactagagtgttcgtgttgattgtttataagtaactcacttatcactaacaagagaatatgttaaaattggttaggaatgaaactctggaattgaagtttctaggtaggaattgaagaataaggaagattatgattttgtgcaaaagaaaagagaatttaatagtgctaaagaagtagaaggatttcagagatgagcagtgggagttatttgaggttcctgattcagaggaaagatgcccagtaaaacatggagtcccacaggggaatggcctgcccaggaccgggccaagcccccaacacaggctcgctcttggagtggaagggaatgaagagaaagccagccgtattttatagccccagaggggattttaaaagcatagtaaaaatgcatggaggtaaaattaagatatacctcagtagacagagcaatcaaattctatagtttcttagactttgcacgttttcttacccttttcccccgtttcgtgttcttataaaagtattttccaggtttgtacatttaatctgaatctccgtacttcatctgaacaaaattcccgtaagtcatccttcttgtagacctcatttttaaaattctaataataatgacaataaagttgataaaggctttcttatttatttatttttaggctttccatttgaaaagctgtcacatgaaaatcttctcgagacagtctgtttgggggatggtgtagatacatgtgaacttttgccaggggtttgtggatgcagattcctttggggtcatgggtgagccatagaggggtgaacttcagactgaatgttaaatttttctcttctgaggtaacccctaagccatatttgtcattaggaccctcttactgtccagttttcctcctgccctgagatgattccctgactcctggattcttcatctcctgcttactagaaccccagcccatccttggcagtgagcagagggcctcatctagcaaatcagacatgcccactaaggcatatcttctgcagtcagcctttaatgtcactgggttatcttcctggttgcacacagtttgacagtacaatcgtcgcttggtatgcgttggggattggttctaacaaccccgaatataccaaaatctgtggatgcccaagacctttatttaaaatggtgtagtatttgcatatgaactgtgtacatcctctcatatacttagtcatttctagtgatacctgtaataactaacgcgttgtaaatgctatgtaaatagttgttatactgtattgttttttatttgtattttaaaattgttgtattgttattttttattaattagctttcaaatatttttgatctgtgattggttgaaaccatgaatgcggaacccacagatatggaggactgactgtatcttacacacagaaccaccctaggctccaaacgctccaagttacccagagagaagtgtctttgtctgttctctcagatctgggcagcaaatgattctaaagggactaagagaaaatattgcagtgttggtagcagacattaactgagctcttagtgccaggcctagcactaagcacttcatcagtttttttttccctcattttatcatcacattaatgctgtgcagttggacctgttcctgtctcctcttttcttttttgagatggagtcttgctctgtcgcccagactgcagtgcagtggcaccatctcggctcaccgcaacctctgcctcccaggttcaagcaattctcctgtctcagcctccccagtagctggggttacaggcactcaccaccatgcccggctaacttttctatctttagtagagacagggtttcaccatgttggtcaggctggtctcgaactcctgacctcagaagatctgcccaccttggcttcccaaagtgctaggattacaggtgtgagccactctgcctggcccctgtcttgtttttaacagatgaggaaacccaggtctagaaaggttaagtgatttcccaaagctcacacagtgagtgagtgctcaaactgggacagggaccctgacaatctgaccgcacagtcccatgttattgcagttggtcaggatgcagcctgcctaatgcggggcctcatgttgtgaatgatgagcacaggaagggcagcaacgggattggctgttgcccacatcgaaggatgcagagatgccacaaaacctagcctggtagcagaaggaagggccgaaagcagtgatcttgtaagttttcactcattttagaagtcagcatatttcaagcatatgcccttcgttttcttttccgttgttcatgcctcagctcagatccttattattctaaaaaatatttttgttaaataaagtacttcttctagaacataaaagaattacatacacatggtcataaaatccaaatggtctagaaagttctgaaataaaatgtattttctaccccctctctcaactcctaatctctctgcccacaggtgatcactgctaagtctcttatatatccttccagaaacgtttaagtgcccttgttctcacacctcgctgtgggacagctgccttccccacatcctattctgtgagcctcgctgatgagagcggtgattttcagggaggaggcacagaagcccagccatgcctctgcctctgctgggtgttaacgtcatccaggactgcggtcccaagcaattgcttaatcggttcccactcctctattgattgcagcttcctatgcaccccatagtggaatcctggaaactggtatccagtgatgaggggctacgctgcaggccatgcagagagtgttctggctgtacaacctgccagaccctggccatttgcggaagtcgtcccattgctaggcctcttttttttttttttttttttgagacggagtcttgctctgttgcccaggctggagtgctgtggtgcaatctcagctcactgcaacctctgcctcctgggtttaagcgattctcctgcctcagcctcccaagtagctgggattacaggcgcctaccaccacaaccgactcattttttttatttttagtagagatagggtttcaccatgttggccaggctggtctcaaactcctgacctcaagtgatctgcccacttcctcctcccaaagtgctgagattacggcgtgagccaccgcgcctggccggccggttcttactagtttggctggagcttcttgcccatgatatcctcaagcataaggtccccctgcaatgagtggtgatttttgcctgttcatggggaagaactttcagaagaccttcttagtcttgaaaacacctgcgtacttaagcatccacagcacacggccctgatgcagaatgaattaggaggacagaaagatttggggaagcatcattggccgttaaacccgctcctgaatctttctgagctctgtaggtggagcttgagatgttcctgtggaccaatgcaaactggaagtcttgatgttctctgaaagttcctggcttctgatgtgtcccgcagacgaggttagctcactacagtgaggttggataccacatggcggggactttaaagttgtctgtttcatccagggtggggcttatgcctagtctgtgacctcagtggggagcaggacggattccccaggagcacccacatttaccttctcgtcttttcccgcttgcttctgccatttgcttgtgcaacccagacacttgggtgtgaggatctcagctccacaattaatgattctttagttcccgcttttaaaacattttgaccatacaatgaataaatgttgctcatactatctgcataatgaagtttaggaataactgccccctgccaaaagattgaatggaaggctcaggaagtgctcatgtacgttttaaaagataataggaattctatgtgaaaaatggcccacttctttattttaatactgaaaacaacttcctaatcctaaaatgattttcttcccctaatctattcttgggcatcttcttgaatttccagcctgctttgagggaagtctgggtttacaaaggcgagattcaaagcttttcaaacaggacaggtcctctggttccctgtgagaagagcccaggacccaccctgtgaaagttcatcccacctaaatttgttcatctggactcagtctttgccagtgtgattgaaggcgtttgtaagcacatccaggagtactatccacctgggcagtcacgcaggagacagagcccagggtgggctagttgcctgcttggagatggatcgtggttaacttcacattcttgttctcttgggccaaagtcttgttcatggtttagaataagacagtgttcaagcagcctgtggtcagactaagattgcgtagtcatcctcaaaagtggccttccagtgtgctctgcgtgagtcttttttttccatagaaaccagccaaaggacagtgatatatttaagaaataatcattttatcagacacactgaaatggatcaggataaacaagaaagtaactcggtggagccctgtgtactgccaggtgggagaggagttctcttgtgtggttatgggaaaaggtgtattttctttccattgatgcttcatcccacgtgtttagtgcactggtttctgaaaccgaagacaagaggcagcccatttccactgaatagcctggccatcaataagtttccagaaggactggggagaaacaaagaatggcccccaatgctggggtctggggttattttgagttaaagggactcggagctactgaatgtcttccacattcaagtcctagaactctttccttgagatattccactttacatttccaaagacagaggaaatatggtagagccaatttcctaaaagttttcgtagaatttcataagcacagcattgatccatgatccgggtagtctgagaggggatccattatccagggctccagtacaggtgcaggtacaaccataaaggcactaatgaagccagagaggactgtctgcatgtcctcaagtgactctctggaggaattaggacagaaagaaaatttacattgtgatcagatggtatagaaaaatttcatagaaaaacctgaacataggaacataaaatttggatgaaatctggtactgcatggactggagggcagaggagttagattccagtggttttctaatttggtttctgacttctgccagcccccaacccattcctttctaagattcgatactctggctgggctctggctgacttccagccttctcagatggagccaggattacatctgtgtctttgcattttgtatccaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagtgagtacttctcttggccatgtcccaggatggagactcagctataaatggggatattggattaacattttctttttatgacccttagccacaaaggtcttggtgtgatgatgtcagcaggagtaagattgtatttctaaataaccaactcctggaaaagaaaaaaatggatttaaaaaaaaaaataactccttgaaagcagagctacttgcccctggctggtccccaaagaagatggcatctggttatcattttttaagtgtctgggcaattcagactccgtcaaatggaataaaagtagaattatccaatttataaaacagatctgacattctagcttttggttactagaacaagactgttctctgttcacttctgtggagaaattagatgcagaatataaatggccttaaggaccgctacccagtgttgctgttctcattggttattaatgtcatattgggctgaaaagcttcaaatatggtacctgacatctaatttctgtgatccataatattttccttgttggatgatacagaggtgtgccaatcagatgtttagtcaaaatatggccacctgggtggtgttggggctacgtatctcttggtctcgcttgaactccacgtactggagctccgttgggctgcatttgaatcctggctttgccagacagtggctgggcaacctcgggtgaggcacctgattctctgaaattcattctcataaaatgagggtggtggttcagacctcccaggactgagcagagttcttggcttgtgcgagttttcctttcatttcccttcacgtggtggtaacctgggagctctgaactgcaaacctcagcaggatcatcgtgtggggcatggagtcagtgggcagaatttgagctcctagccctcgtcctctaggcagggaccgacccctagatcctccttctgaaaggaagtgcagtggtcattgtagggctgtccactcacttctggggtactttttgtcgtcacagcttgagagtacgggaaggtggaaatgctgactacttctgcatcacatacactggaataagctcttgacttgcttataagcagctaccctgtttgccttgacattttcagtagctcctcagattatatacacttctcatgtgtacctatacacatttggaaatgcaaagataagctcttccagagactgatctgatgagctctatttggaagggagaggtagcttatgtggctggcacttctgattttgattcacgtgatgtcacatcagttttgtttcccaagtgccaatttagagatgtgtaccgttagctaggactgaataattgtatggatattatttggttagagtgttaatggaagtaatttccagttgatttgtatactgtagtgaaaagaccactcactcattcacttattcattcactcaaggcatgttaattggacatttactggtggggcaccagagaaaacacaaagaatggtttctttacctgtaggatgtggagaaatggatgtttcttgtgaactccgccagccctagtttgtgtgtgattatatacacagataggttcatgtgcacattcctatatatataactgaactggagagttgtgatcatattttaagaaattgcagctttcgggtttagtccatagtttttgccacctgtgacaccacagtcaacagtggaagtctgtatgtgcccaactgttacctcccacccggggtaccctgagtgtggaaaatctgagtgctaaacatttcaaaacagtgtttagcgcaaacgtaggtggaacagatttccaatgaatgaaggctatttagaagcagtttattagatcggaggcagaagttatacaaagaaaggattgttatgcttgtagtagcaaggcggtgggacataaattagccatttttccaatgcaaatatttattttctgccaagatgttaaatttaattttcgttctgggtagaaacaaaatgacctctgcatagcacatgctgcccttagtctttatgctgcacttttgcaaactattgtgtacttaccttaaatactgtttactaatggcagctccatgctttgctgtgttatgcttaagttagaaagagccgtattcataagtattccaaagacttttgcgttttgttggtttctggaatgcacaaggacaatatatggctattcgtccgatgtgcatagaccttgtaatcttagaaatttaatttgtggtgttcactttggattttcttcattgttaattttatgtagtcataaggacttttaaacttatgtcaaaaaaaaagtccccaattttttagaattttctttttagtaaaaaattagagattccttgaaatgcttttaagaggcatatcctgtaacttggcaaggaatgtgaccataaaatccattggtatttgaataataattttaaagccaccattttacagggacaaaaaaataagaacagtcttaacgttttttctttgagccattctaaattacaaatatttaattggctcaagatcaaaagctcttctctggcacttaggaaagctgaccaccgcactagcaaggataccttccctaaagaaaataaaccgagaataccaatgtgaaatttaatagccgttccaccagtaattgacattctctaaaacgtcactaggaaaatactcaggcgcgtgtgtaccctaagtctcattagttccatatgataagcactccatgctttagtaagccgctgaaagatttttatatttagttctggaatttccctcactacaccccatcaccagatgctatgtgctaatcccctatttacacatttaggctgacactgggcaagcccctgggagaaggttgctttgggcaagtggtcatggcggaagcagtgggaattgacaaagacaagcccaaggaggcggtcaccgtggccgtgaagatgttgaaaggtgagcggggaggcgggaggctcggggaggggctgggtggagagtcttatcaagaaagttccttttgtggcatgtgaactctatcatggcacggggtcagagagcacatagttgacctaggggttgagaagttttcggtataaatcagcatctcggacagactatttatcttgagctgtgtgtacttataaagaaaagccagttttgttagaaagcggtagcctcctacatagagttattctttgactccttcttcgtgaccacaattcttcattctctctgtatttttatgtgcttagaaattatcaactcacatataattgaatttattagctaggagttggtgtgttagatttgggacttaaaccttaactttacaagtacaagaaaatttgtgtttttggagggaacgaagagacgtaagggagcagaaagccttctcttttgcgtgaggaacaaagcagaaatgacactggtctgggagagtcacttagaagctgagaaggagtgaacaggatcagggctggtgcagagcctcctgggacacataaacaattaccctgagatgtaaatgtcgtgttgtgtttgtgggactgtgaacacttctacgttaaccttccaaccctgcttcatgcccatgtccaaagaacttaaagaacttttaaccattaacttattcgtcctgcagtattcttttatgagaagagttatagggaactgtcacattataaatcctcttgtagggatctcggaaagaagatcccatgccgagtgtttcccacgtttccaggcagagaggcccatccttgggatatggtgctgggcatgtcgcaggcgctctggagttaggctttgtctttcttttgtgggttctcatgggatagtcatcacatccctcccaaggggaagtagcaggctggactttgtcaacaagatgtgcattttgttttttgggttttttaaaaggctgtttatctgagtgactcccaaggaaaactagagtgctttgagatgttccccaccttggagcctgatgccggggaggaacactgtgctgtcttgccccaggtgtcatggcaccactgactgaggcagcccctggctgcgtaccagggccaggtgtggggaggacccaggcttctcatctcttttggcggaacttctggttttgctaatggagctcagagttacatgggatattgcaaaaagggaggtctgggagttctctttctcttgtgatgcccaggctggcagccttccctgtaaggacacagaaggatattagtccccaagccattgtggcgtgtcctttcttacagcccacggctgtgtctccctccctcctcatggcccgtggctccctccttcacatacatcagtgtaaattttgcacacacagtcacttgtattgatcttccttttgtgaagctaaaaaactgtttgcaacatggttcttatccatgcccatatttcattttttttttaaaggaaacccagatttttccatactgaattagcttgaggtggagggcacatgggaaagtcttgccacttaggagaatctaagagaagctaactgcgagcccgcgtatgtggaacctgtgccattcttgcttgaaattacagagcggaagtttatgtaacttttcttaggatgggaactgcagtgccctctgagaagccactagaagtcgcagccctttacctgctcagaatgcacatgcacacacgtttatggccctgtttatggggaaccgtctgaacccacctcggaacgctctaagggcctcgaggggctgggttaagaatgcttggtcgggagcaagtctgtagtgatttgaaatggccctaccctcggtctcctcgctggtttcaggcaccatgaagtttggtgtggttttctgagacgccttagatatggcagaggatgagattatctcatggtctaggaaagaattggcattagtgtcagaagcccctgctctcgtcctgactcttggccccattggccccccagtgagctctttgacacagagtgaggcagttccctgtgtaggcctttgtcccttcctcgataaaatgagggagatgatttggaaaatcttttctgattctgaaattcaatttcatgctgtttcaactaagtctttggcaactaacagtagctgcccatgagttagaggaaatgaactgatttgtgaatatgcctactgttcatagatgatgccacagagaaagacctttctgatctggtgtcagagatggagatgatgaagatgattgggaaacacaagaatatcataaatcttcttggagcctgcacacaggatggtgagtaggaggaaaaactgcattcgcccaaatactctgcagtttgattgaatcattttagaaatggctgggcttccagatcctgctcccagagcaccctgtgtgcatgtttaaagttctttttaaaatccccattggaagatgttcctagccatgaacacaaagaagggtctgtgcccgtacctgggggccagtggaaaggagggtgcaggtgactttggatttgagggcctagagggcgctgctgtttctaggtcataacctggagggggttttggaaaaggcagcctccttatgtttttgttttgtaagtgctaagagagatttgtcagaataagatcctatgttttggttgagaagttcttcccttaaaacagggattgaagaatccacatcttgctgtgggtcacagatggctgagctcccaagaatagcttaaaagaggagaaagcggtatgaaggaatacgttattttccctgggggagagagaccctggcttcttccattgaatgtttactggcactttgaaatcaatttgctaagtaattagtaaacttgaaaacgcctatctttgacttagcaatttctcttgtaggtctatatagtaattggtgaactttttctgtaaagggaggtcgtagatattttagacttttgtgggccgtatggtctttgtcgcaacttctcgtgtctgccatagtagtgagaaagcagtgctagaagtacagaaatgaatggacctggctgcatgccaataaaatttaattacccaaacaggcggtaggcaggatttggcttgcaggctgtagtctgccaaccccgagcctataccatggagaaattattgcacacgtgtgtaagggaacatgtacagagatgttcattgcctactgtttgttatggctgaaacctggaagcaaatgcctatgcatataagggaatggataaataaagtgtggtgtgtttatacgatacagtatatgcagctgtgaaaaggaatgatctggttttgtttttataagcccaacaggttccaaaaggataatgtatgggtaaaaaatgttgcaaagatctaagagctttattattcatttatgtgattaaaaataatatattacttattgaatagttaaaatgaaccaaaaggatagagtggagggatccattgctttccaagagggcgcaggtgacagcatgagagtgacagggaagagcacgtcaactgtgtctctgtgccttttgaggctatcatgaccaagggcttatttatcattttggagagattataatcatatttttatgtgtgcttttctgtatgttaaaactttttcttttttcttcttctttttttttttttttttttgagacaaagtctcgctctgttgcctaggctgcagtgcagtggtgtgatctcggctcactacagcctccacctcctgggttcaagcgattctcctgtctcagcctctcaagtagctgggactataggtgtgtgtcaccatgcccagctaatttttgtatttttagtagagacgaggtttcgctatgctggccaggctggtcttgaactcctggcctcatgtgatccacctgcctcggcctctgtaagggctgggattacagatatgaggcaccacgcccagccgctgtatgttaaactttaaaaaaaaaaaaaaaagcatgggttgtaataactaaaaatgttttgctgaattgcccaaggggagaccctggattctctctttagggagcttctcttcttcctcaacagggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaagtgagtctttcacattctacttggctgggtggaatccaactaaaaatgtctttaaagaaaacaggcaatttggacatgctcatttgctagatcaagccctcgcatgtcttgtacaacctggaaaatatttattgcgttattcccatttgagtttaatgaactgtttaaaaccaaagcagcctcataaacctatagcatcgctgcagagatgagcagaaaagatacctcttctttgagacaggaccatgtgtgatttccctcggaattcagctctccaggtgggaaatggatggttttaaaggccccctttaattcggatgattttctttctttcttttttttttttcttaagcttcatttattttgtggttactgagtttttgaacatagactttaggtgtttagtgttttgggtttgatatggcattaaatattctaagagtaaaggtcaaacaaaggggtattttagtaaccttgcgtcctggagctctgcgtttattttgcctcgtttggcgggtgaccctctgtggttagaagttggccaggtcccctgaggtggactgcctgcattccaggcgtgccacttaccgtggaacttgaaacatttcagttattctgagagtagttagacaggtgcccagatgtcctcggaggcattttggatgacccaaaactcccttgtcagccccacacatagggaagcggaggggcggagctgcctcctgtgcagaggtgggccttgctcctacctgcattgcagtttattgcagtgccaggaattccttgggtccccaaagaggtgagatcctctggtcggcgtgcaccctctgtcactgggggtctgggttgcctgaagagtcacaaactcaagtctccatggggccatgccagtcacaccaccaaggcctgcggatcactcagagtgcagagattcgagggatggctgcacctcagctctactctctggccacataggaacatggcccagagctaccccatgttctggatggttttttctttctttcaaacaggctggagtgccgtggcataatcacagctcactgcagccttgacctcctgggttcaggtgagcctcccacctcaacctcctgagtagctgggagtacgaggatgtgccaccatgcctggctaagttttgtgttttttgttttttgttttggtagagacggggttttgccttttttctttttaatttaagaaaaactttaaaaacattttttcaggagagtttagagtttaagactttttcagatctttttcgtataaaaatctcccaatatataggttttgggaaactaattaaacacagttttgacttctgtgattgtgtttacgtacacgtgcgtgtgtgtgcgtgtatgtagggtagtttgccaatctatttggcatccagagacaaccagacagatccagaacatgggacatttgacaagatatcgcttccaaatgtcagtgtctcgaaagacaaaaactgctggggagacggttccagataaaagggggccgatgagacaattcctaagtgtaaaagtgggatcctggactggatcctgtgggtcggggagggtggccagttcttagaaaggacatttgtgagtgtcctttgaatatggactgtataatattactggttatatttctgtatcagtgttgaatttgccgggggtggtgacagtggtatctgttgtaggagaaatacgctgaagaattgagatttgtgaagtatcagtgatgcctgcagctcagttttaagtggtccagccataaaatataatcaatccattcactatcccaagtgtgtatgtgtgtgggggcaggtggggcaggacatggagacagcaagtgattgagtaggtgtaacaagcaaacccagcagtggtggatactcactgtgccatccctccttttctgcagctgtgaactcttcctaaataagcctggggagggtagcccatctgtaggctgcctattttgatattctggtcttgatcactccctgccctacctgtgtgggagataggggaagcagttttgcacccagcagggtggtgctactaggggaaatgtggtaggagggctggctcagtcattttattaaatccttcaacatctactcctagagcacccccgatgtctcatgcccttggtcaggctctccagcgaagtggccagaagagacatagtccttgacctcctggggcaagaaccatgggtgacagtaagagaaattgactgtaaatgtgggaatgaaaataaggttgtaaaaaaatattgaaaaaggtgccatggaggaaacagggggataaggccttactcatgccaggacgctgcactttgctgtcactgccatggaagcctctgagggggaggaagaggatcagttagtgcttcaaaaatgcctctcactgctgcttgtgtggtgaatgggaaggctgagcccctgtcaaaggtgatgatggtttgggctagggtctgttgggtccaaagacaccgagaaaagctggtgggctgatgttggacatattttgctcttgggataatgaatggattgattagataggagggagagaaagagagatcaagggtgacttctggatttccagcttgaaaaactggatggtggtgcagcttccaagtctgggaggacttgggaatcagggctggggcagggggcatagatttgggtggaaaatccgagctcgtcttgagcgtatctgagtcatccaaggggagataatgaagaagctgcaggcagcagctcagctctgagggtgggctaacagctgggaggcagcaaagggagctgtgagttcaagccatgggcgtggacaaactcatctgcggagaagcttggaagaggagaatagaagcctgaagtcaggtcctgagaaaattctcaaatctagagattgactgaaagcaccagaaacagcagcggaggccgagcaggcacagcctgagcagtaggaaaatcaggacacggagcacagaggccccacatgggagcttcaggaaggagggggcaggtagtagagcctcggcgctcagactggtgagaagcacgggtgttgagtcctggtcctagaggcagtggtggtacccctgcccaccctagccctgaggacccagagctccttcctgttttggagctggcagagagaaaactaagagacgaactttgctaagcagggcaaatgcatccatttaatcgtggaagaacggaagtacccatattaaagtgttgtgataatagtaactatcgttattattaattactgacccctccgggagaagctaaccatcttccaggcaccgtggcagagcatttgacataaagcatcttacgtagccctcagaacaacccggaaataggtgggatttggatccccattgtatgggggaggacgatgaggaagcagcatgaatggtttgagaccagatgtgtcaggaggactcagatgtcctcacttctgagaagcggacttgtaggtccgaagagtggagtggcaggtcccagacctaggtctcctggtcccccactcagctgtctcctgctctcatgaggcccctaactctctctaaactgaggcaagaccaatgagattccacgtggggggcgggtgaggggttgtttagtgccccagtgtggcctcattgtctctacattgaataacagcccaaggtaaaagggatattgtatgggcctttaagacatggcatggttccaaagccacttactggaggccacctgcagttaaggacccagaataggtttgaaaatggaggtagatgaagatgttaagcatggtccccttgcgagggctctgcttccaaaaatggagggcttattcttgaaagtggagaatgaagaaccaggcaaagggtccggccctggctttcccacacccatcccctcacaatggggagccatgggcttgtgagagacctgcttgcctgaaggaaggggcaaaagagaactgttgattacatcgttactgatgtactgggttcatctgtgctcagcgctgggccgattgagatgaacacacagtgcctggcctccagcagctttcagttgtgtgtgtacatgtgtgtgtgtgcgtgagtgtgtgagtgttggggtaggggttggggactggagacagagaagtgaaaaaacaccatggtgtatatagcaatgcaattaggtaatagggtatttgagccttacacaatttataaaatccttactatttttagctcaaatcacactaattttacttttttaaccaaatcccaaacccagttaaccctcaaagtgttaaacctgagcagtttgtttttcgtttttgtttttgagacagggtctcactctgtcacctggctggagtgcagtggcgtgatcttggctcactgcagccttggcctcctgggttcaagtgattctcccacctcagcctcctgagttgctgggactacaggcatgtaccaccacacctggctattttttggtagagacggggttttaccataccatgttggccaggctggtcttgaactcctgacctcaagtgatctgcccacctcagcctcccaaagtgctgggattacaggcatgagccactgcgcctggccctgagcagttttttttttttttttggttgagacagagtctagctcttttgccgaggctggagttcagtggcgctatctcggctcactgcagcctctgcctcccaggttctagcgattctcctgcctcagcctcccaagtagctgggactacaggcgcttgccaccacgcccggctaattttttgtgtttttagtagagatggggtttcgctgtgttagccagggtggtctccatctcctgacctcgggatccgcctgccttggcctcccaaagtgctgggataacaggtgtgagccaccacgctcagcctgagcagtttttttagtgaagccccagcttccccacctgtaaaatgggtataacactatccatgtcataggttgccgcaggaattcgatgtcatcagccatactgggcacagggcatactgtctacatcatagggatgttggtcttccttcccttagtgacccactgaccttcacctatggaacaccaaactgtcccagggccctaattgtataaaatggtcagctccctgtgctggagaacagctcacattcctgtggatgacggggatttggcttgcctttgattactttctttttctcgggtgtgggttccaagtctcctcttattcaacccagaggctggggtttgatgtttcctagcccctgggatgagggatggccacgctagactctggctttcgctgagaagatggtggagggagccgtcagcagtgtctctgtgcaagctgagccctaatgcatagttggagcccagtgcgtgggaagcacattcttctgaccacacagcttgccagacacacagagcgcgtgtcggcaggagcacaccaccgggagagtttggcccggggcttggaagttcaatttgaacaggcctccaaaactgggaacagggctgcagccccagacgaatctccaggcagcttctgtgagctctcatgtttcctgcttccaacctggccagggattgcaagcttgcgtggctttcttgctttcccgcttctgggcttaggctacccgggaggcccagaagtgtgtgaacacaaggaatagctaggggtcggggtggaatcaaataattccttatttatatttcagggatcacgtagcttgccccttttttaattgtccatttcgtggagtgcctaagatcgcccccatttcagccttgttgaatggactgataagactttctgcttcgtatgatagttaacctttgccaataaccagtgtaaaaggcttcggtggtgatatttgcttctttgtgtcttatctcttcccaaaatagaaggtgatgattggagaccctaattaccttgtatcttgtggaaatcttgctatatgaaagtgtaacaaaaatgcagcagctcacagtagcgtatcatttgtagaaaggaaaaatcataggccgggcgtggtggctcacgcctataatcccagtactttgggaggccgaggcgggtggatcacttgaggtcaggagtttgagaccagcctgaccaacatggtgaaaccctatctctaccaaaaatacaaaattagcctgatgtggtggtgggcacctgcaatcccagctacttgggaggctgagggcaggagaatcacttgaacctgggaggcagaggttgcattgagccaagatcgtgccactgcactctagcctgggaaacaagagtgaaactccgtctcaaaaaaaaaaaaaaaaaaaaaaagaaggaaaagtcgtaatagctagatctttctgagacccaagagttagtgtcaagacaataaattagctgttctgcagcaagtatttaatatttcagtgtttagaatcagtgtatgtggcacattcaggctgaggccaggtgttaggagaaactggactgagaacgtggatagacgggcattggccatggtagagaccaagaaaggacatgactagtcatttcaggaaccttagtcatgggacatggaggaggtacaacagggctaagtttggaagcgtagagacccgctagacgggcagtgtggaagtctcagggggaggggcagacagtgaagatggcctggactaaggcattagcagtgggaaaggcatggtgtggacacatgggaaggcattttggagttgaaatcaacaggacttgggaggaatgtgtaaagaataccggtgtatagctctccgattaagagagacaaagcattggaggagttgaaaccttgaatttgagacgtcaagggaatgtcagtggggaagtgtcccatagacagttgaaaatgagaacatgggtctcaggagggaggtcatgatggagatacgaacttgcgcatattttgtatgtgtttagaattaatgccttgaggatatatggaaatacataaacttaatggaacaattcctctatttgaagggacagaaaaagagaagagccagccagagattctaagagggcagggagagacagagaggcagctgagggaaggggacgggataaaactaaacagaggggctgggtgtggtggcttacacctgtaatcctagcactttgggaggccgaggcgggtggctcacctgaggtcaggagttcgagaccagcctgaccgacatggtgaaaccccgtctctactaaaaatacaaaatattagccgggtgtggtggcaggcacctgtaatctcagctactcgggaggctgaggcaggagaatcgcttgaacccaggaggcggaggttgcagtgagccaagatcgcaccattgcactccagcctgggcgacaaggacaagactccatgttaaaacaaaaaaaacaaaaacaagaaaacctaaacagagggaccattttaaaaaacaagcaagaaatcaatagcatctgaagccacagaggaggaacaactgaggagttggaggacgtcatttgcgtctaacaattcagaggttcttcataagcttcaggagaggcaagagtggaacacagattagaatgtttgagaagtgaccaggaatgaagaagacacaatgttggattttaaccaacgcttctgaaaattcaggtttaaagggcaggagagcaagtgttgagagaaaagattttaggatgatcagatacagatctataagcagctgaaagaaagacactggtgtggctggacaactggaggtagaagagaatatggttatttagtctaccttcgctcttcaaaatgatcattctatttatttataattccaaaacaaatacatgtcgtgttccaggctctccgatgatcccagttgacctgtcttcttaatcttagagccacactgcgttttcttttcttttctttctttttttttttttttttttgagacagagtctcactctgtcacccaggctggagtgcaatggcgtgatctcagctcactgcaacctctgtctcccaggttcaagtgattcttgtgcctcagcctcctgagtagctgggactacaggtgcacaccaccacgctcggctaatttttgtagttttagcagagatgggattttgccgtgttggccaggctggtctcgaactactgacctcaagtgatccgcccaccttgacctcccaaagtgctggtattacaggcatgagccaccgcacccggccacactgtatttcttatagtataccgcaactggtttttaacatcagctatattttctatctgcattttaagaaatgaacatatttcctttttgttctggcggtgttttgaaattagttatttctcttgcttctttcttgatttcagtgtattcatcgagatttagcagccagaaatgttttggtaacagaaaacaatgtgatgaaaatagcagactttggactcgccagagatatcaacaatatagactattacaaaaagaccaccaatgtaagtcgatggcagtaacacagtgggcaggggcgggggtgaggctcagaatgttccaggaagaaaggccgtcaatgttgagagctgggtgggatggctggggacccattcccctgccccgattcccgttcttttgacttactattcacaaactctcaatatgcaaatttagcctctattatgtcaattttagtaaatgtgaaacacttatatacagaataatcagcaaccgctaggattttcttatggttctcatcaagaactttcatagcaaaaactacagcttggaagttactggtttaatttttgcctaataactggtcaaggagcatctgtgtgctagggagataaaggatagaatccaaggagatggcattttattaacggcccagacctgtgcatctcacacattgttcatggtcctcattgggactgatttctgctctattgactgactagtgaaaaccaagaatatcagctcttaaacagggcatagccctattgagcctgctaagataaattcttttaaatatatttagtttttgcattttcctctacatttgcaggggcggcttccagtcaagtggatggctccagaagccctgtttgatagagtatacactcatcagagtgatgtgtgagtaactctcttttctctggctttttcctgggcttgagctgcaaaaatactgtacgtacttcacctttcttccttctttagtggctgctgcatttcacacattcgtagaaggtgcaggagctggccttagaaaggacagattttatggtaggctgataaccaatgctctgttactaatctgcctggcttcaaagagcacagaaggtggaactgctgacctccccctgccagagcggaagtccttcccttgaacatattcatggatgtgcaactacaaagcggttatctaattcgccaagctcttggcatgttcttcactccattaaaggagtaatcctggagcttttcccacttacgagtagtttgtcatatttccctctaacccagatttgtccttaaagagtggagctgagtgagatgtggtccaggctggggacctccacagggtctactctctatgtttatccctcaacaaaaaggtctgatcttgctttggcatccttgatagcattctagaaacacagtagaatatttctattatgatatactgacaaaaccagtggggtcaggctccaactgatattttagatttgaaaattcagttgaaggctgtgtgcagtgactcatacctgtaatcaatcccagcactttgggagggcaaggcgggtggatcacgaggtcaggagatcaaggccatcctggccaacatggtgaaaccccgtctctactaaaactacaaaaattagctgggcgtagttatgcgtgtctgtaatctccactacttgggaggctgaggcaggagaatcgcttgaacctgggagtcagaggttgcagtgagctgagattgtgccactgcactccagcctggcaacagagcgagactctgtctggggaaaaaaaaatcacttgaactattttttatttgtatgagcaggaggagttctgggtaggcattaattctgtgctaccatagttggtcctctcaacaatcctaaaaaaaagacatgactatcccatttttgctgtgagcaactgaggcacagaggctgttctgcctgtcctgtgctgctgcttttgctctgtagaaaactgcggagtgaaacaccaccatcgagtacagaaggttgagtttccagaacgaccatgatgtagctaaacctggctctctcagcttgctcctcccagagattgagcctcctgaacttggcacaggaagtccaaatctctgaagagtcaagtgtaaataaattatggcctgtgagatgtgttcagttttgttgtgtgcaactcatctggggcatgtgattcctcatcctaaccccagcccagtgctgattgcctttgcgatcttagtaagttccagagcctctgtgcagcagatgttccgccagccacacagggcagctgtgatcctgcggagttggcttgctggccttattctgtcaactgcccatcctggtagatcacaacccttgggtcaggcacataaggagttggaaaggagcgtaaaggctttgaaactgagaaactgagatccttgcattgctaacaccacatttaagacaagcagctctattccagagtgatggcagtttgcctttttgtctattgatggaaaattccatcagcacatccccgtgtcatcatcattcggggatgctcttgcagggcaggaaagagcacataggaggaactgcaggagggcccatttgtctttgaacttcagaagtgaggaggtgtttatgtctcagctgggcgtgtttaggttttggcaacgtggatgggttagtaatgccgtgctttctccttttgttgcagctggtccttcggggtgttaatgtgggagatcttcactttagggggctcgccctacccagggattcccgtggaggaactttttaagctgctgaaggaaggacacagaatggataagccagccaactgcaccaacgaactgtaagggctgttgtctttcctgccggtgccccagtggacttgccacaccagtaatacctctcctgatgtatctcgtttttgaaggcccctggtttcctaaacatgctctaagaagaatggctgaagctctctgggctcaatccagagctgggatacatagcgacaccgacaaccattacttgtctgagagaaagaacattattctgagtatggagagggctttggatcagagggtgtctggctgcctggctgagggctcctgactttgcagagccagcaggagtggtcttcctgggccactgtgctgcaccttctgcggtctcccgtggagtgacaggaagacccacgggtcaggaaacaagctagaaagccgcggggccgccctgcagggtgtaggattaaggaaccaacacagcctttccctggtggttgtgcctggcccccgcctggccccatcgtggccagtagagaatcggtgtttccagaacttctcgaaccattgaaaattgccattacagattgacgccaaccacatttcctcagagcgaaggaactcgtgtttggttacctaggtctcacttgtgttttagtgcagagaattaaacatgtgtccaggcgccctccttactgtaccagatctgcctgtaaaaccatgaactggtttgtagcaaaacctgcctcacactttaagtggagttatgttgtgtttgtgacgtgtgcctggtgcaatagaatcagtgctttgaaaggagtctctctgcctcctgcctcaacccctccaggattaactaagaagagtgattgtcccagaaactgcggtctattgtgtatcatttcatggggattttatatcagtaatcccgtgagtgcttttcggtgtaccgtggatgtctgatgaatggccacattttatagcatattatataaaggcatttattgtgctctttgtcattcctattgttttttttcttttgtaacgtagaggatctgtcgaaacccaaaatcaagataagacctgggaagctaagcctatctaagagttaatcaggaagttagtgtgcagcccagtggtggcagattaattcatcaaaaacttgaagttgtagttttcaaattttatttaatttttttttaactcaggaagctgtgtcaactagaatcattaagacccaaagcactgggcagataaatagtggagctgctttggtgctgggcagggtgtcaggggagggaagactggagaccagcccatggaaatacgcattttccttcagcctccaaagcatctttagggtgtgacgccattgtgagatgtcactgtggcccagggttaccagggaaaacacatagctgtgtctttcttgatggcttcgatgcctttctaacatgtttttgtaagtcaaagtgcctttcggaggaactggcagggaagcttttgggaaagtgattcatgaccccctaatctagttgcttggaaggttctgatgcattttcctaatttacaccacgtccccatattgcctattaaaactgactataaccacgtacccagtgcatatgaaattaattcaaggaaatccatttttcccaggtacatgatgatgagggactgttggcatgcagtgccctcccagagaccaacgttcaagcagttggtagaagacttggatcgaattctcactctcacaaccaatgaggtaagaacttccttttagaagccccttgtccttggttgtcttgtgagacatgcgtagtgttttacacacacactcccctgttggctgttggttggagtctgtggtcttgtttattctttttccatagggtcagatagttcaactatgggttcctctcaaatcatgatttttctcagaacttcattttgtgagttctgactcatgaaaccaaagacagagggacatccccgaggctgccttcagtgtagctgctggtggagcagtccggggtatgtgggagagtgggaaaggggaagcagtattcacttgcattttggtgtgcatgggaaaaagcttggattcctgtgcaagtttgattctgtgctttggtcattagtgggtaaactgataatgttcgtcatcatttgcttgatggaatacaatgaagttttgtaacaccagcttctgttaccacagtactatcctatgtgatcctgttggtaatgctgtatgccttgcagcctctttctaggtgtatataaacatacactgttttctacaatgagcaacttacatgatttttacataaaaacatgtaccttttgttaaaatatttattttccctaaaatatttatgctctcgcctgtaatcccagcattttgggaagccgaggagggcagatcacctgaggccaggagttcgagagcagcctggccaacatggcgaaaccctgtctctactaaaaatacaaaaattagttggatgtggtggtatgtgcctgtaatcccagctacttaggaggcgaggtaggggaatcgcttgaacccaggaggtgaagtttgcagtgactgagattgcgccactgcactccagtctgggagacagagcaagacttcatctcaaaaagaaaataataataatttatgatccttgccaacaaaataaacactcgtctgtcactcactgtgcaaatttagccatgtcagtggctccttcaatatgcagatagagtgccttttataattatggaaagcatatgctctgagcaggaaagatgataaacccatcaagtctagtcaaatcttaagatagagaaattgttaatgaatgtattttgagatatttaatgaggatgcacaatagtgttcttttacacaggaaactaactccaaaccatgcaattgtctcaacaagaaaaaagttaaggtcccccaagtattttagaaggaaaataatacacttaatttctgatttaggaaatagttttagagtgattttttaaaaagtaataatcaaatgtagtgatatgaagtcttagctcagcagctttatcttatgcgtctgactgtggcctgtgctggataaaggaagagattgcacttaaatgaatacagctgaccttcagaagttgaaaggaaaggaacggttcaagggggggaagaaaccaactttcttcttctgccaaaattgttgtttctagtataagttcctttaactgtagacttggaatctactgatatccctgtttttttcctatcagatctgaaagtttatggcttcattgagaaactgggaaaagttggtcaggcgcagtggctcatgcctgtaatcccagcactttgggaggccgaggcaggcggatcatgaggtcaggagttccagaccagcctggccaacatggtgaaaccctgtctctactaaagatacaaaaaattagccgggcgtgttggtgtgcgcctgtaatcccagctactccgggaggctgaggcaggagagtcacttgaaccggggaggcggaggttgcagtgagccgagatcatgccattgcattccagccttggcgacagagcgagactccgtctcaaaaaaaaaaaaaataaaaataaaaaagaaagaaactgggaaaagcactaaagttctattttaatgatctcatgtctatgctcaaagtgatttatttatatatttacatgtagagtgggtccgttgatactgaaatttgtatctagtaccctaaaataaaaaagcagaatgccatattgtctggtggatataaaaatcgaagtttctttccttctgaaaatcattaccatatgctcaagaaaaacggttccatttaggacaaaatttcgtttttatcattgtaagcaaaaagttctcttttgatgtggtgggcgtgtttgtttccagttgtgtggttaatgctgatgttgttggaactgatacattccccttctgggatgctgggatggggactctttctcttgccaaccctggtgatgaattagagggttttgtgtgtgtgtgtgtgtgtgtgtgtgtgtctttaaaaatgtctagttgccaacattccatgggctcttttctgataacactgaggctgtttgtgctgtggtctgcactttttgccccctctcagcaaaaccacatgtcatagaatagttgttggcttctggatgtgtgagcagaactgccccactgtgccagcccagtggaggcagagagacccacaagttcccaatttagaaagcttttcatagcttcagaacaggggtcggcaactgctttctgtaaagggccagggagtaaatattttcagctttgccggccctgtggtctctgttgcaacttcgccactgtagcctcaaagtagccacagacaatatgtaaatagatgtgttctagtctgtcttctagtaaaattttatggatcctgaaattggaattttatataattgtatataaattttattcattttaatcctataagatattcttcttcttttgattttttttttcaaccgcttaccaatgttaaagaccatctttagccctcaggccatacaaagtcgtctgtgggcacccaagtcggaggaagtgtcaccctggggtgatccagagggctttttgcagcaccagcactggatgccttggggagcagaggacactttctgaatctcgaaccttcaaaactttgaaacttaaccgatattttcctgaagtttcctttaacagtgcattatggatttaacatacatgagtatgtctaagccttttttgaacctgtttacattttcaactcggagagcttctgagagtaatcagttacatctgttaaattacccactgaatgaagaagtattccccttcaattatccccgaaactacaatagtaaaatgtaattcagaaaataaatattcatagtctcaactacttaaagggggtctggggacccacaacatgttaccggttttcattttgctggggctcgcatttgaagcaagggctctagtgaggaggtggtgtagactcagcgggttatttaggtccgtgtgaagccgagttgcctgcccagcacctatagctcaactaggttttattgttctctacctgtcaatagttgatttatgatggattccaagagaaaagctaaggacagcctggggtacatcagacgtggtctcagggaggtcttcgtggaagtcaggtgggctgggtctctgttcaccttctaggggtctcctgtcctgtcccacgtccaatacccacatctcaagagtttgtgtttgaaataaaactcttctcttcccttctttcaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtattggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaatactcgtgtcttaccaaatggtttcctgtgcttggaggtgctgactgagtgctgttgtgaatgcaggaagggcagggctgccaagggtcttatgtgctacacacgggggtgacttgccagaggggttgactgagaccagcagtacctgtgacaggttgaggttgatccagtggaaaatctgaatcagttggttggagccctggctcggttgcttactggcacctcaatggaatcatcgttcctttctgagccctaccagttccccagaggagca

SEQ ID NO: 1133 - DNA, 2079 bp, Homo sapiens
tttcctttagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtggtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagaaagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatg

SEQ ID NO: 1134 - protein, 471 aa, Homo sapiens
AHRRLKALRVVHARRGSVQMGLTSTWRYGRGPGIGTVTMVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTESFG

SEQ ID NO: 1135 - DNA, 32185 bp, Mus musculus
  misc_feature (1)...(32185): n = A,T,C or G
cctgcagttacaaatgtaatttctttttttttttgttgtcaaacataaggtaccaaatatgcaataaattgttttgaaaaacagttgtgtgaatatttccactaacctgagttgggcttctgtgaaatgcacaggtggaaacagaggttgcaagccagaggcaatgaaacacactgtagggctagtatagaggggagcttttagagccggctaagtggtggtgtcaggaaagttccagaactaagcagaatgctgctcctttgttcagatttcactgaggctaggatggtggcagatcctgtgaatgtaattcaaatcagaaaggaaaagtaaacatgaccatttggattgggaaaccgagccttaaacaagtcaaacctgtacactgagaacgagcctcaggcttaatatttctttatgtttgcaaggtctgagcaattaagttcaatgaattaagtgtatataaaatagaacttttgtagtattttagttatacatagtacatacactaaagggaattttcagaagatcagatccttttatttcatagtacatgatctgcattccacatcccagtctagcaggttagtgatgcaaagatacttccagtctgaacttcagtgcttacacaggccctgtctcaggaacatcttaacagatggcaaaaaaaagtgagcagactttacgaatttttctcctatgagtggcaactaaggttcctgttgtttggaaaaaacactagtggtatgtccgctactaattcagtgttggaggaggcaccagccatatagtaggggtgtgtgtgtgtgtgtgtgtgtgtgcgcgcgcgcgcgcgcgtgtgtatttgtttaaattctactgtatatcaccatgaaatctgtctgtttgtcttgacaatgtttaaatgatgtagattgtcttagaatgaatactcagaagtactcagaactccgattccgatgccacccgagaggagtcagactcctgtcatgtatattgtattccaaccaatttactggaactattgaataaatctttattttctttcaggtttatttgacagtggatacattgtctggtgtcacaggaccttgactgggttcacctaaaacattgtactttactctgagtatatatttatttcaactggatcatttcacatttaccccgttgatattcagttaattatcagtgatactgtgggggaaaacagggttagataaacaagttggaaaaatgcagtgtgatgttgtaatctaaacaagtgccttatgtttattgctaagaactggtgttatcaacccttttactaagaagggtccctcggcctgtattcatgtaggaaagtgaagagccttctgttttcttcatagtcacttactgtcatgtctcattgaaagttacaatctgacgagcttagtttacttagctttaattagataggtgagtcatacattttcaccattttttcctgtatttattatgcacaataaaatgatctctaatagcatgactaaaagtagtgccgatgttgctggaaagctttctgggtcgtacgaggccctgttttttcaccgtgattgtaccgcatgctctactactctcagctgtgaagtgaaagctgtgaatgtatgaagagctcagaaaaccatggagtgttgtgacaaactcacatcctttctaatcaattggtaagactttctgttgccgggcatagcatctgtttggggaaagctaaaagggaaatactgaaaatgctaggcatttgttattttagataattactgtccttggattctgcaggtcgaccttcctgatgggaggagtcttcctatctgcatcgtgctcctggttcttacatttaaggattcttactaccgttttgctgttgtctaagctttgctgaacccattgttaagtctaagacacaaacccatgaaatggctgtgttgcgccataggaagcagaaatggtttcagtttctgctggttgaaaattgaacaacttgtagcaataaaaagcttttggaaaaggttatcaagtttcacttttcccttctgcagctataagctggttgtggaaagtctgtggtgtgtaggaggctctgaagaaggctttacttaacaaagggtgtcttgtatatatactctctactaaatgtagtaaaatgagcctacttccgtgaagatatacccataatattttttaaaacacacacaaaaaaactaagggtgctgagtgtgagagtgcatgcatataatcccagcacttgggagatggacttgagggctgccctgcaaaggcaaagcagggacgaagcctgtgggagtcaggagtcggctatttgtgtatgcagtgggtcctccagcaacatcatcttgggataagagctagaagaaagaatagcttaggaaaaagtttggtatggtataaattagaatttactgatgttataacctctgttttatttaccaaaaccagatgacagcctttgtttaaaggcttatagaaaacttaaggctgttactaccagtgcaacaaactattctgaggtctgtgtagcccctgctggcctccaacacagaggtcagccttcctttccctcctgagtgctgcgattaaacacatgtaccatgcctatctatgaagactttaaaaaacttatgtgtgcacacacgtgctatgtgtggggagtgcattgtgtgtaagtcaggacaacttaactagatcatatctcacctcccacctttacccagcctttacaagtgcttcaagagtcaagctgcaaggcaccttcacctgggagacacttcacttgcccataagtgaggccttggtctgtactttaagaacctgtatttcatgcagttggcttatttctacatgttggtagtctcattgtaaagatggtctggccttcctaaggacaaactttcttctcacttaggaatgacatgattttgaaagtgtgttctggatctcatgagttgatttcaactaatgatgcgtgtcttctgttcacctgtacatcactgacacagggactctgctgtctctggttttccactgtttggtcctgagtgaatttaacacttgtttactttgtaattgcagatttttcaggacacacggctacattgttctttcaaacgggctcttcttaggagctctaccctcaagtaaccaatcctatgctgctctgttacctttccaaatgatcaagtcacctcttcaggcagatggtgacgagactattcacctgggctctggagtaccagatactgataattcttaccttccttaacttagtttttaaaaactgagatcaatagacatatttaggaacatgtattcagcacttgttcagaaattcattaaaaaggacctaagaataagccaactgcttcacttgtttttgtttttatagtttaaaacagtctgttttgtagttttaaacagtccattgaacattttctgtttgctagaatttttgtgagtgaaatgtcttaacaaagttacatgactaatgtgttggcttaaattcttgtaagtcttccccaccctgaacccccagacagtttctgtgcatggccctggctgtcctggaactcacaggctggtctcaaactcacagagagattcattcgcctctgcccctcagtgctggaattaaaggtgtgcaccaccatgcccggctgtaagtccatttttaatttttaaaaattcttttcattgtgtgtaaacttggaggtccaagacactttgcagtagtccgttctcttctcccatgtatgagtcccaggatttgaactcaaaacatcaggcttgtggcaagtgccttcacccacgtagtaaacctatgcaatcttagacaaggataagagcgatgcgtaatagatattcaaactcgtgttgaggtttgtgcgactataattgcccccacagaatgtaggaggtaccaataactgtgaacttaggtcatccataaactcaaatttcctaaaccttagctatggttatagaagagtcatcttcttggtcctatctgttggccttgtataatcatgtcagcatactacagataatcatatttattgactttatcagtatgttttccacattaatctttgctcttatatagctcatcagaaatggttgtgtctttgtaggatacaggtggtggaagtaccatctctcattttttccattgttgtgatactggttggcattgaatgagctcatcttgaagcaggcacttcctaggtactgccatgcctagtgggactgacttactacaaaggatgccactcgttttctaattcttcaaagaatattaaggacattggtgacaggcatactacatccctagacctttctttatttaatagcctaacatctatagtcttagtatgcaggattgtttagcttctcagcatcatagtgagagtcattcacagccatccgctctagtccacagttgtgcttgaaactgtaaactcagccctgatcctgtattcaaatcccaggaaaactctataaacatgattttgaaagtgtgttctggatctcatgagttgatttcaactaatgatgcgtgtcttctgttcacctgtacatcactttaactgttaagctttctgattggtttaccatccacaataagtcatgtttactgtactgagacaccagtagagaacaaagaaaaagccaacctgttagttttatgtcattgaaacaactttgaatttcccctagacaacagcgcttttaaatggacagggacaaatacttgggcttttaaataccaatccagtacttgtaaaaacagctgaatttgactgttttcactacgagattgcatttacttgtaaataaatgaatccctattatgagaattgtgccaggaactttggcagtagagccaacgttggtaaaaggattgacaggttccaaagtcgtcaagtaaatttacctgctgagggtgttgaccaaacattctgggtaagactccaaaatctagctggtatttatagttattaaaaggtagataattttgtcactcagcctcagttgtatctgggatgttttctgctggttagtgtttattaaaaaagaagcaggattgaaactatttcttgcctctctagagtttatattattcctcaccatggtacacctggaggtctccattttcgatctgccttcacagaaggtccagaattagtaagattattttctttgatcctgtgactcaattgccaagtaacagcacaaactctaaaggtttcataccacagcagtataatggagttgttgcagcagcctgcaggtaagttagaatcaggttacagactgactcatgtctcagacactgtactaaaaatttctaggtcaaacatttagatataacttttaacttttttttcccactgtagcccaatgtagagtaaacaaggttattcttgtcagtattgctattttcattattcctcgtcattatcgcctgctatggctcactaggccaatatttaaggaagcagtttataattctttccttgataccctacaaattttaacttttacaaattatatttgtnnnnnnnnnnnnnnnnnnnnaatgaacaaccagggctcacaaacaaaacaaaaccaaatcccacccccacccccaatccagtaacacaagaatgtctaaataggaatggataaattgaactatgtaaagttctgtagctaaaatgagtaaattagcaaaacttaattaagaattgccttccatggagctggggaaattggctatcttggtaaagtcttgccaagcaagcctgagcacctgagttcatgcccctgcacctacatagaactcaggctcacttagaatttcagcctttgggagttagagattagaggatccctgggatgctggccatagaggtgagaggattcctggggtgctggccatagaggtgagaggattcctggggtgctggccggatggcctgatacagagaccttgtcttcagcactcaggctggtgaagtagctccaggtgagggcctcagacatcgagtgctgacctgggactcatatggtggaactccactgatatccatgtgtatgttgtgatgtggctcctcacacacatgcacacagatatgtaattcaaaaaataagataggggctggagagatggctcagtggttaagaacactgactgttcttctagaggacctgggtttagttccagcacttgggagacagaagcaggcctgctctacatagcaagttccagaacagacaaggatctctgagaaacgttctctccacaccccaaaggattgagattgatagaggatacctgacattgatctctgtcatcaatctgggtgcacacacggtacacactcatcagcacgtatatacgtactgtaattgtacatagatttaaaccaaaaggaaaagtggaatgtaactgatacataatagcccagaaggaatgatttgtacccagttgaagaaatacatgaagaaggggggttgtaaagaggaaagatagttgcagcaggaaagaagtatgaagagaggtttgctggagaaatggtgtagaattcagagaggatgctcctgaaagtctggtgtcccaactccatctcccaagggttgggattagagtgcaccaccacacccagttttatgaagctctacaagttgaacccagagctttgcgtatgctaagtaggcactctcccaactgagctatgtcccagttgaagcagaaaaagtgtcttaagatttttgagatatatatatatatatatatatatatatatatatatatatatgtgtgtgtgtacacatatgtatgtatatgtgtagtgtgtgtgtgtgtgtgtgtgtgtgtgtgtgtatggtttttcgagacagggtttctctgtgtagccctggctgtcctggaactcactttgtagaccaggctggcctcaaactcagaaatccgcctgcctctacctccctagtgctcggtttaaaggcgtgtgccaccatgcccagctctgacttttatatttatcaactataaaatgatagttgtaattaagtgacttttcaaaataactacttctggtgctagagatcaaatgtgcctcacagatgctaagatgtactctaccatcagctccagtattactctttatgttactaaaaatggctcatggaaaagagtgcattctccctgtgtagccaccagagggcaccagtgaacagtttaacagccatacccagcatcctattttggagaaatcactttttcactatatatatctactgtagaaaaaaaaaaaaccaaaaacaagtttagtcattcataaatgttatcctaagagaattgttgagattttaagggtactggggatcaatgcagggccttgttaggtaaatggcttaccactgagttttcttttttttttttaacatatacatatttattttttatttggcattataaggacataataggtatactgcttgtttgagagagaatctttatgtagtcctggctgtcctggacctcagtatataaaccaggctggccttgaactcacagcagtcaccctgcctctgctcctgctacattcagcaggttgactttgaacttgagatcctcctgccttatccttctgcggacccgggatcatggctatgtgccacctttcctggctgacaaactatcagcttaggcaggaactaagagttgggagaaagaattctgggagagaaggaggtgggaagatttgccagaaagatacgacgggatgaactcatggtacctgagcacaggtaaccagccacatggcagaatgtaggctagaataaacgggatattttaatttatatctaatcagagaagaacctagctatatggccaagatatttgcagatatattttgagtctgagtcttatttctggaaggagtaaccagggcccaaccacaatgtcccacagtgcaacaccaaaatgtttataaacagtacagttccttgtatcacttcttcatgcctcgggtctcccatggaggcagaaaaagcccaagggccaggtgtttcctgagagcacacagagttgctttacagaagtgctatgcactgacgagatttagagagtctattcaagcatccatgtccactcatttccactcaagtgaaagaatgttcattgtgttaaatataagcatttttccttagtgggagagaaagaaggcctctgtcttagttattcttctattgctatagcgaaacaccatgaccaagacaacttagaaaataaagcatttaattgggggcttgcttacattttcagagggttagtccatgatcatcatggcagcagccaggctgaacttgaatcatgattatcctcctgcctcagcatgtactattatatcatgcagttctacattttcaatggaacttcaataggacccaagtctcaaaatgaaatgtttaaaatgcccaggatgtaagcccaattactaagcattcaaagaatgcgggaaatctcagtcctcctaggaaaaatgctgccaacactgcacacagatggtgaaattatctcatgaactattaaccatttaatggaggttaattctcatttgtctcatgtctgtaaattcaggcaaagtgatcaacagctttcttcctgggctcttttctagggatatttgtatagcaatcgttttttgcgtgataaaaaatatttttttcttcttgttctagggggagtcttgtttggtctccaggatgagaaaaggcaccatcactcttctggatgaagctggacagattcagagaccatttatgaaatacccgtttcctgcagagcatttcctgtaatgctaccacttacatcggacagacatcaccttggcctcatggcatcacttggggaatggggtatactctgcctctctgagaaggtgccttttctttctcacctaggagtttcattgacagttcatcaactggcactggaacttgttgacttacaaagttaacatgtcagatccttcagagttgactccaaaacgtctccatgtaaccactaacatactgttccagccttctcagtactgggattataggcatgtggtattacattcagcttaagtggtacttatttttaattttaaaccaatggtaacattcagccaggcatagtctcacacctgtaaccctagtattcaggagactaagacaggattcccacaaaaatcagagccagcctggatacacagtgaggttctaggccagctttagctacaatatgaaaatcctggggggggggggctggataggaaagaagggaataaggagatggttctaaatttggatccccagaacccaaggcaatgctgagcaggcatggaagacctcctgtaattcctaccttggaagatggagacagaatccccagagcaagttagctaccaagactagctctatggaatgagctctgggtttgactgagagatcctgcctcaaggagacctggctgtcctggaactctatggagttgaagagaatcacagagatttaagacttgtgttgctcaaaccagccgaaaacaatttgtctcttttacaaaacaaactgagcgggtcgtggtagtgtacacttttcattgcagcaccgggaaggcagaggtagaggagagtctctacggccaagatcaggttcaggagctgagtagcctctcaccctcctgcccacgccgttccgccccgctccacggaggcccggaggaagcggtgagcacaggggatgctcagagcccaactccaagccccaaccccggctgcgaccaggcggccacgacgccactgcgccgccgcctctcgcgagaccacagccgggccgcgcctccttcctctccgctgtctctctctctctccccgcccccgggggctgcgcagcttcctccagagctcgggaacctcggacgtggcgaggcggtcagaaggctggagcgcggcacatagaggtccctcgggcggaccttctgagccgcagtccagccagggagcgccgacgcatctttccaggtacaccgcaccgactggcggaggcctactgcgcgtgcgccggggccttagcggggcgccacacctgggtgggcaggggctgctcgcgcacgcgcgccgcggtgcccgcgggctgtggggagttgggcgtcgtttgtcactgctagggagcgctgtcgctggcgtggcgtcattcccgcggcttctgtgctccggctcagctcggggcggggcgggaggatgacttcggagatggagtcgtcgctggaggtcagcttctcgtccagctgtgcggtgtcaggggcgtctgggtgtttgcctcccgcccgctcccgcatcttcaagatcatagtgatcggcgactcgaacgtgggcaagacgtgcctgacttaccgcttctgcgccggccgcttccccgaccgcaccgaggccacgatcggggtggacttccgagagcgagccgtggatattgatggagagcgcatcaaggtgagccggtggggcggggacgctgtctcagcggagtgccgctccttcttggcaggtgtcgggacctcaccctgggtctgggcaggagtgtgcggtgcgccccatggcgtgggaaagtgtgtttgtatctatcaaacttctgaggcattgttcctccacctctaatgtacatcaggtttacctgggacttcttgtttttcaaaaaagcacgttctgatttgataagctcccctataacgcacatgcaatgagtctgtggaccgaccacactttgagtgacagaggtgtagggggcggtcacccccccactcccacccccattgcttgagtgagagttttgggctgggaatctgggtggtggtggtggtggggtataaccggaagaaactcagaaatttttcaagcatagaaaattccgttataagtcgggcctgggggaacacttcttaaatctcagcactctcacagagaccaggatctctgtgtttgagatcagcgtggtctaattagttccaggatagacagggctctcctggatagacagaatacacagagaaaccctgtctcaaccaaacaaacctcaaacaccccaatttaacaacaacaacaacaacaacaacaacaaaacctccgttatatctaggaattcttttgagcattgcacagatgctaagtattgtgggagtaaaacctgttgcctttgaggcgttttctgtatgataaccaatttatctagggggaaaaaaatctgttttctcattgaggcatttatatgtgatggttcttaggtggtttgccaacatcatatctcttgttgcaaaaacagaccctctcccaggtagctactgagactttgtaatcatagtaggaagtctaaggcagccaggttgggattctgaagggttgggttcctcaactgcagaataatgatccttgacaagtcaggggcctcctgatgctgtaaacctcggcactgttgcgaaactactaagggttacttaatactactccttaaaacatatgagatggaggtgtgtgtgtggggggggagcacccgtgtctttaactctagtattctgggagatagaggcaagtggatttctgtgcgttcaaggcagtctggtgtatatagttagtcccaggacaaccagggagactacaaactgcccccctccccacatatgaaacctgggaccacccacccccttaagcaactgttttacattgcagtctcctacatcagtctactcagaagaggtttgatttgcccctcctccccttcttcccttgaggcgtcgtgtttccgtttctatactcaccctttcctcaaagagttttacttttaccccaggaacaataaagggcaaatcatcttatttaagagatcaacccttctctgggcccctttgcttttaaatttgcctttattttatgtgtgtgcatgcacaggtgtgcatgagtatgtgtgtatgtgagtgaggtaagtctaggctctagggattgatgtcaggagtcttcctcgggtgctctctagctttactgttttgaggtagtctcctcaacgaatctggagcacactggttccatgagactgactaggactaggatcagggctgggatcacagttgtacaggtgccaagggtacaaatttagcttggcaagcactttctttcctttctttctttttcttttctttttttttttttttttccagaacagggtttctctgtgtagccctggctgtcctggaactcactttgtagaccaggctggcctcgaactcagaaattcgcctgcctctgcctcccgagtgctgggatcaaaggcgtgcgccaccactccgggcttggtttacacttccacatcactgttcaccactgaaggaagtcaggacaggaactcacacagggcaggaacctggaggcaggagcagatgcagagaccatggatgggtgctacttacaggcttgcttcccctggtttggccagcttgcctccctgtacttcccaggataccagcaccacccacaataggttgggccctcgtccattggtcactaagtgtgaaaatgccttacagctgggtgtcttggaggcatttttctcaacttctcttgatgactctagcttgtgccaagttggcacaaacccagccagtatagtgtagaagcctgtggaggcgggaaagcttctggtgtgtgtgtcttttgggggtcagcagttgtggggaaagttgcccagttagcccaggtgcaagtgtgagccagtgatgctatggcatggatttgtctctcaagttcacttgttgggaatataattcccaagctcctaaataatgagacttggaggtgggacatttgggaggtgattgggtccttcagacttatgattgggttaatcccttcatagattaattacactaatctgtggactggttaagggattagttcatagattagtgaattaatctcatttatggattaatgggttagtgggagggttttcctacctataaagctgtgaaccaaatgaacctccattctctaagggtatgggtgctgtgtcgggcctccattctctaagggtatgggcactgtgtcgggcctccattctctaagggtatgggtgctgtgtcgggcctccattctctaagggtatgggtgctgtgtcgggcctccattctctaagggtatgggtgctgtgtcgggctttttgttttgctttgcttttgcttttctgaatattttaattaatgaataaatgtagagaccatcctcctgtgctctgcagccctggctgtcctggaaccctctttgcaccacagttgggttctaactcactgaagttgacctgcttctgccttcaatcccagcacttgggagacaggggtaggcggatctctgagtctgaggccagcctggtcttctagtgcagtggttctctgcctgtgggttgcaaccccatttggggttgagagaccctttccctggggtcaactaaggccatcagaaaacacagttatgctgggtgtagtggcataagcctttaatccaagcactcgggaggcagaggcaggcggatttctgagttcgagaccagcctggtctacaaagtgagttccaggacagccagggctacacagagaaaccctgttctcgaaaaaccaaaaaaaaaaaaaaaaaaagaaaacacagttatttacagtacaatgcatgacaataacaaaattacggttaagaagtagcaatgagaatattttatggttgggggtcactacagcatgaggaaatgtatttaagggtcacagcattaggaaggttgagaaccactgacaaagagaattccaggacatcccaggggctatacagaaatcctctcttgaacaaccaaaaaattacattaaataaaaaaatggtggtggtggcggcggcggcggcgaatgggtattaggaatagtcccttacacataggatctgatttttaagtcagtcgctggcttagaataaaggatgtactttcttttttgaaaacaaacaaacaaaaaatctcacataatggttatggttccagagctgggtgtggtggtatccatcttcagtcccaacactcacgaagcagaggcaggcagatctgagattgaggtcagcctggtctacacagcaagttctaggccatctagcaaacagtgagaccctgtctcaaacacagacacacataaacatacacacagtttatgtacatttttgtgtgagtgtgcacatgttcatgcacatgttcatgcacatgtatgtagaggccagaggttgatgttacatgtctccctcaattgctctctactgctgtgttttttgagacagggcctctctgaaagtggaacttatatccccagccctaccttgcactcatgaacctcctgtctttacctcctgggcgctgggattgcaggcaggcacacctggtttgtgcagtgctagggatggagtccaggacatgtctatgctgatggaactgtgtacatataaatctaagctctctccccacccctgtgtatataaaaagtctgtaaaacctttcctaagcagagtctgatggtgcgtgcctttattctcagcattcaggaagcgtagataggcatgtatgtgagttataggcctaccagagctacataatgtgaggctgaggcaggagtatagccttgagttgaaggctagcccgactacttagtgcattgagagcctctttgtctcaaaacaaaacaaaagagccaggcatggtagcacacctaatcctagcactcttggaattgtttgaaaagaactcaggctatgccactgggcagttgagctgtgtgtccacggccgccatcagtctggtagccttaaaaagagtcttcttcaattccacgacagctaagtgagagcctgtctaaacatacacggagagaaagaaaccagatctcccacaaagcctgtacttgctaattgatttctgagtgctagatacatataaatgcaagagaaaatcttgttcacagaatgttggcagctgaataaaacttaattccttaaataaaaatgcatttgactttgagattggttctcccggtcttatccatatgccccttcccgatgtcttgctgcatacctctcagcagtcatttggccatggcagatacctgagtatagcctgatatcctgagatttaacccagatctcctcattgatccgacgtcactacttaaacatatcagggctggtgtctatagacaaaagagtgagagttcactatgttaaaaacaagatagtaatttttttaaagatttatttatttattatatgtaaatacactgtagctgtcttcagacaccccagaagagagcgtcagatctcattacggatagttgtgagccaccatgtggttgctgggatttgaactcaggaccttcggaagaacagtcagtgctcttaaccactgagccatctctccagcccaagatagtaattttaactatggagaaacaatcaagatatggtttctccttagatcaaatatttaaagagtaataattgataaaatagatattttattaagcacaaagaatgataacatggtgtaaggagtagcaaactgtgagagtcaaatgctctactttttgttttgttttgttttgttttgttttttcgagacagagtttctctgtatagccctggctgtcctgtaactcattttgtagaccaggctggcctcgaactcagaattccgcctgcctctgcctcccaagtgctgggattaaaggcgtgtaccaccaccgcctggctaaatgctgtacttttaaaatattatttatttatttttatttatacgaatacactgtagctgctttcagacacactagattagggcatcagatcccattacagatggttgtgagccaccatgagggtgctgggatttgaactcaggacctctggaaaagcagtcagtgctcttaaccgcagagtcatctatccagccctctacttttttttaatgcaatctaaataatttttgtatcattttctgtgctggggcggaacccaaggcttttccatacatgctgctcaggccagtgctctgctccctaagctacaccccagcactgcttcatgtggttggaggaaagaatgagatttcatggtaaatgaaaatcacataaagttcaggacctaccgggtcatccagctgtaatctctatcttttacttcctcaatccagctagcttcacactgcagtttctcctgttactcccatcatcaaaaccctagctaaaactctgtctttaaccctgtccttggggggatggaggtctaagtccagtgatggagtacttgtctggcatgttcgggatgatggctctcctccttagtactgggggaaagccaaacctgcttcgaacttcgttagcagcccagttctcatttaaaaacagtgaacacaagccttcctttgtctggtgcacactgccctcttctttcaggcatcttagagtccagtcaaatcatttgctggtttcccactgctggctagaaatgtctctcctgtattttcctgcaaggtggttattccgagtctctttcttgagaatcccacccattctgcgtccttctgtgtaaacccccttagcctccaccaaaccatcatctcattgtatgggaagactgtcaggcaagaccggtttgagtctggtaacagctcccgatccatgcaggaggagctcaggcccaagtgttaagttgtgcaaacaggtcagttttgaggtaggttaccctggaaatcccaaattcaaatgattttaaaaagaaaaaaaaaaaaaaagccaatgaaaagaaaggtggcaaaggcagggcagtggtggtgcacgcctttaatctcagcacttgggaggcagaggcagaggcaggcgaatttctgagttcaaggccagaggctagcctggtctaaatgagttccaggacagccagggctacatagagaaaccctgtctcgaaaaaccaaaaatataaaaaaaagaaaggtgacaaaggacaaaactctaggtgaatgttgagggtaaagccaatgctagagggctcaggggcaagttacagtgaccggaggtgataacgcaggagcagaggtcatgaaagtgaggtggggcgtccacctctaaagtaagttttcatttattttatgtaccatgtgtgtgcctggtgcccagaagaggatgctggggtccctgaactagatagagttcctgactgttgtgaaccaaatcctagccctctacaggagcagcaaatgctcttatctgctgagctgtctctctagcctctgagtctttacagtttagaacagagtattgctcagttgcacaggcttgtctcaaactccagatagtcctgatacactgcccccgtctctggagtaacagaatcacagatagcagtatgcttggtggaacgttgaattgtatttattttgagatgctttaatttaaattgcatgtattttgtgtgtgtgtgtgtgtgtgcgcgcgcacatgcacgtgcatacttgtgcacacatgcatggatgcacacatgcctatggaagtcaaaggatgacttccgggaggtggtttgctccttccacagtatgggtcctgggattgaattaaggttgtcaggcaaggtagcaagcacctttccacgcctgagcagtcttgccagccctgaatacaggattcagatacctatgtttgatacaggtccttgtcatgtagctctggctgtcctggaacgcacaaagatccacttgcctctgcttggatgaaaggtgtgctccgccacgccaggataggagggttcattaggatcttatctgacaaattctgaatcagttcctaggacccactcatggttcaaaagacatcctctctaaatttaaaaaacattttataaaagtgagtcccaaggtagcagttctgtgctggcccgaggtatgatgccaggctcacgtttacctctgctctctgctctccttgtgaggctggttttactcctataaatgcctgctgtcaggcagcaaggggcaggctgagctgtgacatgggacatgttttaactgctgtccttgtgtgtgtttgtgattgtgtgtgcagctgtgcgtggaggttatagttcttcctcagtcactctctaccttagttttggggacagggtctctcactggaaactgatcagtccagttagtctgactggcctgcatactccagagtccctcctgtcctcacacctccactgctggggtggggtacaggggtgactggcgcaccacctgccgtgagtgctggcgacagaactcagtcctcagatttgccagcaaacacggtaccttctccccgggcctgaaagacagtagctttcatgggatgccctcttcctgggaaagctggttgcatgtaattgacaccaattctgctgctgggtctcccaaagtgccaagaaaatatgagaatgatttataataccgtatatttctaccttcaataaaattaggctcatgttaggaaacaggaagactactaagacaatgaagatgccgggcatggtggtgtatgcttttaaccttagaactcaggaggcagaggcagctgaatcggggagtgtgaggctaccctggtctatagagagcgttccaggccactgaggactatacagtaagaccctaccttaaaataaataaataaataaagataaaataaagagatttggatttaaagaactggcaggtgtaaaagtctaaactgagggctccatggaaggaaggcccagaggtcagaggtacttgatttctgcatcccacaggtcagtggacaaccaactcctgagctgatctctgacctgcatgcattcagcatggcgtgtgtgcacctgtgtgcacacgggataaaaaaactaaaactgcttttaatcccagtacatttgactcagcatgggcctctcatagcactaggccataggtattctaaatggtttttgtgtgttgtatccttttcccgcagtgatttttaaaaacattttaaaagcccatacctgttcagatttataatctgtatttagtagtcacattgtgactagactaggattatgaagcgtggaccctgcaggtaaagacgggccagagagcggagaggtgttacgggcaggaacagtggctgagttgctctgtttgtgccattggactgagcttgtcgactttgctttctgttttcctctccagatccagttgtgggacacggcagggcaggagcggttcaggaagagcatggtccagcactactacaggaatgtgcatgctgtcgtctttgtgtatgacatgaccaacatggccagcttccacagcctgccggcttggatagaggaatgcaaacagcacttgctggcgaacgacatacctcgaattctggtgggaaataaatgtgacttgagaagcgccattcaggtgcccacagacttggcacagaagtttgctgacacacacagtatgcctttgtttgagacctctgctaaaaaccccaatgataatgaccacgtagaagctatattcatgaccttagctcataagctaaagagccacaagccattgatgcttagccagctgcctgataacagaattagcctgaaacctgagaccaagcctgcggtgacttgctggtgctgagtcataggtgtggccattgcgggtctgacttacctgaagagatgattgggaagtgtgacagtgatgaagttcgtaagagtaaatcctaactgtagtagatcattctgctgttatcgttgttatgatgccttttgtattttgcatcctctcaatcaagtttgtcactgagacagcacatggaaaaggccgctttacagtggggattgaaaatgaagactaccggggccatctttccagctccagccagaagcagcagcttcaagtgagcatgatggaccttaaatggttggtcctcttcctctctgggtccctggagcagcagaagccatgctgggtagtgcacacatgcagagcagctggagcgagccgcaagctaatagggtgctttaattactctgtctttaagcactaaaaactaatcaaaagaaagcaagcagttgtaacaggagtttactttagccatgacatttaatcagaatatcaaatattctggtgccccttgtcctctgttcccagtcacagtcagttgggtgactcggagctgatttcagtcagcatccatttggctgggttctgtatgtatgttcctgtaattgtattgttggatgaggttttgacatgcgtgaattttatggccttggtataaaaattggtaaagcaaactgttcccttggtataaaaaatgagttaagtattgaaaaatatacttacctgtccctcaatgatgaaagaaatggtttagaaagattttttttttttgccctaagtacttgtagtttgagtttaaaactttgcacaaaggaaatagcacgtttacatatgaaggtcttagcagagtggtgtgtaagctgtgctcagcctaagtccgcacatcctctttgtgacagcttgcaacccttgccaattttagaggaaatgaagccaaaataatgtcttacttaaatattttcataatgtgggaaacaaacataacccaacctagtttcagattcttgtttcattattctgatggtcccaactggacagttcatttatgaaagcaaaattgttctatttaataaactaagtgaaagtaacttaagggatgattgtacaatttaaatattaattcagtaaatacaatgaaatgaagattaggacccagattggctttctttgtagttagaaagatctttctttggttccttctttttttcttttttttaatagaaggtctctctttgtgggcctgactggcctgggacaggggtggcctcagacttacagataccgacctgcctcttcctccagctgctgggagttaaaggcttctgtcaccaggactagcccaatacatctttcttaatcatgctacaattaaagattaaaggttgtcttctgtctaaatgaatgctgacttgtgaactgttttcctggtgacacaaaatggcggtagtgacgggtggctgcagatgtttgtacggaggaacatctggtcattgttcttccacgttctgtacaccgagggtggggggagctgatctgttctctaagtacctctgtggttttcttctggactgtttcagtacagaactgttaattagtcatttttctttttaatgtaacttttcttaatgagcattcttacaattctgtgaaaagcataattttttcattttagtatttattaatcaaaacatatttgtaactcatttgtaacgacctatcactttagttttagttttttatttgaaaaagatacaacccaggtgagcaaggacaacccctttagatgtggtccaaggcgcttgggcttataacgcactttatagactattgatattactttcaaaatgatggtgaggtgacatcttgttacttttttaagcacaaatcacacattttgtacatctgtgattttattttggctgacatttaatggaaagtgtcacgttttaggaaaaaaaatcttaatttgtgaacagcaaagcaaactcctctggcgtctgttgtggttggttgacagtgtacacctctttgatgttctcccaacaaggatgatagttttgctgtgaaacagcgccacctttaacacttctcccataacgtacaataaatcatctttgccacgaggaagcgtttctttctttggttttctgggttgaatgtaaaattaaagaacgtacttcttcctgtctactgtggttttcagaaaatatgtacggcctacagttcgttcatttgaaaatcccaaatctggggctggtgagatggctcagtgggtaagagcacctgactgctcttccgaaggtccagagttcaaatcccagcaaccacatggtggctcacaaccatccgtaacgagatctgactccctcttctggagtgtctgaagacagctacaatgtacttacatataataaataaataaatctttaaaaaaaaaaaaaaaaaagaaaatcccaaatctgatatttagtctattcaaaacctttcagattttggattgagagtttttggattagggattcccaaccattgaagttgatacagatgactaaaaccaaacccaaagttaaaacctaagggattctcaagaatactcagtgcagacagcacatgtgctaaaaatggctggtgtggacttagctgagtgagcacaggtaactagagatggagaaggaagagtgtgagtcaggtacaagactgcatctagaccctgctggacagggcagaggtagctgttagtcagtttgtgttatctaagttactgttgtattcaaatgctaacttgcatccagagatagctgtcttaatcagatattcaccaactggccctgtccttcagacatgtatgtaggagggagcttgtggagctcagaagaggacatcaggtcaccaggagacacccgacatgggatcttaacttgggtcctctggatcctcagttggccatgtcctagatttgctagaactggcacgtgctattttaatttacttggtttattgaagtaatcttgtctgtccaatgtttgccaaattcctactgtgtgcccccccagtggttgtatgctgtggaattgtataaacaaatcgaactgtctttgaagagcttaaagtgtaggtaaggggctggagaaatggctcagtggttagtagtgcttgtttttctagaggatctaggttaagttcccagcacctattttgggtgcctcacagccacgtgtaactacagctttgggtgatctgatgccttcttctgggcctcacaggcacctgcatacacatgacataaactcacacacatacacacacacacacacacacacacaccccaaatgaggtaaatgcatggatgtcacattaaggaatttaaggaataaatcatacttctcttggagtaggttgaccaagagagcccaactttgactgcttcatttctctatgtgcgtcttccatctgtaggttgtaatttctggcctgtccgtagcccatatgttgtcggagtctgatctacccccttgcttgccctgtgttgcctgtgtgttgtgcttgttcctagcagagagcttgactctgtatctattgaccagcacaggaaacacggtatgggaaaatgagggaacatgttctctacagaactctttaactggtttacaagggaggatactcctgaccttaagtgatccacaggagcactccaaacctcataccttatcaacctatctgtacctgttgtttccagcatatatggtggctatttactttaacattgccttcgacatgttgactgctctcagtaaacaattaccacacatacctgcatgcactcatgcatgcgcacactgatttggctcatggagaggtgcacaattttaagagtaaatatgggggtttgcaaccccataggaagaacaatatcaactgactagacccacccccacccccagagctcccaggggttaagccatcgacaaaggagtaaacatggctccagctgcacatgttgcagaggacggccttgtcaggcatcaatgggaggagaggcccttggttctatgaaggctcaatagatgccccagtgtaggggaatcgagggtggggaggtgggtttgggtcagtgggtagaggaacaccctcatagaagcaggaggagggaggatgggatagggggttcccgggaaggggggaaactgggaaagggtataacatttgaaatgtaaataaagaaaatgtccaataaaaaaaagaaaaagaaagtaaatatgcatttgatttacattgtaaagctgttttgtatggaaaattcaaagcatattaagattggtgacattgttcccttacaggcaaattaaacaggctgagcacacagtaggacagcaggtgaagtttaaataacctccaggcatattattaacttggctgcaaggtccagcaaaagttcagtctctttgcaggcaagagatatgttcagaaagcacaccaccataggtaagtaggagttctgttgcaatgagaaggtgtgatcggttggataagcagacaccagaggagggtcctcagagtggagctgtgtgaaagcatcacaacagcaaagatgtctggatgacattctgaggtccatgtgaggtattctctgagtacgcgtatcaaacaggcttaaccaggcctgggaggtagtaggcagaatgcttgcctagtgtgctcaaagccctgggttagagtcccagcaccataccaaccagacatctgtagggtctctctgtaatcccagcactctggaggcagggtcaggacgataggatctagtggcatctttgactacctagtgagttcaaggccagcctagactacctgagaccctcgtaactcaaaaataaaaattaaaaagaagaaaaaaaggcaaaaagcaagtcaggagtttactgtaggaccctgactcctctctggctcgtctccttggactcaggggagctgaggctcttctcttgctgactgagccccacactgaatgtcctcattgtccctcagacaactgcagttctctatctctctggctcagtagggaggaacatgcggtcactgcccatttctggtgttggctgttggaaccacagcgaggaaaatgacctgattgtcaggcctagtgattatttctagaatggattgtgattggcctggcccgtaggtacttgcccaaggcccaaggcccaaggcaagtacctacgtttgtttatcttaaataaacaaaggcagtattttggatttcaggagagaaagaatttgtgggtagagggtagaaaagaagtagctgggactgcctcacagaaacgtggagttgtctgtacacgggtaacaagtgagaccttgttgcatagtagcaacatcacacttacgctgggagatctgtggcaatggaaggtatgtgggaatgaggtcatggtgacagtcgacttactgtaatagcctaaaagacaaagctgtaactgagaccctggcagaacgtactgcatatttacaatcccaggaggcagaggcaggaggatcagcatgtgagggtcctcctcacctgacaatgagtctgagaccagcctggcttgagatgtctcaaaatggagtgaatgaatgaatgaatgaatgaatacagatctaaaaggttgatcgtattgtgcagtgctagggtacttggtgaggatacttgaggcccaaggttcaataccatgtaccccaactcaataaatacacaaaataaaaaaaaaaaaagaacagaaagacttagtggatttgggtaacttgcagagtcgctaggcagatccaggaaagaaatagatgtgacaaatacaagaacagcaacacccaagagaaatgtccacctgagccctctgtcaggactgttctcctcagcactggtggcatcctggacctgccatccttgtgtccccagagctgctgcagaagtactgaagtacatcactgcccaaaggaccattcacctattattgcatccccacctgcacccctcacaactggcccacactttattatactgaataccatgaggcactggccaggtaacagctccacgtgtatacgggtagagaaaaatctctattcagtatttgaaattattgtgtcacttagttttagagtgctgaacacagaagccacgccttgcccgtgccaagcagactcagcctcctccacctgcatcctccaggccagcaaacacgcaaacatatttgtccacctttccagtccttccacctaaatgtgtcagtatttgtcaagcctggtaagtcttgttgaggagtcatacaggtctcagcccggtgtgaccctggagaccactggagatcacagaactgggctgattgtcctgtgtttcctgtctacctggatgcctggagctctacctagctctttggccttatttgtgtgatttctaatctcatttaaagatctctctctctctctctctctgtgtgtgtgtgtgtgtgtgtgtgtgtactgggagcaatgtggtggtcagaggacagccttgaagctgactcagcccaagttttctcttcccaccttcatgaattccaggctttgagcttaggttgccagcttaggttgctgaactgcaggactatcaacggcctccagtctcctcatcttcttttgaatgacagggtatcgatatgtggcccaagctggctgggaactcagagacccacctacctctgcctcccaagtgctgggacaaagggctgcaccaccactcccagcatatcctcactttagaaaagagactgacagtaactgtttggattattgtacgattaatgacttaatatatatgtcatatctattgttgcctagcagatttccccgaagctgagttgataaaacaagtgtattatccctcagttgtggtgggcgagggatagcaagccgttcagctaggctcttctgttttgggtgtccaggacaatgtcatctgaggggtggctgggaagagttgggcagttgaggtggggcagcttaaggttggtccttcctgttgttcgtaccctctctttgtggcagcttcaaggtgggtggccttgctgtactatagctggaaaactcctaaagcaagtggctcaggatgcatctgcatgtcctagtgtcacttctaaggaggtacaaaagtcactctgagcagcagtcgtaacagcttcctctgccttatgtgggtaagctctgtctggaatgagaggtctggcagagactatggccttttaaattttttgcatgggatcatgggcagttactgctcacagtggcctctgtcgtgccagagcaactaaaagccttgggatatagaaagctatgctgtacttctggcagagaatgcacgtacaccaagacatatgctaccttgccagatcttatacttctttttctttttctttctttcttttttttttttttttttgtttttttgtttttttgtttttttgagacagggtttctctgtatagccctggctgtcctggaactcattttgtagaccaggctggactcgaactcagaaatccacctgcctctgcctcccgagtgctgggattaaaggcgtgtaccaccacgcctggctttatttttctttctttaaaattgttttttaggttaccatctgaaatgatggattgattcatcgtgacactttcttgtgtacactgctctcatttacaccccctgctacctccttgctggtcccctttctctctgccagttgtccctcttttgtccccttgtcacatgtatctcatttctctctctccttttccttccagcacccttatggttcttctttccctgtttccgtcccttttggtttcctgaaccacatatattttaatacacatacacacacacacacacacacacacacacacacacacacacacacacggccttatttgtaatatccactaagtagctcaatagttggatcactaccaaacctccacgttgctaccgcctccccttcgatactcctgaattattatttactaaaatctctattccatctttgctgctctagacccaatggggggaggggcccctggggcctctcttcccaggctcatatatgactgtgtgctttctctcccgcagctgccaagtctaatcctcctgcttccccccggcatggagattctaaaaacttcttacccgtggtttccttgccccagaaatctagagtctcacctctgtctccctgcccagtcattggctgctggcaacttaatttaccaattaggaacccgcagcgtcttactcgaagatgtaggaattcccatgtaatttgggaacctaattaacataagcaataaaccaaatccacaacatttgtctttctgagtctgtcttattctattcaacatactgtcctcagttccacacgctgtccagtaaatgccatttcatttaaataaaagtatctatcagctgtcaatcaactgccatctattatctatctatctatctatctatctatctatctatctatctatctatctatctatcatcaatcctctatttatctatcagctatctgtcaattatctgtcactatctcaatcaatcatctgtctctgtctctctctctttctctccctctctctctctgcatgagtgttttgccttgcctgtatgtgtgtgcatcatgtatgcccaggtacccaggaactccaaaaaaaaaatgtattggcacacctgtaactgtagttacagatagttgttaactgccgtgtgggtgctaggaattgaaccctgggtcctctggaagagcagccagtggtcttagccagtgagccatctctatagctgcacgtttgccttttagttatttattatgtcctttctaccactttttctttcaaccctcacgtccttacttttgtgagcagcgtgtccatgttgggagttgaacccaggtcctctgaaagagcagcaagggctcttaactgctgaaccgtctctccactaagtagttattgctgccaatgtgtgcttgggccacccaggggccacatgcagagaaaacagactctcccatcccagcaaccatcaattgccaatagctcagctctgggtaggactatgctagaacttcactggcttgaccttgtccgggtcttggtgcgtgcagtcacggctggtgtgaggtcatatgtgctacacccctgtcatgtnnnnnnnnnnnnnnnnnnnncccacgaaaagtgttgtggttgaaccttgaaagtgatactgaaatgctggtaaaaataggtacaataatagcaataatattaatacctggggttgtgttaggtatgtgtttatggtataaattaggtctcacaaaaacctcaattagcaaatgccactggggcttttctctttaaattgctgtttggaaccagcagtgggatagagctgcacacaaggttgagaggtggccgtggagctgaggctgggctgttctgctgcgtgcctgcctgcaagtctttgaccccggagtggacaatggagcatcttgcggatccttcctcttgttttaccttaccaggctcccctgctatctgctcaggtcccctggctctgctggatcctgttgatgctgtttagcggatgtggtgtagcttctcagcagaggaaggttctgttggcattgagaatttgtgtctctgctgtcaggctttagagttcaccttgtgctccgcttccattgatatggggtagcgtcttccagtagccaccaaggccttttagaatctcatcttctgagaaatgctgcctgtttgtcttcacttgtgagggagactgctcgctccctctgcccttccattttgtttctcagacaggctctttagctttaagggctaggggcattaaggatgccaggatctgtgtttcagagctgagtgttctcacccagccttattgaagcctagcccggaaagctttgagaagcaaagcccctgacagccgagatcccttggcagtactcagtgcggcagtgttggccttctaggataatggggattttctcatatcctccttggactgttgaaacctccacaagggaatcatttttcaaaacatcttgttctgggaaggactggaccaagtaagtatatttactgtggaaagaagcgtgcacttataccaaagcagtcttctagtgcagctaggtgcgctcggtacgaatgcgctgagttagttctaggacttggctctgtgtttcactagtcttgtgattggcggcaagaggatgagcctaggatcccgtctgatggtatagaaagatccccagtctgatggtatagaaagatgtcataggccatgctgttgttgctggatcccaaggccagggccactcagagacagccagttctgaggattccctctggagtgtgttttcacaccaatagaaagaggctctcttttctcttggtgacttttccaagccatttagccatgagctgtaccatggtgtgctcttcatgaacaccaaatcattttcaggctggtactgatatgtgccttccttacgtatcttgtccacacatttgctggctaacccagaagtcttagcagatgtgaagtgtccaggttaagaagtcactgctcccagcactcgggaggcagaggcaggtggatttctgagttcctggccagcctggtctacagagtgagttccaggacagccagggctacacagagaaaccctgtctcgaaaaaccaaaatgaaagaaagaaagaaagaaagaaagaaagaaagaaagaaagaaagaaagaaagaaagagagagagaaagagaaaggaaggaagaaaggaggaaagaatgaaagagagaaggagaaagaaagaaagaaagaaaggaaggaagaaagaaagagagaaagagagaaagagagaaagagagagagagaaggaaaaggagacagacagacagacagacagacacttaagctgtcacttccttagggaggtttggtataatgtgcttttgtttctgaagtctatagcatgttgaaaaaaggtgcactccccctcagcattttaaaagttcgaatttttttatcttgttgaaaatccttctaagtttagagttgcattagactctggacccatttgttaaaaagacaaatgtgacatctaattaatgtgcaagagcaagccgggggggggggagggggagatgccaatctagcaaatgaatcccagtaaagacttgtgcatagtttatgatggaacagagaacccagggacaaggctaagcctggccaggcttgctcacatgatgggcgaaagttgagtaagctacgagggggtaaactagtaggtagcattcctcagtggtccctgcttcagttcctgcctcgacctccctcagtcaagtgtgagggtgggggtgtgtaagccaagtaagtgttttcctccccaggtcttttcggttatagtgtttatcacagaaagtgaacttggacagtgtgttctgagtatgggcacatagagaggtcagagaatcactttggggagtcacttctagctttatgtgtgtccctggatttgaactcagttctccaggctgggcagcaagcacctttgctgatagccattttgcctaggctatgtctcctgaagagtttagagagcctggccacactgctttgttagtgttttgtaaaccagctttctcgggaccaggtgctgccactgtagcctcacagcctgtggctctgtggccttgtggctctgtggccttgtgtcaccatgcctcctcactgtgtgaggcacagtaaagggccttctgcttacagattcatatcaagcatcctcccgtggctcttcatggtcgggaggggaggtggtctcattaattctgtttataatggctttgattgtgccagtctccacagcctgaggccagcatcttgtattcgattgccacacaatcaccccttctcctcaaagcatttgacatttgaaaatcactccgtctccgtaaacgatgcctcttgattctctagcaatttggctccgagggctttacaagaggaaacatttcctgatgtgatggtttgactgatgctttgtgaaaatgagcaatttctgcccagcatgatggcgctctggcaatatcgccctgggagttggcaccttctgggagttccgttgctggaaagtgaacccagagtcacgcactctgactttgtcttctctgctaagtgcatcgagcgagctagtacctcgcccttttaggaggtgatgggggaggcatggcatgcacacttgaaactgcaacactcagaaggcttagggagaaccctagcttggtccacgtaataacatcctctcttggaaggaaagagaatgagagtaacggacctcttcaccttct

SEQ ID NO: 1136 - DNA, 3406 bp, Mus musculus
cgaggcggtcagaaggctggagcgcggcacatagaggtccctcgggcggaccttctgagccgcagtccagccagggagcgccgacgcatctttccaggtacaccgcaccgactggcggaggcctactgcgcgtgcgccggggccttagcggggcgccacacctgggtgggcaggggctgctcgcgcacgcgcgccgcggtgcccgcgggctgtggggagttgggcgtcgtttgtcactgctagggagcgctgtcgctggcgtggcgtcattcccgcggcttctgtgctccggctcagctcggggcggggcgggaggatgacttcggagatggagtcgtcgctggaggtcagcttctcgtccagctgtgcggtgtcaggggcgtctgggtgtttgcctcccgcccgctcccgcatcttcaagatcatagtgatcggcgactcgaacgtgggcaagacgtgcctgacttaccgcttctgcgccggccgcttccccgaccgcaccgaggccacgatcggggtggacttccgagagcgagccgtggatattgatggagagcgcatcaagatccagttgtgggacacggcagggcaggagcggttcaggaagagcatggtccagcactactacaggaatgtgcatgctgtcgtctttgtgtatgacatgaccaacatggccagcttccacagcctgccggcttggatagaggaatgcaaacagcacttgctggcgaacgacatacctcgaattctggtgggaaataaatgtgacttgagaagcgccattcaggtgcccacagacttggcacagaagtttgctgacacacacagtatgcctttgtttgagacctctgctaaaaaccccaatgataatgaccacgtagaagctatattcatgaccttagctcataagctaaagagccacaagccattgatgcttagccagctgcctgataacagaattagcctgaaacctgagaccaagcctgcggtgacttgctggtgctgagtcataggtgtggccattgcgggtctgacttacctgaagagatgattgggaagtgtgacagtgatgaagttcgtaagagtaaatcctaactgtagtagatcattctgctgttatcgttgttatgatgccttttgtattttgcatcctctcaatcaagtttgtcactgagacagcacatggaaaaggccgctttacagtggggattgaaaatgaagactaccggggccatctttccagctccagccagaagcagcagcttcaagtgagcatgatggaccttaaatggttggtcctcttcctctctgggtccctggagcagcagaagccatgctgggtagtgcacacatgcagagcagctggagcgagccgcaagctaatagggtgctttaattactctgtctttaagcactaaaaactaatcaaaagaaagcaagcagttgtaacaggagtttactttagccatgacatttaatcagaatatcaaatattctggtgccccttgtcctctgttcccagtcacagtcagttgggtgactcggagctgatttcagtcagcatccatttggctgggttctgtatgtatgttcctgtaattgtattgttggatgaggttttgacatgcgtgaattttatggccttggtataaaaattggtaaagcaaactgttcccttggtataaaaaatgagttaagtattgaaaaatatacttacctgtccctcaatgatgaaagaaatggtttagaaagattttttttttttgccctaagtacttgtagtttgagtttaaaactttgcacaaaggaaatagcacgtttacatatgaaggtcttagcagagtggtgtgtaagctgtgctcagcctaagtccgcacatcctctttgtgacagcttgcaacccttgccaattttagaggaaatgaagccaaaataatgtcttacttaaatattttcataatgtgggaaacaaacataacccaacctagtttcagattcttgtttcattattctgatggtcccaactggacagttcatttatgaaagcaaaattgttctatttaataaactaagtgaaagtaacttaagggatgattgtacaatttaaatattaattcagtaaatacaatgaaatgaagattaggacccagattggctttctttgtagttagaaagatctttctttggttccttctttttttcttttttttaatagaaggtctctctttgtgggcctgactggcctgggacaggggtggcctcagacttacagataccgacctgcctcttcctccagctgctgggagttaaaggcttctgtcaccaggactagcccaatacatctttcttaatcatgctacaattaaagattaaaggttgtcttctgtctaaatgaatgctgacttgtgaactgttttcctggtgacacaaaatggcggtagtgacgggtggctgcagatgtttgtacggaggaacatctggtcattgttcttccacgttctgtacaccgagggtggggggagctgatctgttctctaagtacctctgtggttttcttctggactgtttcagtacagaactgttaattagtcatttttctttttaatgtaacttttcttaatgagcattcttacaattctgtgaaaagcataattttttcattttagtatttattaatcaaaacatatttgtaactcatttgtaacgacctatcactttagttttagttttttatttgaaaaagatacaacccaggtgagcaaggacaacccctttagatgtggtccaaggcgcttgggcttataacgcactttatagactattgatattactttcaaaatgatggtgaggtgacatcttgttacttttttaagcacaaatcacacattttgtacatctgtgattttattttggctgacatttaatggaaagtgtcacgttttaggaaaaaaaatcttaatttgtgaacagcaaagcaaactcctctggcgtctgttgtggttggttgacagtgtacacctctttgatgttctcccaacaaggatgatagttttgctgtgaaacagcgccacctttaacacttctcccataacgtacaataaatcatctttgccacgaggaagcgtttctttctttggttttctgggttgaatgtaaaattaaagaacgtacttcttcctgtctactgtggttttcagaaaatatgtacggcctacagttcgttcatttgaaaatcccaaatctggggctggtgagatggctcagtgggtaagagcacctgactgctcttccgaaggtccagagttcaaatcccagcaaccacatggtggctcacaaccatccgtaacgagatctgactccctcttctggagtgtctgaagacagctacaatgtacttacatataat

SEQ ID NO: 1137 - protein, 285 aa, Mus musculus
RGATPGWAGAARARAPRCPRAVGSWASFVTARERCRWRGVIPAASVLRLSSGRGGRMTSEMESSLEVSFSSSCAVSGASGCLPPARSRIFKIIVIGDSNVGKTCLTYRFCAGRFPDRTEATIGVDFRERAVDIDGERIKIQLWDTAGQERFRKSMVQHYYRNVHAVVFVYDMTNMASFHSLPAWIEECKQHLLANDIPRILVGNKCDLRSAIQVPTDLAQKFADTHSMPLFETSAKNPNDNDHVEAIFMTLAHKLKSHKPLMLSQLPDNRISLKPETKPAVTCWC

SEQ ID NO: 1138 - DNA, 42104 bp, Homo sapiens
  misc_feature (1)...(42104): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggggaaagggaaatgatctgacatttcagggactactggacactggctctgagctgacgttgattctaggggacccaaaatgtcactgtggtcctctagttaacataggagcttataaagttcaagtaattaatgaagttttagctcaggtccaactgacagtgtgtccagtgggtccctggactcatcctgtggtcattttcccagtgccagaatgcataattggcacaggcatacttagcagctggcagaacccccacattggctccctgactggtagagtaagggctattatggtggaaaaagccaaatggaagccattagagctgcctctacctagaaaaatagtaaataaaaaacagtatcacatccctggaggggttgcggaaattagtgccaccatcaaggacttgaaagacacaggggtggtgattcccaccacatccctgttcaactctcccatttggcctctgcaaaagacagatggatcttggagaatgacagtcaattatgtaagcttaaccaagtggtgactccaattgtggctgctgtatcagatgtggtttcactgcttgagcaaattaacacatctcctggtacgtggtatgtagccattgacttggcaaatgcctttttctccattcctgtccataaggcccaccagaagcaatctgccttcagctggcaaggccagcaatatacctttactgtactacctctgtggtatatcaactctctggctgtgtcataatcttatttggagagaacttgatctctttttgcttccacaaggtatcacactggtccattacattgatgacattatgctgatcggatccagtgagcaagaagtagcaaatacactggacttactggtgacacagaagatggaaaataaatctgactaaaattcagggaccttctacctcagtaaaatttctaggggtccagtagtgtgggtcctgtcgagatgttccttctaaagtgaaggataagttgctgcatttggcccctcctataccaagaaagaggaacaacgcctagtgggcccatttggattttggaggcaacacattcctcatttcggtgtgttactctggcccatttactgagtgacccgaaaggctgccagttttgactggggtccaggagaaggctctacaacatgtccagactgctgtgcaagctgctctgccacttgggccatatgacccagcagatccaatggtgcttgaggtgtcagtgacacctccaagggatgctgtttggagcctttggcagtcccccataggtgaatcacagtagaggcctctaggattttggagcaaggccctgacatcttctgcagataactattctccttctgagagacagcttttggcctgttactgggctttggcggaaacggaacgtttgactatgtgtcatcaagtcaccattcaacctgaactgactatcattaactgggtgccttctgacccatctagccgtaaagtgggtcatgcacagcagcattccatcatcaaatggaagtggtatatacgtgatcaggctcgagcaggtcctgaaggcacaaataagttacatgaggaagtggctcaaatgcccacggtctccactcctgccaccctgacttatctcccgagcctgcaccgatggcctcatggggagttccctatgatcagctgacagaggaagaaaagactagggcccggttcacggatgattctgcacgatatgtaggcactacccaaaagtggacagctgtagcactacagcccctttctaggacatcccctgaaggacagcagtgaaaggaaatcttcccagtgggcagaactttaagcagtacacctagttgtgcactttgtatggaaggagaaatggccagatgtgcgattatatacttattcatgggctgtagctaatggtttggctggatggtcagggacatggaagaagcataattggaaaattggtgacaaagaaattctgggaaagagatatgtggatgtatctctctgagtggtcaaaaactgtgaagatatttgtatcccatgtgagtgctcaccaatgggtgatctcagcagagaaggattttaataaccaagtgaataggatgagcccttctgtgcatactcagcctctttccccagttacgcctgtcattgcccaatgggcccacgaacaaagtggccatggtggcagggatggaggttacatatgggctcgggaacatggacttccacccaccaaggctgacctggctacggccactgcagagtgcccaatttgccagcagcagagaccaacactgagccctcgaaatggcaccattccttggggtaaccagccagctacccgatggcatgttgatgatattggacctcttttatcatgtaaagggtagaggtttgtcctcactggaataaacacttattccagatatcggtttgcctatcctgcatgcaatgcttctgccaagactactatctgtggactcacagaatgtcttatccactgtcatggtattccacacagcattgcctctgaccaaggcactcactttatggctaaagaagtgtgacagtgggctcatgctcatggaattcactggtcttaccatgttcccccgtcatcctgaagcagctggaatgatagaacggaatggccttttgaagtcacaattacaacatcaaccaggtgacaacactttgcaggcctggggcaaagttctccagaaggccatgtataccctgaatcagcgtccaatatatgatactatttctctcatagccaggattcacaggtccaggaatcaaggggtggaagtggcaccactcatcatcacccttagagagtcactagcaaaagttttgcttcctgttcccatgacattacgttctgctggcttagaggtcttagtttcaaagggaggaacactgccaccaggagacacaacagcaattccattaaacaggaagttaagattgtcacctggacacttggggctcctcctacctttaagtcaacagtctaagaagggagttacagtgttggctggggtgactgacccggactatcaagatgaaatcagtctactacttttttttttttttttttttttttttgagacagagtctcgctctgtcgcccaggctggagtgcagtggtgggatctcggctcactgcaagctccgcctcccgggttcacgccattctcctgcctcagcctcccaagtagctgggactacaggcgcccgccactacgcccggctaattttttgtatttttagtagagacggggtttcaccgtttttagctgggatggtctcgatctcctgacctcgtgatctgcccgcctcggcctcccaaagtgctgggattacaggcgtgagccaccgcgcccggcccagtctactacttttaagtcaacagtctaagaagggagttacagtgttggctggggtgattgacctggaccatcaagatgaaatcagtctactattccacaactgaggtaaggaagagtatgcatggaatacagagatctattaaggtgtctcttagtattaccatgccctgtggttgaagtcaatgggaaactataaaagcccagtccagaaaggactacaaatggtccagacccttcagaaatgaaggtttgggttacgccaccaggaaaaaaaccacgacctgctgaggtgcttgctgaaggcaaagggaatacagaatgggtagtagaaggctagtcatccataccagctacaaccaagtgaacagttgcagaaatgaggattgtaattgtcctgagtatttcctccttttgttaaaaacatgtttgtgcatatatacacttgtactaagaaaatatcttcattttatttcctttttttttgagatggagccttgctcttgttgcccagtctggagtgcagtggcaggatctcggctcactgcaacctttgcctcctgggttcaagtgattctcctgcctcagcctcccgagtagctgggattacaggcatgcaccaccatgcctggctaatttctgtatttttagtatgttggccaggctggtcctgaactcctgatctcaagtgatccgcccagctgagcctcccaaagtgctaggattacaggcgtgagccacagcgcccgaccataatattatttttgtgaaaatatgtgttctgagttctaaacattcagcttacaaatccccttttgcaacatgagtgtttgtagagtatgtgtgtgttttgaatgtgtgcatgtgagtatatgaatgtgaatgtgtaagtgcacgagtttaagtgcacaagtgtgtgttagtgtgtgcatgggtaggaatgtgaatctggttgtgagtgtgtgtgagtgtgactgtgtgtgtggggagggctgcatgtgctgagagctgtcaagaatgaggacttccatttctcctcaccaatctctagatcctgccttattttatcctctcctaagccttatgcaaacttaagaaaaatcaggttgagaccctctattactgtcaaaagccattactcatctcggcctcccaaagtgctgggattacaggcgtgagccactgcgcccagcctccttttatcatgggacattaagatttacttcatatcagcatttaagtattgttaactttatgtaatagcatttgggttggggactggtgtgtttccagctgtacaaaggatagttgtattaggtgtaattatgacattattattgtctttatttgaagattatgaatgatctcaggagatatgtatgtgtttaagttgacaagtggtggacttgtgatggttaatacagtcaacttgattggattaaaggatgcaaagtatcgatcctgaatgtgtctgtgagagtgttaccaaaggagattaacatttgagttagtgggctgggaaaggcagacccacccttaatctgggcgggcaccatctaatcagctgccagcacgaccagaatataaagcaggcagaaaaacatgaaaagactagactggcttagcctcccagcctacagctttctcccatgttggatgcttcccgtcctcaaacattggactccatgttcttcagctttgaaactcgactgccttcctttctcctcagcttgcatnnnnnnnnnnnnnnnnnnnnaacaacagtaggccatgattgcactttttacatatatcaaatattggcaagtctgccatcctagcttcccatctgcctacaagtgggcagagccatttttaacctttcttactgtgaacatacttcaattcacttagaattcttgaagtccaggccaagcacctctagggtaaaatttagcattctgttttatccaggtgttcactaacggttccatattaatttgcttctgcagataaagtataaattcctcatgggctaaaatcacaccttattttgtatcttccccttgcaccaaccactagcatagtactgagtacatagttcaaatgccattaactccacagtgatcctacctatgaagatatgacttgaagaattctgaaactcattaagctaacctatacaaggatactaatttactatttatatactgaaattaaagccctagtatgatgtctggggttaccaaacacagtgatatagtaatttggtggaggccagcaaggccaatgccatacttctcagggtaactggaattgtgtcttcaaaggagaagtaattcccactatcaactgggaggtacagggtatcaaacttgtgagaagagcccttctgtaggctcaaggagtgccagtggcattcaaggaggagggagggagaggatttttgtccccaaggggcatctagcaacattttgagacagttttggttggtggtggggtgctactgggatttactgggtagaagccagggatgctgataaaataaacatcctacaatgcacaggataaccttccacaacaaagaattatctgacttaaaatgtcaatagtgccaaggttgagaatcctttctttcataggcaatcaagggaattctttgtcctctgtgctcagacctgaacttaaagagtaaaattatctaagagctgtttctgagtaagacaagttacgaaatgggcactgtcatcaggaggtggcatatctagttaaaaaaaaaattcagaaattgagtagtcttattttgtatataagattatccttatgctattctgttttctactttttttttttttttttttgagacacagtcttgttcttgtccccgaggctgaagtgcaatggcatgatcttggctcactgcaacctctgtctcccaggttcaagcgattctcctgtctcagcctcctgaatagctgggattaaaggcacctggcaccacgactggctaatttttgtatttttagtacagatggggtttcgccacgttggccaggctggtctcaactcttgacctcatgatccaccctcctcggcctcccaaagtgctgggattacaggtgtaagccactgcacccagcctgtttacttttatgttttagagatgggggtctcgctgtgctacccaggctggagtgcagcagtgcaactatagctcactgcagacttgaactcctgggctcaagagatcctccagcctcagcctcctgagtagcaggaagtagaggtgtacacaaccacacccacttttttttttttttttttttttttttggagacaggaggtctcactctgttgcccaggttggagtgcagttttgcgatttcagctcactgcaacctccacctccctggttcaagcgattctcccacctcagcctcccgagtatccgggattacaggcatgtgccaccacacctggctgatttttgtattttttggtagagacgaggtttcaccatgttggccaggctggtctcaaattcctggcctccagcagtgctcctgtcttggcctcccaaagcgttgggattataggcatgagccaccacacccaggtactactgtgtgattttaatatccaatgttttttcttctattacaaaagtatctttacatacttatcttaccctaagccattgaaattgttccattttaagttgtactgacaaaggatccaaatttacagtttctgctcagctgtgtagcaaagtattaaggaaagggttacatgttcacactttgaggccaagtggtagtgactccaaggacaaaatgaacggtcaaaaaacagggctgtataatccatccattctttccaacagtagaatttcctccaattatcaattctggagattctggggttattcaattaagaagagtagcacatacttcagtcacatgaggacactctcaaaatacaagttgaaaatacaaaactcctcataacaatgtcaagtgccaacaatgatttttaaaatttaagtagggctgaactgtgtgtaactggtgaaatgttcaagttaacaatccttacacacgaaatctctcacttcactgacttaattcattatttgctgaataaacaataaacttccagtcagtagtcaagagttggcaatctagctggtaggacataacatataatcatgaaacagcaaaaacagtattcaaagattaaattagcaataccccaaaatgtgtgttagagttagcataaagaatttctgatgtagtttaccaagagctaaactaaaaagtccagaatacaaaaaacagggatgcaatgatgttagtttttttcaccatccttgaaattctcccattaaccacagctctgagttttcaactgctctttgtccttaaatcttcagattccctcctttgaatgggataggtagagcagattagaagaaatatattccgaggctctctaatagtttctggatgattaaccttcatgaaaataacctcacagataagtaattaggatttttcagcccatttctataaactaagtaaactttttttctagtgaacataacttgatatattagtgactgtagaaagtctttctacagcaacaggaattatatcaaggcttttgcaaattcctggcaactccgggcatgtttaagttctactactcatctgttctgactatattttcatctgatggaataagcagttcatctcctttcctagaacttttagtgctctactgtccccctcactttagttaaggtctgccatgtcctcctctccgacagtccttgactttcccaatggcatattcatctgctcaaacagatgtcactgcaaaacaaaacaaacttttaacaaaaagcaatgtttgcatatttggggccttttgtatgacaatattgcacgtttcctcagaaaaattcacggagattctttaaggttgggggtttaatctattgatattttccttaggtagacaaagacaacctctaagtgcgctcagttaatctttaaccgctacatcatcgtcacccaggcactaagacataactagggcataatgagttttatttccaccaggggcgcctagtaactaccaggttcaacgctcccaggtggccgacatgtgatgtgctctactgtttgggctggggatattagctcaacaaactctggccacaaggtatcacgcggatattcttggggatgcctagcgaaatgcgctgtacctaggcctcgaactctcgcctgctctccggtgggcggtctcgaactccagcctgctctccggcagcccacagcaatgcgcctgccaagaccttaggctgcaaaactcgccacggcccagagctcgcctccaagtgcgccccgcacagggcaagctttcggcgaggactcgcgtcccacccatctagccctggccgctgtcccaactcccgcagttcacagaggcggcggcggtgagcgcagccgatgccacatcctcagcggcaagctgaagaaacctgtctcctctctggggcgaccaaacgatacgtcgatgccggaaccgacccgacgccggagccgtcggctccgtccttaccgttgctctccaggtacacgcccccgtcaaaggcggctctgcggccctctcgcgagagagtgcccgtggtacctccttcctctcagttgtctgtctctccccgcccccggagtgattgcgcggcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccctgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctgtcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaaggtgagcggatggggaactgttggggaggacagggtgacaggtgtcccaaccccaccgtgggctggtcgctggccgtgtgcacggtgtgtgtgcgctccatttttttctcacgctgatgagattggagttggggattggaaggattgcaatactgcaaacttctaaggcagcgtttctcagacttcattgtgcatgcgatttacctggggatcttgtttttgaaaatgcaggctatgatttaataatctcgctgatgatgcaggtgcagctagtccgtggaccacactttgagttcaggagtgtagggcttatctaccgacccatttactgtgtgtgtcgtgtgctgggagtcagtcaaatatgaacggaggaaaaacagtgaaattgcgcgagaatggaaaattcatttaatcagtaatagttattaaacattcattcgagcagtgccttagatgttgtggaagtaaagcctattgcctttgaggaagtacttaggtattctcttgcatacagttttgctgtagtagtttctttatgatactgattttagaaaaatctattttcctgcagaaacattctatatgtgatagttcctactcaggttgccaaaagcatttctcatgatgccacctcagacacacgcccaattctttattccctttaagtcgttatttttggtccctgggactggggacactgagtgacagtaatagtggagaaggtagtataggccccagggcaggtttgaagttctgaggggttggaatctaacagtggaatgaggatcaatgacaaggcttaggcctcttgatggtataaaccttagacacaccttcatagcaagccaccactaaatgccacctgttgatgccactccttaaaacataggtggaaccaccttgccttatactactgctttaaatcagcgatcgtctttatctcagtctcttggtggggatggggagtggtgggagaacaggcttgctttagacgttcctaccctcgtatcttagaggcaagaacaatttatttttcagttccctaatcatcgccccccaccccaacgggttatactgctaatgatggtagaggtgaagtaagctgggttaaaagaaattaacctttctttggtgcttttgtcttttaatttttcacattagtatttcatgtcccatatgagctctcagtggtggttttggagttgctttgtattagggaatttagaaagatttgtatacttgcagaagaaaagatagaataaaaggctaaacatttttcaccagaattaggtttggcccagaagcctttggggtgaaaaataatggagcttctgaagttccaagggagttaagattgggagaagcaggaatctgggaagtacgtgggctttggagcccaactaacctggattcatatctgaacctacgaaagggtagggatgggctgtgtgtccttactagggtgaccaactttgcccaagactgtccaggttttaaaactgggtctcacatcccggggaccccctgtattgggcacaccaaaatagttggtcaccctggaccttaggcagattctttaacctctcagagtctgtatttttcttccgaaaaactgggatcatgataccttatcaggctgctgtgaggatcagatgaggacatatatgaagcacctggttcatagttggtgcctttaaaaagattctttgtctttcctggtggcttaacattatttttcctgtttgccaccattagttctgcagttgtacacccaaagttgaaagcagagatagtggagggcataggtagacagctaaggggagagaaatttaaaaaacaaaacaaaaacaaaaacggaagtaggaaattctttcaaaagtggagagaatgagggtgggggaggagttgggatttgagggccctttatctgttcctgggttgccatttatacttaaagataacagatgaatcaggtgcaaatttaagagataatagtattgaaaaaatataaagcatgtgcagtgtataaagtcaattacctaactactgaggtgagtgctggcagtgataaataagacagaaccacaggtatgacgaatctgggagcacagagttgataattctggttgggaagagcaaggagatgatattttttggggagattatttctactgaactttagcctaacttgttacattgatatggacttgaatactgagatcatttttcttctaaggccctagccgttgatttgtgccaccaatggtgagacttgagagagatttttattgtggttgaaatgactacagacatgttctgaggtttctatagtaggaaaagatatagctatgttgggcattttttaaaaccacagagcttaattttttttagtgccctttttttcgaaaactgaaaagtgatataaagagctttattctatgtgctgcttctgctgctttttggttaacctgtaatacatcttgagtgctgctgaaatgttcatattacgtctttggaaaattgtagcctgatctaaaatgacatttttcctaatttttcatctcaaagctggaaagctctattactttactagtaaaatgccattctagacattatttctttgataaaaatgagatattgcgttaaatgttttgataatcatggactagaaaattttcagaaagcatgacttaacaacagtgccctttcagaatccgttaaaatgttttatgaaatttaagaaagcctatatctgctaatccattcctaagcagtatgtgcaggtagttgaaagaggaaaatcttgtttgcaaaattttggaagtcgaataaaattataaaattaaattccttaaatacaaatacattcggcttttaaattgagactcctaactctaatccttatgctccttcctcgtgtgtatatccccttcatgactaattgtattcctttagcacaatcattttccagtggcagacacaccaacccattaaagcctggtgttgtatttaatccggcctcccattagaggtcagcaggtcctacttgaacattttagtagcttacttttttgtagcggtagaaatgaaatgttcccatgttaagtgcaaaatgttaatattaactaaaggaaaataatcaggacctctccccacactggtaaaacaaatatttaatgagtaattgctggaaagaagacattttgataagcacagagaattatgatacggcacaagggtcagcaaactatgcttgagggccaaaaatggtcttttgcctgtttttacatggccacaatctaagaatgattttttacattttttaatgtttagggaaaatatcaagatttcatgacatgaaaatcatatgaaattcaaaattcacctacgttgtactactttaatccttcttatccttgtactctcacccctctctttgctctgagtccaattggttttccacctgcacactttctattaactgtcttgtcttcaaaattctagttcaagtcctttttttaacctctctttgaactgttgcagcagcttaacagttacagcagcttaactgatctcccagtcctcaattaatctattttgtacattgttgccaaaatgcccgattaatgttgtacttcaagatttatctcccctaactcaagtgccctttatattatattctccattatgttataaagttccagctgggtgttgtggcttgtgcctgtagtcccagctactcctgaggctgaggtgggagcattgctggaggttcaagggtacagagcactatgatcgagccactccagcagagccagaccctgtctctgtctctctctcttttttttttaacacgtttattttaggttcaggggtacatgtgcaggtttattgtatagttaaacatgtcacaggggtttggtgtacagattattttgtcacccacatattttgtcacccacatattaagcatagtacccaataggtattttttctgatcttccacctcccaccttccacccttcaggaggctccagtgtgtgttgttcctgtctttgtgtccgtgcggtatttggttttctgttcctgcattagtttgcttaggataatagcctccggctccatgttgctgcaaaggacatgatcttgttctttttgtggctgcatagtgttacatggtatgtatataccacattgtctttatcctgtctaccattgatgggcatttaggctgattccatgtctttgctattgtaaatagtgctgtcatgaacatacatgtgtagatgtctttatgacagaatgatttatgttcctttgagtgtatacccaataatgggattgctggagcaaatgataattctgtttttagctctttgaggaatcacaccactttccacaagggatgaactaatttacactcccaccagcagtgtataagtgttgtcttttctctgcaactttgccagcatatgttattttttgactttttaataatagcccttctgactggtgtgagatagtatctcattgtggttttgatttacatttctctcatgattagtgatgttgagcattttttcatatgctttttggccacagatatatcttcttttgaaatgtgtctgttcatgtcctttgccctcttcttaatggggttgtttctattaagaacaaatcccatctcaaaaaaaaaaaaaaaaaaaccttccagccagccagattccagtgactcacacctgtaatcccggcactttgggaggccaaagatcacttgagcccaggaattcaagaccagcctgggcaacatagtgaagccccatctttaccaaaaatttaaaaaaatcagccaagtacggtggcatgtacctgcagtccccgctgctcaggaggtaaggcaggaggattgcttgagcccaggagttggaggctctagtaagccatgatcacaccattgctctccagcctgggcaagagaatgagaccctgtctcttaaaaacaaaaaaagagtctcctcacacctccagtcagcttccttctatgaactcttttagcaccttacctgaacctttagatgatttctatctcattgcatacatacctgtcttacctcccttactaagttttattcagggcaggatccatgtctggtaattccatagacttctttcagtgtctagttcagttctttttttttttttttcttttgagacaaagtcttgctctgttgcccaggctggagtgcagtggcatggtctcagctcactgcaacctccgccttcaggtttcaagcaattctcctgcctcagcgtcccaagtagctgggattacaggcgcctgccaccccaccccgctaattttttgtattttagtagagacggggtttcaccatgttggccaggctggtctcaaactcctgacctcgtgatctgccgcctcggcctcccaaagcgctgggattacaggcgtgagccaccgtgtccggcctagttcagttcttaaaccacatagtaagtactcagggaaaagtgttgaatatatagaggcagagagatcagttggtagggtactctggaaatccagaattgaggtgataagggaaaataaaggggtgatagaagaggtattttgaagataaagccaaagtcttcagtaactggctgttggtgatgagaaagaagaggactagatgagtgaggttgtgagtctgggtgacaggaggtaggtagtggagctaagggggactacgtggaagattgaatttggacaggctctgtaacattatgatttagtcatgtgtttattgagatgatcctatattcaaatggaaatactgattggcagctacaaataccggattggcacacaggagaaataattatgcacatgaagttgaagtttggaagcacggatagaacaaaatgtagctaacatgcctagagagaatagtagaaattttgttaaatttttttatggcatgatgaagatgacattcagtgaatgctgtgtaaatataaaatataaattgggttactaattattgttctgtgttgatcttcattaaaagtaaattaatgtttataagtcaaaaaatattttatatgaagtcaccttataccctaccttaaaacagaatcaaattgatactttatttcttaaaatgtggtattggtggttggagagataccaaactggttctcttgatttgatttgatttgcattgaaattcagtgaatgagaatatgcgcagttcaggtatcctaagaatgctgaagaatcttgtgatcccttagctcagaaacttttgggcagtttctggtctgaaaaagactttgaattgctggggtttggtcctggggctggcatggtgtaagtaatatacattttcacagacccaagctttcctactatctgaaggatcccaggaaccaggtcagaattcctgttgtttttctagcctgatttcagaagcctatgattctcttctgtcacttcttacgaagacgaagaaggcagcattggtgtgtatattcagaggtggtgagaagagaattacttacttctctggaatcagtggtcaagatctcttgctttggagactgtgtgaggactctaagcaaattagtttaagcagaaagggaatttattttttcatataactaaaaagcctagaagtaaatttctctgtctgccagttccaactgcagctctacatgcccattcctaaactatggtagtgacagggagtgtgggggtgcgaacctctgattggtcagacgtaggtcacatgccctccctgggagccagtggttcatgtgaatggaaagcaggggagggccgattcccaaggaaaatagggtgctattaatagaagggagaatgagggttaggctggagaaaacaacatgcattctctacagaatcaggtagtccacgtttaaattctggccttaagacttactcgttttgtggccttgggtgaattacttaaacctcagtttcctcatctgaagattgggtaattattacatagggttgcatatattaaataagggcatgtaaaggacttagcagagttcctggagtatacatggaatgtgctaagccccaaatcaatattaatagtttaagagtaaatgctcattccttcaggagagagatggtagtggggaaaaaaaacaggcagtgaaagaatagggaaagaggatggataactaagattactgttccaaattgtgtgtattttttcctctaaggtgataactaatgctttctctcactgcttgctctcttccttatcaccattattattctgtaattaaatcctttatttaaaaaaaattttgaccaggcatggtggctcacgcctgtcatcgcttgaacctgggaggcagaggttgcaatgagctgacttcgtgccactgcactccagcctgggtgacagagcaagcctccatctcaaaaaaaaaaaaatttcatatatacatataattcctttatataaaacttcatgaatctctagtttaaattccaatatcaagttttaacaaaaatggcaacctagctactgctaaatactaatagtagattcttgttgttgatgacagctcttttttttttttttttttttgacggagtctcgctctgtcgcccaggttggagtgcagtggcacaatctgggctcactgcaagctccgcctcccgggttcacgccattctcctgcctcagcctgccgagtagctgggactacaggtgcctgccaccacgcccggctaactttttgtatttttagtagagatggggtttcactgtgttagccaggatggtctcgatctcctgacctcatgatccgcctgcctcggcctcccaaagtgctgggattacaggcgtgagccaccgcgcccggccatgacagctcttttggtagttttattatccaaaatgagaaatgatctgactttaaattgatttaatactctttttgcttgacctaaaatgttaaaggttttaatccaaattttccatccctgattaactattaaatttccttttcccctattctttcaaagaacacatttttattatttcatgtaaaagaccatctatataagaactacataagagcttctgttaacaatttaagttgtaaaacaacatcataactggtattagtgacatctcaagagaactctttgctttttgtatgtggagtagaaatgtgtgtgtctggtgtacagaatcaaatggcaaatctttgaaataaattttagctttctggagtctctctcaacctctactgattctgagtgctgccatttcatgtattggtctgtgttcacttaaaccctgttaaaattttaaaataaataaattttagcttcctaagaagacaagtaacaaatttttgtgattatttgaaaggaatactgcctttaaaatgaagaatttgggccaggtgccatggctcatgcatgtaatctcagcactttgggaggccgatcagttgagccgaggaattcgagaccagcctgggtaacatggagaaatcccatctctacaaaaaacacaaaaattaactgggtgtggtgacacactcctgtagtcgcagctactcaggaggctgaagtgggaggattacttgagcatgggaggtggaggttgcagtgagccaagattgtgccactgtaccccaacctggcgagagtgagaccctgtcataaaagataataataatttctttttgagatggagtctctgtcgcccaggctggagtgcaatggtgcgatgtcagctaaccgcaacctctgcctcccaggttcaagcctattaaaggcgtgtgccaccacacctggctaatttttctgtatttttagtagagacggggtttcaccatgttggccaggctggtcttgaactcctgacctcaagtgatccacccacctcggcctcccaaagtgctgtgatgacaggtgtgagccaccacccctggccaagtatatattatgttatctttataatgtttaaaatggcaataagattgctgtgagcacatattagccatttttcctaagatatttaagtattaaattgggaaaaatttctctgaaaatatttcctaatttaacatttaccagatgaaagcgtctcacttccttgggtccaaaagtatcagtttctcttcttttttaaacatcatgaaccattccactcatagctaagcctcaagagttttctaggctttgcttttcgcctagtgtctgtctgactgtctccttcaaagttttctctagccttttatggtcaacagtttttaatcagttgtcctgtcgtgtattggctgggtctctcactgctcctttcctgtctccttgccttctcatctcagtgtgcaggcctggaaggcagcaggcagcagtagccctaagccttcccatcatttagttattccatgagagaaattttgaagcttctttttagatattcctttgtaaatgcctcattattagttacgtttatggctctacagtaaagtgtagagttatttcaggctgggcatgatggcttttgcctataatcccaaagctttggaaggccaaggtgggaggatcacttgaccccaggagtttgggaccagcctgggcaacatagtgtgaccacccccccactgtctctacaaaaagtaaaaacttagctgggtctggtgacacgcgcctgtggtcccaggtactcaggaggctgaggcaggaagattgagcctggtaggtggaggctgcaatgatccatgattgtgccactgcattccagcctggaggggctgagtgagaccccgtctcaaaaaataaaaataaaaaaggggtaatttcatacctctgtgttctggaagacttgatatgattagaaagcataaaattttgaacgggattgatgggaagaggaatactgcttttttttttttttttttttttttttatactttaagttctagggtattcaatgtgcaggtttgttacatatgtatacatgtgccatgttggtgtgctgcacccattaactcatcatttacattaggtatttcttctaatgctatccctcccttcccctaaccccatgacaggccctggtgtgtgatgttctccaccctgtgtccaagtgttctcattgttcaattcccacctatgggtgagaacatgcggtgtttggttttctgtccttgtgatagtttgctgagaatgatggtttccagcttcatccgtgtcgatacaaaggacatgaactcatccttttttatggctgcatagtattccatggtgtatatgtgccacattttcttaatacagtctatcattgttggacatttgggttggttccaagtctttgctgttgtgaatagtgctgtaataaacatacgtgcgcatgtgtctttatagtctcatgatttataatcctttgggtatatacccagtaatgagatcgctgggtcaaatggtatttctagttctagatccttgaggaatcgccacactgtcttccacaatggttgaagtagtttacagtcccaccaacagtgtaaaagtgttcctatttctccacatcctcttcagcacctgttgtttcctgactttttagtgatcgccattctaactggtgtgagatggtatctcattgtggttttgatttgcatttctctgatggccagtgatgatgagcattttttcatgtgtctgttggctgcataaatgtcttcttttgagaagtgtctgttcatgtcctttgctcactttttgatggggttgtttgattttttcttgtaaatttgtttaagttctttgtagattctggatattagccctttgtcagatgggtagattgcaaaaattttctctcattctgtaggttgcctgttcactctgatggtagtttgttttgctgtgcagaagctctttagtttaattagattccatttgtctattttggcttttgttgccattgcttttggtgttttagacatggagtccttgcccatgcctatgtcctgaatggtattgcctacgttttcttctagcatttttatggttttaggtctaacatttaagtctttaatccatcttgaattaatttttgtataaggtgtaaggaagggatccagtttcagctttctacatatggctggccagttttcccagcaccatttattaaatagggaatgggaagaggaatgttgtttagtcagtctcatctaaaaacaaagggttttcttaggattaaacttcttcttcttctttttttttttttttttgtttttttggagacaaggtctcactctgttgcccaggctggagtgcagtggcacgattatggctcactgcagccttgatctcctgggcttaagcgatcctcccacctcagcctcccaagtaactggaagcacaggtgcatgccaccactcccagctcacttttttttttttaagagacgaggtctcactggtaggaacaaagtagagacaaggtctcactggtaggaacaaagtagagacaaggtctcactgtgttgcccaagctggtagagacaaggtctcttttggtagagacagggtctcactgtgctgtccaagctggtttcaaactcctgagctcaagtaatcctctcacctcaggctccctaagtgctgggattacaggtgtgagtcattgcacccggcctggggttaacatttatcattaccgcttacatttgtggaggacatccacagttctttgagggcgggtctaaattctgcgtaatcatctttttttaattttgtttttataaatgacatgcatgtttgttaaggaaaatagaaaagtagaaataaagggagaaattaccttggagacaaccattgctaatattttggtatatttccttttcgtgtgctttttattttttatcttgtgaatataatttgcttaaaacattataagtcatttttcattgatgaagtgatgcttgaacatctgagttacagaaaatgtcattagaagagaaaaaaatcagctctagttcccttggatagcttttatataggtcatccaatttattaccaaaatatctttctaaatgctaaagatagaatttcaagggtcttttcttttcttttttcttttttttttttgagacatagtcttgttctgtcacccaggctggagtgcagtggcatgatctcagctcactgcaacctctgcctcctgggttcaagcgattctcgtgcctcagactcccaagtagctgggactacaggtgcatgccaccatgccctgctaattttttgtatctttggtagagacggggttttgccctgttggccaggctggtcttgaactcctgagctcagataatctgcccgcctcggcctcccaaagtgctgggattacaggcgtgagccaccatgcctggcctcagatatattttatttgcagatattttctcccattctgtgagttgtctcttcactttgatagtgtccttagaagcacaaacttttttttttttttttttttttttttttgaggcagggtcttgctctgtcacccagactagagtgcagtgacatgatctcagctcactgcagcctctgtctcccaggctcaagtgattttcccacctcaacctcccaagtagctgggactatgggcacctgccaccacacctggctaatttttgtattattagtagagatggggtttcaccatgttggccaggctggttatgaactcctggactcatgtgatccacctgctttggcctcccaaagttctggaattacagggatgagccactgtgcctggccttccgccgcgcacctctttccccaccacgccccccgccgctttttttttttttttttttttttttttaaaaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggcagcagtgagctgagatcgtgctgctgcattccagcctgggcaatagagcaatgtcctgtctcaaaaaaaaaaagccaattacattatttatttaaaaatatacaattattgttgactatagtcaccctattgcctatcaaatagtaggtcttattcattctttctgttttttttttttttgtacccgttaaccatccccatctcccctaccccgaagccccactacccttcccgagcctctggtaaccattttcaactctctatgtccatgaggtgaattgatttgatttttagatcccacaaataagtgagaacatgtgatgtttctctctctgtggctggggaggccttacaatcaaggcagaaggtgaaaggcatatctcacatggcagcagacaagagaagagagcttgtgcagggaaactcccccttttaaaaccatcagacctcttgagacttactcactgtcatgagaacagcatgggaaatacctgcccccataattcagttacctctcacagggtccctcccacaacacgtgggaattcaagatgagatttgggtggggacacagccaaaccatatcacctgataacaagttaacactctttttacataaacaaacaaacaaaaaactaatagaaactgtatgctttaacttcatcctccccactttttaactttttcttgtttctatttatatcttattgtattgattatgtcttgaaaagtcatcgtagttattatttttgattggttcatcatttagtctttctacttagaataagagtagtttatacaccacagttacagtgttataatattctgtatttttctgtgtacttattattaccagtgaattttgtatctttgggtgattatgtattgctcgttaatgtccttttctttctgattgaagtgctgccttcagcatttcttgtagcagaggtatggtattgatcaaacccttcagcttttgttggggaaagtctttatttctccttcatgtttgaatgatatttttgccagatataccattctaggataaaaggtttttttcttcagcacttggaaatatatcatgccactctctcctggcctgtaaggtttccattgaaacatctgctgccagacctattggagctccattgtatgttatttgtttcttttcttttgctgcttttaggatcctttctttattcttgacctttgggagtttgattattaaatgccttcaggtagtcttctttgggttaaatctgtttggtgttctataactttcttatacttgaatattgataccttcttctaggtttgggaagttttctgtattatccctttgaataaactttctgtctctgtctctttctctaccttctctttaaagccagcagctcttagatttgtccttttgaggctattttctagatcctgtaggcgtgctcccttgttttttattcttttttcttttatctcctctgtgtattttcagttagcctgtcttcaagcttgcttattctttcttctgcttgatcagttctgctgttaaaggactctgatgcattcttcaagaatctctttgttgaatttatctggtagtattctgaattccttctctgtgttatctcgagtttctttaaaacagctattttgaattctcttctgaaaggtcacatatgtgtttctccaggattggtccctgttgccttgtttagttcatttggtgaagtcgtgttttcctggatggtgttgatgctaacagatattcttctgtgtatggacattgaaggattaggtgtttattgtggtcttcactgtctgggcttatttgtagctgtccttcttgggaaggcttttcagacatttgaaaggacttgagtgttgtgatctaagctgtatctgccttaggggttaccctaagcccagtaacactgtggttcttgcagactcgtagagttaccaccttgatggttttagacaagatccaggagaattctctgtactaccaggcagagatgcgtgcttccttcccttactttcttccaaacatacagagtctctctttgtctctctctgttctgagcaacctaatactgagagtggagggacacaagcacccctgtgaccaccaccactatgactgcactaggtcaaagccccctttacttttgcctctgcactaggtctagactgcactagacctgaagccagcaaagcagtgtgtctcacccaaggcctgctgtaactactccctggctaccgcctatgtttactcaaggccctaggactctacaatcagcaggtgggaaagccagccaggcctgtgtccttctcttcagggtggcaagtttccctaagccttgggttggtccagaagtaccttccaggagtcagggactagagttaaaaatcttagaagtctacttggtgttctgttgtactgtggctgagctggcactcaaactgcatgacacagtccttcccactcttccctcccatttccaaagacagaggagcttcccacttgtagccattgccactccaggccatgaggagtactgccagactaccaccaatgttcctttaaggcccaggggctcttaagcccccttgtcataaatgctgcctggcctgggcctcacccttcagagtagtggggtaccctctggcccagggcaggtccaaaaatgctgtccaagagtcaagtcctgaaatctgggaccccaaaggcccccctgtggccatgctggtaccaaaggtacaagacagagtcccctttacttttgcctctgcttttctcaagcaggagttttgccctatagccaccacagctaattatgtgctgagtctcacttgcagtcagcaagtctcagaggttcacccaagactgtcaatgtagtgcctgggtatgccagctgttttttcagggcccaaaggctcttcagttagcagtgatgaatgctgccaggactggattttttccttcaaggcagcaggttcccttctgcccaaggtgtatctagaaatgtcgtctaggaggtaaggcctggaatgagggcctcacaactctgaccagtgtcctatcctgctgtggctgagctggtatctaagatcaagagagcatcctccccactcttccctctcctctcctctcctctcctcaaatggagggaagtggtcttttttggagctgtgagctgtgcagcctggggttaggggaggggtgatggcagcactcccttggctgtcccagctggagtctcagtatgtctcctgtctgccccagcgcactgtctctgggccagtttagcactcggagttgcctcagagttgcaatgcttgtggcctagactgcctttcaagtttacttggagacacagagggcaaggtttgtgggaactcatgtttggactgctgggattggtggttcccctctggctggggctgggttaagtgttccctctgtgggtagacatcagctgagtttggtccggttttcctttttgctctaacagggcagaactgagttcattgcctctcatttgctgtgttctccttttcccagtgcccagagaggctctctgtaccacaccgctgctgctcggggtgcagggggtgggtgttggcaattcaggactgttttttctatctcttcagttcctctttcagcaatatgagttaaaactaggtactatgagtgctcacctgatttttggttcttatgaagttttttttttttttttttcctgtgtagttagttattaacttggtgtccttgcggggcagttggggacatgataggtagagctttctattctgccatcttgctccaccctccaattttgtttgttcaggctggtcttaaactcctgggttcaagtgaccctgatgccttggactcccagagtgctgagctaccgcatctggctgcacaaatatttttaattttgatgaagtccagtttattttttcctttgattgcttttactttaggtatcgtatcttaagaaaccattgcctaatccaaggttacgaagagttaaagttttagctcttaaatttaggtctttgatccattttgagtaagtttttatatatggtgtgagatagggatccagcctcattttttgcatgttgtccagcactatttattgaaatgactaatctttcctgctgttgaattttcttggtaatcttgttaaaaatcagttgaccatagatatatgggttcacttctggatccacagttctgttccattgatttctgtatctgatcttaggccagtttcacacagtcttgattactgtagctttgtagtaagttttgacatctatagttttaagcattttaattctatgttgagcatttttattcatgatttttttctagccttcttaagttttcaaggggtcctggatttcatagacatacacatacatgtatatgtttgtttggaggctggatctcataacaacatctttcctaggtttaatattttaaattagactagtgaaaggtaaagaggggtgtatagtaaccaaatttacaggaattaaatgcttaacatgttaacacctgatatatttttctcttaacattttaaaataaagttttgaggtaaattttatttaaacaaattggatttactgaaatttagaaaatcctgtattgaaatattagttccgacacttgtattataatttaattgtgaggtaactggtatcatgaagtctggatcccataggtaacactgaaaagacattatggaagggagaaatcaaaatattttaagtgaagagataataaagacaatgcaagatgattacatttcttgatatgtataattggaatgggattttcagttttcctctttttcttcccatttttagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactgtgacaacacaggaaaagttggttttcaggtgagattgaaaatgaagcaaagataggatgaatctgaacatctctccatctagagcccaatgaaggaagcttcaaatgagaacatgatggaatcagtaaccattcaatcttttgtcctaggattggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagttttgttattattgatatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtttctttctttctttttttttttttttttttttgagatggagtctcgctctgtctccaggctggagtgcagtggcgtcatctcggctcactgcaacctccgcctcccaggttcaagtgattctcctgcctcagcctcccgagtagctgggattacaggcgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactatgacctttaattgaaaataaataattaaaatatcagacatgttttggaaaagtcttaatttgagaacaccaaaggaaactaccccagaatctaatgtagttagctattaataacaatgcattattgaaagtatattgcaaatacatgtttcctcatgaaatctaagtaattttgttgtggaatagtgtcactgttacatttcccccatgaagttcaataaaccagcttagccacaaagaaattgtgttttattttctttgtttggttactgggtagagtataaaataaaacaatctttttttcctcctggtttccagataatattatatatatgatacacttttgaaaacaacaaaaagcccccaacccattggacaattattttcttgtatacatttgaggtcaaagaacacttcaggaaaaaaactcaacaaagtattaaaattagctgataacacagcttttgtatttgtgtgttttagtaatccagcttgttttagaatagttcagtgcaaaaagcaaatggtgcaagaggagttgatgtgtatttagacgtaaaagcatttaacagaatgaataactatagaaagtatgagaaaagagaacgaactacgtctcaggtataagattgcagttactgatttagacaccataggattagggatgtgggggcctctgatgttgattctgcttcccctggtcagtttattttacgtataagttacccttgtgttcaaacacaaaattgacattattcatgaaggactgctttcttaatcagatattaagaagttcgtcatgtattttgggagcacgtttgctacagcctgtgtggcaagggcgaatgcacttggtttgttggaataacctgatttatcaaacatttatcaagtatgggtcatgtgttctctatttgtgttagtggagctacatagacactgtccttgaagaacttacaaaatagtatatgaacaaataggaattctacaatatactgtgatcagtgtaatcaaagaagcatatacaaaggacaatgagcacagaatatggagtggtcttttgacttggatatgggagcagtagataatcaaaaagcttcacaatgagtggaagcatttatgcagcatctcagggtaaatgtgaggcattctccatgtaaaggagagggaagaaagtcatcccaggtgaatgcactgcagggctcaagagtggagttgaatttggggggaatgactgctaggtcagtgtgagtatgtgatagaatggagatgtggtcagaacacggaaatgaagctagcaaggtagattttggttaaactgccaagttgccataagcagtgggattaggactggcttgggtgcagtatctgaaactcagtctgaaccagcctataagggggattttaatgtaaggagtctgacttgtctcactggacttgaagacaaggatgtgactggactaaaagaagagctgggattgagcacacagtttcctaactctgggtccagcttctctgcacatctgcattttctctttcttttataactagatttttccattttttaagtttaattagcagaaaacatggccactgagtacttctgaacttttggatgctgcagtcattcaaagagaaatgaactctcagtctcaagttgaaatttccagcatagactgttaattggcctggcaagatccaggtgtccacccaagaccaatggccaaaaaagataaaataagcaatttccacatttaggggagaaggtattttgggggaaggggagcaaaaaaagaagatagccacacaaaaacatttgaactttactatttaggcaatgggtaactaatgaaagcattttgcaaggtagtgagaccgttagatttatgccataaattccagcggcaatgggaagggtgaggggatgaagtcatggtcagtcagcttactgaaatagcctagaagaaacagctttaactggagcactggcagaaaaatacagatttgagatatttcagaactaaaacccccaggagttagagaccaaggtcaggaatttcattgcatgaactagtcagtattcttttctagagctgctagttgcactcatgtatgtggccaaatgtttttttaaaatatcaggctttggttttattttttagattattacattgctttaatttgcctttatcaaaagtttgattcttgtgatttatttacatatatgtttttcagagtgttttgagtcagatgaaacttgtcatttaaaatttttaagttgtatatcctaatgctttttggtatttttcttgttctgagtagtttaattatagaagattctgtatatttttgagtcccagaacattctttaaattacaaaaacaattcaacttttgttttggttattcattccataaacttaacagagtatatggagccattttattacttctcagctcctcattattaatcttttcttgctgcaaatggagagttccatgtttcaataaaatgtgatcagtaatgggacttctttttttaagttaaatttttgtataggaaatacattcacatggttcaatacttgaaccattcacaaaagagtaaatggtgaattctccttcccactctttctcccagctcctcagttcttatcacaaggaaccagtaccatgaattttttttgtttctgtttttgttttgagacagggtctcaatctgcaacctaggctggagtgcagtggtgtgatctcagctcactgcaacctccacctcctgtgctaaagcaatcttcctacctcagcctaccaagtagctgggactacaggtgcacgccacaacacccagctaattttttgtactttttgtagagccacggttttgccatcttacccaggctgttctggaactcctgggctcaagtgatccattcaccttggcctcccaccccagttcccacgctgggattacaggtgcgagccaccacacctggcccctgaatttgctgtttcttcacataacagtataccctggagatgaattcatgttaaaatatgtaagcttcatcattctcttttaggtctcatggaattcctttagttggccattatttagatagccctctactgatgaacatttaggttgtttccagtcttgctattacaagcattaccaaaatggatatcattttacataagtaatttctcaaatgtgtgagtatatacaaagggaaaattcctagaagtgacattgctagatgaaaggtatctgtgtttgcaatttgggtttctaatcgccctcctcagaggttgcactagtaataaaaagcatgcctgattcctcacacactcacaacacagtctattatcaaaggttttgacatttggaaggaacattaataggtgaaaaatgatatctcactgtggttttaactggcatttatcttatgagtagggttgagcatctttttatatttaatgtttacattttgttttctgttgaattgtctgttcacattctgtcaggttttgtttttttgccttttgtagggatactgaatattttgggtaagttagtgatgttttatttttttttcctagtttgttttttgccaaatggcattgcttctaatggtttttggcatgaaaataattttaatgtagtgaaacttagcagtcttttccatgactctcattttgtgtcataattagaaagactaaccttgcctgagataagaattctcggccagatgcagtggctcacgcctgtaatcccagcactttgggaggcccaggcgggcagatcacttgaggttgggagtttgagaccagcctggccaacatggtgaaaccccgtctctgctaaaaatgcaaaaattagccgggcatggtggcaggcgcctgtaatcccagctacttgggtggctgaggcagcaaaatcacttgaacccgggaggcagaggttgcagtgagctgacattgttccactgcactccagcctgtgggacatagtgagaccctgtcaatctctctctctctctctttctctctctctctcacacacacacacacacaagtgaatgttagctatgtactggataattatgatgtctcaatgtaggtttatcaaatgtaataaatgtacatagtgagggaggccgtgtgtatgtgtggatgggcaggggctctgtgggaacttgatggtttctgttccatttttctgtgaccctaaatctgctctaaatataaacattatttttttattatactttaagttctagggtacacgtgcacaatgtgcaggtttgttacatatgtatacatgtgccatgttggtgggctgcacccattaactcgtcatttacattaggtatatctcctaatgctatccctcccccctctccccaccccatgacaggccccggtgtgtggtgttccccaccctgtgtccaagtgttctcactgttcaattcccacctatgagtgagaacatgcagtgttctgtccttgcgatagtttgctcagaatgattataaaccctatttttttaaatagatgtgtcagagactgcaggttgcctacccaatttttgtcttccctcttgtattaatttcctaggctgcaggaaaaaagtaccataaattgggtggcataaaaaacaggaatgtattgtctcacagttctggaggctggtagtatcagtagtgttgatttcttgtgaggcctgtgagagagaatatgttccatttctctcctggctcactgcagcctcgacctcctgggctcaagcaatccgccaagctctgccccctgagtagctgggaacacaggtgcatgtcaccatgcccagctaatttttaattttttttttttttttgagatggagtctcactctgttgcccaggctggagtgcagtggcgccatctcagctcactgcaagctccgcctcccaggttcacgccattctcctgcctcagcctcccgagtagctgggactacaggtgcctgccaccatgcccggctaatttttttgtatttttttagtagagacggggtttcaccgtgttagccaggatggtctcgatctcctgaacttgtgatctgcccgccttggcctcccaaagtgctggggttacaggcgtgagccactgcgcctggccaatttttaaattttttttggtagagatgaggtctccctaggttgcacaggctcatcccaaactcctgggctcaagtgatcctccagcctcggcctcccaaagtgctgtgattacaggtgtgagccaccatgcctggccagattttttcctcttttttgtgtgtgtgtgatggagtctcgctctgttgcccaggctgcagtgcagtggcatgatctcggctcacttcaacctctgcctcccgggttcaagtaattctcctgcttcagcctcctgagtagctgggaataaaggtgtgcaccaccacgcctggctaatttttgtatttttagtagacacaggttttcaccatgttggccatgctgttctcaaactcctgacctcaggtgatccaccggcctcagcctcccaaggtgctgggattatagacatgaaccacaccacccagcccagatttcctcttctcatagggatgccagtcatactggattagggcccatcctgatgacctcactttaacttgattacctctgttaagggccctgtcgccaaacaaagtcacattctgaggtaccagggattagaactccaatatcttttttcggggggcaggggcacaattcagctcgtaacacatctccctcttttcttactaacagaaccctggtttcttttgctggccacatagcccactagataatcagttcccagcctcctttgtagctaggtatggccacatatcacagttctggccaaagagatatgagcaggtgcttgccagggatttccagggaaactttgctttcctgtaaagaggcctgccctttcctctggttgcttcctcctcctctgtccatggctggcacgtgggagggaggctatagcactggcatggatgccttggcattacaaaatgctctggagaacagtgtcctgcagctaccacaccagctcaggctacttacctcatgattttgctgagaaaaacaatccccactgttcaggggatttgagtacctgtagatgaatgcaattctaactggaagaacacttgaggtgaaatgtggaagagacttggggacattgggactaaaacttttggatgacgattgcactatccctgtttagggactgcccgtgtggtcagggagcaatttggggcccactcactgccctagcgcatcagtccttcaaggagaggaacttgctgggagaacctgagttagtgcctttctaccagcctttaaacctgcgccaggggaaaacaccgttttagggacttagtgaacaatgggtgcgccatgcagatgtcattcctaggcaacaccctaggagtggcagagcaaccaaagagaaggaaccggggtcccagatgctgtgctgctaccatcacagccccagacagttatgcttggaccagtaagtgagagtcaagtagaagacttacatcttgttcgagccaatgttatttgggcttaactaatacctcatctaagttatcctagaaaagtacatctagctttaaattgttaaaatttgtcagtctgtgataaaattgatggtacacaattttactactgtatgaaaatatatgtgtaaagtctattatggaactggtatacgttagggatctcacctagctcatttaagaagaaagggactggcagggcgcggtggctcacgcctgtaatcccagcactttgggaggctgaggcaggcagatcacgaggtcaggagttcgaaaccagcctggccaatatggtgaaactccatctctactaaaaatacaaaaattagctgggctaattagtggtggtgcatgcctgtagtcctagctactcaggaggctgaggcagaagaatcacttgaacctgggaggtggaggttgcagtgagccgagaccccaccactgtactccagcctgggtgacagagcgagactctgtctcaaaaaaaaaaaaaagaagaagaagaaaggaacttagagaatttggggtagcttatgttatctttaggaggacctgggaccaaaatttggatgctacaaagacagggacaatagtagccaagataaatgcccagatgttgtagacagttgactgtcaccactatctctcctcagcacctatgacactcaggactggccacaaaatgtccccaaagctgtcccagaagtactgaaatcttcaacatcacactggaaagaaaggccattctccctgtgaccctgtctctacccacttcctagaactgaagctgcaaatatatcttgggaatcacaggttttatcatcccaggctctgcagcaggaaagcacactagaagaggatggggaggcgtcgagtaagccagtcagcatctgctgcagaaagtgatactacgcctctgaagctcttcactgggaaacacagcatactgctattttcatgcatttctgaagtacttctaaagtgtgaactaaaaaatccttgctaatttggtgatttgttatattttcataaactccttatgcaaatgtaagattagtaaatgttgcctacttctgagagtgtattcttccattgtacatccaaaggtgctatggagcatacattttttaattctgaaaacattgggaacttaatcacgtaggataaggtgtatgaccagctagacagggaggcactccctgagcctttttcttccatcctcttctggctgaacaccctttcctttacgatctcaccttcagagttacttgattcctgaacccatgtttagagcctcacctttacctctgaaatcctgaattggctgctgcatgtgggccatctttcttttgcagtatctgtggaccactcaaacatgtaatttaaaatgtataaacagtggggcatggtggctcacacctgtaatcccagcactttgggaggctgaggtgggaggatcacttgagcgcaggagtttgagaccagcccaggcaataaagagagacaccatctctacaaaaaatttaaaaattagctgactgtggtggtctgtacctgtggtcccagctactcaggaggctgaggtgggaggatcgcttgagcccaggagattgagtcttcagtgagccgtgatcataccactgtactccagcctgggcaacagtgagactcagtctcaaaaaataaaaataaaaaataaaataaaatgtataaactcaatcttcctccttaaatttatttttcttcctgtgtttcctcaaaacctccagcttctgttgaggcttcccttcccccaactcccacatctagtctcctacctggatctatcacttccactgcctttgacccttgcttctgtcctctcttgctgagaggcagaggacgccgcgcttaaactgtggagtgagaccacaaagaagctgaatcccagatgttctttttttttgaaacggagttttacccaggctggagtgcagtggtgctatcttgggtcactgcaacctccacctcctgggttcaagtgattctcctgcctcagcctcctgagtagctgggattacaggcgtgtgccaccacatccagctaattttttgtatttttagtagagacggggtttcatcatgttggccaggctggtctcaaactcctgaccttaggtgatccgccctccttggcctcccaaagtgcagggattacaggcatgagctaccgtgcctggcccagatgttcttttttaaacaaattattttatgttttattttttaagagagagtcttgctctgttgcccaggcttgagtgcagtcgcatgatctcagctcgctgcaacctctgcctcccgggttcaagcaattctgcctcagcctcccaagtagctgggattacaggagtgtactatcacacccagctgatttttgtatttttagtagagatgggtttttgccatgttggccaggttggtctcaaactactgatttgatgtaatccgcctgtctcagcctcccaaagtgctgggattacaggcatgagtcactgtgcccagcctgaatcctagatgttctaaaagtcaaacctctccatgcttcaatttcctcatttttaaaaagggctgacactaacccacggggttattgtgagaatgaaataatatatgtgtagtatctagtgttgtgtaacaagcttccccaaaactgagtagataagaccacaattattggttgtctcgccgctgtggcaaggcaggagtgtgcaggcagtgcaggctacaggtctctcctgaggttgccgtcatctgaagtccaggtgaagaatatgcagcagctggggcagagcagccggcactcctcgggcatctctcgctctctctttctctgtgctgctccgtatggcagcctcaaggtagcaggacttcttacatggtggctgcaagcacccagagtaagtggcgcaagataaacctgcaaaagccctggggcgttttctaacttagctcgaaggtcactctgtatccatgtagaacagcaatcgcaaaatcttgcttggttttaaggggaggagatgtaaattctgtgaatgagaagcccgtcagaaaacctgtggacctttctacaaactatcagaggtgactatgaagatgttttgtactatttggatggtccactgtttatctcatgacggagtaattaaaagacttactaaactgaaaaaatgtgctacacgttttttttttcccacagataaccgatccaaattgttgaccatttctttctttctttctttctttctttttttttttttttttttttgaggcggagtctcgctctgtcgcccaggctggagtgcagtggtgcaatctctgctcactgcgagctctgcctcccgggttcacaccattctcctgcctcagcctcccgagtagctagggctacaggcgcccacctccacgcccggctaatttttttgtatttttagtagagacggggtttcaccgtgttagccaggatggctagtgtttgaaatatatttcatgctaaggaatatgctaccttaatagttatttttagataaaccatctatctcttcctagtggatgtttggaaatgtttccatctgatgtgtgt

SEQ ID NO: 1139 - DNA, 3869 bp, Homo sapiens
gcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccctgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctgtcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactgtgacaacacaggaaaagttggttttcaggtgagattgaaaatgaagcaaagataggatgaatctgaacatctctccatctagagcccaatgaaggaagcttcaaatgagaacatgatggaatcagtaaccattcaatcttttgtcctaggattggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagttttgttattattgatatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtttctttctttctttttttttttttttttttttgagatggagtctcgctctgtctccaggctggagtgcagtggcgtcatctcggctcactgcaacctccgcctcccaggttcaagtgattctcctgcctcagcctcccgagtagctgggattacaggcgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactatgacctttaattgaaaataaataattaaaatatcagacatgttttggaaaagtcttaatttgagaacaccaaaggaaactaccccagaatctaatgtagttagctattaataacaatgcattattgaaagtatattgcaaatacatgtttcctcatgaaatctaagtaattttgttgtggaatagtgtcactgttacatttcccccatgaagttcaataaaccagcttagccacaaagaaa

SEQ ID NO: 1140 - protein, 229 aa, Homo sapiens
MAEEMESSLEASFSSSGAVSGASGFLPPARSRIFKIIVIGDSNVGKTCLTYRFCAGRFPDRTEATIGVDFRERAVEIDGERIKIQLWDTAGQERFRKSMVQHYYRNVHAVVFVYDMTNMASFHSLPSWIEECKQHLLANDIPRILVGNKCDLRSAIQVPTDLAQKFADTHSMPLFETSAKNPNDNDHVEAIFMTLAHKLKSHKPLMLSQPPDNGIILKPEPKPAMTCWC

SEQ ID NO: 1141 - DNA, 90043 bp, Mus musculus
  misc_feature (1)...(90043): n = A,T,C or G
caggtttttttctttttatttgtttattttcttaatgagtgtgcacatgccgtaggtacagtgtacctacgtactctgtaggtgtgaaggccagaggacaacccttgggagtgagttctgtcctttccccatacaggtcctagggctggacaggaagtgccttactcctgagccatctcacagtccacagatagggttttcttaagatgtggcagctttgtggctactttctattcttttcttcttccagatttatattgtatacttttatctcactggactaatcatccttacagtattttgagtgacccctgtagtagtttttatacacagcaccatatatcctgtaacggagttggctttgcgtagtttttatcagaagacatttctttcctcccttgagtagaaccaccaggaagtaaaggctgattagaagcgggcgggcgagagcctgcctgctgccctccaggttggtaggaaggaggaaagagtccattgacctttttatcatcaggtacagtgttttcgcagatggggctagcagttgtgttgtttctagacccgtgtgagtactggaccgccacatgctctttccatgtctcttgtcatcaccagcggtgactctttacctgggactgccttgtttagcattcgaaagtcttgcatcctgggaagtccttcagtcctacacaaatcagtatgatcggtcataatgagatggccatatgatttgtccgttattccagtaatatcccgtgttatgtcatttgacttcaggtatgaagcaggcttccaggataaactcttcttgctcagtgccaacaattatatggtgattcagtttgctttagtggtatttgacttatttcatgtctgtatttataagggatattggcttatatttcctttcttgttatacgtattttgatttaatctattcttagccaaaagaagaagcggtgcaccctatgtttaaggtctgaagtagtactcactaaccctgagggatgtgttgagtggtttttgcctcctgttttctgtgaggttcgtgaaggattggtgtgactctttaagtacctttggtagaatttaccagtgaaagtgtctggcctggattttctctttggtaattaatttcaggcttggtcttactcactaccaattcatcaaggagggaagccaaggcaggggcttacagcagaaaccctagcgaactgctgcttactagcttgtcctttggttggctcctacttagcttggcttcttttaagattttacttgtaagtctgcctaccctctccctccccgtccgctcccctcccccctcctctgtgtccccctcctcccatgtcccctggagttggtgttgtaggcagttggaagtcacttgacataggttctgggagctaaactcaggtcctccttatttatttatttgtttgtttgtttattatttatctatctttgtctaccggggtttttctctgtagcctttgctgtcttggaactcgctttgaagaccaggctggcctcaaactcagagatctgtctgcctctgcttcccgagtgcgagtgggagtgcagggactaaagtcgtggcgtggtgcgtggcccccgcagcctagcaagaacagctttttctctatctgctgagctctctctagcccctggaaagcttttttttttttttttttttttaaatcctgtctagaactacctgcctgagaagtggaccatgcaaagtgggcaggccctcctacaatgacgaggtctgtgtgcacacctatgctgtagagcacatgtgatccgaggacaggctggcctgactccgtgcgtgcgggtcctgggttgaagtcaggttgtcaggctctgtggagctatctgctgactcagtcttttcatcattaaaagtatccttttctttctcctcatgttcactcttttaacagcatcttttttgtgtgcttttactttcagcctgtttgttttattgatgtgaagcgcatcttgtaaacagtgtctagttaaatgctctctgtaagaaaatgccacaactggcttttgattacagggtctcatgtgctcctagcgtagtcactgagagatttatgcctgcagttttactacttttcgtatgttccattaaaaataattcgcttactctctgctgcctcttttatacctaacagacttcccagtgtgctattggaactcccttttcctgttatttatttatttttttaaagatagggtctccttactggcctgttgctcaccgtgtagcccagactggctttgaatacagcacagtcctcctgcctcattgtgctgagtgctgggacttcaagtatgtgtcagcatgcccagcagaatacagtttttaatttattaaatctatttcagatcaagaacagcttccttgtaacatagaaacttggcttcagcctagccacatgcctcccgtcctgcctgttagcagcagtcagggtactgcagtccagtcttctgccttatttcttctttgttgtctgcacatgggaccgtactgtgctagcccgaactattgcatgtgacccttgagtcagcctcccaagcagctgagcaggcagtcaggtgccgctgcccggacttccgttttctttttgcagtcttgtgtcttctcaaagagcttttacactcgctacatttttatttctttgtatgggtttatctgtttccttgcctgcatttctttaagggtgtgagttgttcagcctgaaggagctgccggagggttgcttagagggcagctctctaggcatttggttttctgcgatctttgtgtttcccttcagttttgaggagtagctttgctgggcccagagcccctgagctcaggtgtttccctcctcccaggacccttaacattccacctgcctcggtctggtctccccttgattctcataagttacttttctgctttgaagatattctgtttttgacgtttaacaggttaattatgatgtgtctagtatggatctttttctttttttgtatattgtattcatttagtctttaaaatgcttaagagtatctatatataataattatatttattgtgtaccataactttgccctgtatttataccagtcccagtcttttattattgtctgtctgtcttccttccttccttccttccttccttccttccttccttccttccttccttccttccttctctttctctcttccttcctttttctctctctctctctttcaaaaagacttatttttatgtccattggtgttttgcctgaatgtatttctgtgtgcgggcgtcaaatcccacgaaactggagttagagacagttgtgagttgctgggggttgaacctagtcttttggagatcagcccttgcttttaaccacggagccatccctccagcccctgtagtgtgtgttgtgggtgcaagcgtgctattgtgtgcatgtggggaaccggagaccactttgtggggctggttctctccttccatctttacatgtgttcctgggactgaactcaggtcacgacactttcacagcaagccacaccaagccactttactcaccctgcgttctcgatggctaacatcatttcatgaacgtatgttttgtgtgtgtgtgtgtgtgtgtgtgtgtgtgtgtgtggtttttccagacagggtctctctgtatagcgctggctgtcttggaattcactctgaagatcaggctggcctcgaactcacagagatttgtatgcccctaccgcctaaattctagaattaaaagtatacctggtggggctggttctctcctggactatttggagactgaacttggcaacaagtggtttttttttttttttttgtcttctggtttttccagacagggtttctctgtgtagccctggcatgcaccatcactgcccgatgacaagtgtcttaacccttaggccttaactaaccttaatctagctggagggctgggattacaggaatgtaccacacagtccctggctaacttaataaaccttgattttttcccccaattatttttagatttaatttatgtgtattagtgttttgcctgatatatctgtgtgaaagttgtactatttgtgtgcctgatgcccacagaaggcggaagacagtgctgcatcccctgggactggatagttgtgggtgccaggaactgaacccagggctgctgcaagagcagcagatgctcttaactgccgagccatctctccagcccccctgatgattatttcttgaaatatcttacctctccctgacctgctctgtagggtaactgatttctagtcatgaattttcaagtttgttaagtgtggtattcaaatgtgttgagctttgttagtgaggtttttttttttttaaatttcttttattttatgtgtgtgtgtcttttgccttcgtgcatatatgtgcatcatgacggacatggcagtgcctgcgggggctgtgagccaccatgtgggtgctgggaacctaacctgggtccttgcaagagcaacgattgctctcaattcccgagccatctgtccggctccttcgctgatgacattgttttgttttgtttgcttgtttgtttgtttttgagacagggcttctctgtgtagccctggctgtcctagaactcacaggaccaggactggcctcgaactcacagagatctgtctgcttctgctccctgagtgctgagattaaagacatgcatcaccatgcccacatagatttttaattttactgcttttaacattataatttttatttctttcttttttgcaactttgacactttcattgagattgtccaattttgattcgtaactgtcttactctgtcttgattacttaaacataggttttattaatttggaaatgaacctgaattttacttattttctttttctctccttcttccctttctcctttgaatcagggtcttactatgtagtcctggctggctggaacttgctatagtgaccaggttaggctggctggaacttgctatagtgaccaggttaggctggctttgaactcacagaaatccgcctgcctctgcgtccctggcctgagccaattctcctgccatttgggtcctgaggattgaactgaaggttcaatcttaacgctctgagcgtgtgtctccctggcctctaaacgtcagatgtaatgtaatagctaaaccatttactgaacagcaaagcattttatttaagatcctagtcagtacttgtatttcaagatatgcacagtagtataatacttttgaacattgaactttatttattttttttttaaagatttatttatttattatatgtaagtacactgtagctgtcttcagacactccagaagagggcatcagatctcattatagatggttgtgagccaccatgtggttgctgggatttgaactctggaccttcggaagagcagtcgggtgctcttacccactgagccatctcaccagccccaacattgaactttatataacagattttatttaaagaatttgcaactttaattaactaatggttattgatagataggagatatatatatatatacatatatatcaatcaactgaagttttagttacatttatttatattgaacaaacgtgcactgactggtgtggagaccagagaacaacgtgtgggcatcgcttctcctgtgctggcgtgcaggtcctgggggtgggacaactgtcagatgtggcagatgcaacatgtcctttgcccaggattcagtatctatgtaaaagatctatcagggacctggagggaaggctcctctgctaagagcgtttgtggctcttgcagtggatctagacttagttctcagcgtccgcatggtggctcgcagtcatcagctctggttccgagggatgtgacgcctttgtgggcgggcgtgcatgagcgcacaaacactcgttcacataaaataacctccccagtctgtgaaatgggaatacagtatagatggctacttgtttgtccacgctccctgcggttccccgtgttgggggctgagttaggtgccgcaggtaggaacaacaagccagagtgacagtagattgaggcagctgacaggacagtataggagttgcaatggttgtaaagtattatgaagctttcccagccgtgcccttgttaggtgctggaggtccagcccccctttcttgctcctccgttatctgctcacggatgcttgcttccaccagaaagtgcacacccaagtcattagttaaaaataaaataatcctttaatagtattttagttttttggaagacacagcagacaccatagctgctattttactgctcttatattttgggagaggagacaggcaagcattaagaacccaaacaaggtagttttagagagtgataaatacagcaagtgaataaaactgtgatttttaggtagggaaggctcggaggcccgtgtgccgatgaagtgtgctttgcgcagggagcactggctgaagggggaggggaaggaactgtgtcctgaaggatgctgtccatcctgctggccgtgcggtggggactggaggctgtggagcagtggtgtgaaggcagtgtgtggtccgtggtgtgagtactggtgtgagtacttgtgtgctggtgtgttcagcaagcccaggtaggagagaagtgtgaggtcagaggtcagctggccagaaggaacatctgtctgtttgttttttccaggtgtgcagaaagccacaggaaaggcagtgcagtgcttttattcctggccagagaattaacttagagcaggatctgtttttcttttttcttttctctctctcttccttccttccttccttccttccttccttccttccttccttccttccttccttcctctctctctctctctctctctttctctctttctttctttctttctttctttctttctttctttctttctttctttttgtttggttagatttatttattattatatgtaagtacaacgtagctgtcttcagacacaccagaagagggcatcagatctcattacggaaggttgtgagccaccgtgtggttgctgggatttgaactcagatccgagcagtcagtgctcttaactactgagccatctcgccagcccaggatgtgtttttcttgtaaataagagtttggataaatgttgtgtttaggatttcatgtaaatgatatttggtcatataaacgatatggaaaagtaagtttcctactggatatttcttctgtaaagtttatctaaaaatcgaccgccagcaggtataaagctttaacttttagtgcagtaaccggtgcgttgtcgatgtacacttcctgactgtgcctgccgttccagagtctgagtccgtgtgaaaggttaggaggctgagcgccaggtggcaggttcatctttagttctgctggtaaatgctggcagccatgtcggctcaggcttcactgtctctgtgctcattgagtctttaactaacaggacagtggtgacgaacaaggaaaagatacgtcagtaactttcttacatattccctatacagcaccaggatttctgctttcatttttcttgtatcgtttccttcttgcatgaatgaaattgattttttttctttttagtagaatcattagatttctcatttcctattatatatcctatagttattttctttgtttggtattggaattacatttaccaacctgcagtaacaactctgagtttgaacactaatttaatcctgtaaaactctacttctggactggtgatggagctcggcgacttgccgtgcacgcacagagccctgcgttcatccccagggccagaaaaacaaaaactcctttatggtcctccatctctttcagatgtcacaagacgtacgccttcatgcatgtgttcgcccaaataaactagtctttaaaacgatgccctcattagataaaataaataaaatgtgtagttaaaccaaatttatattaatatcttggcttttagacaaaaagtgtttggagcaagtttgttaagtctttttaaagcacagagaaaaaggaaagagcaaaacccatttacagcaacacttccctgccgcctgggcgtgccctctgaatcctgcccttggtttcctcacagagcttggcgtccagggccggcccctctttgtcttgttgggctcatctaactattccctgaagcctggctctgcttacagtaatgagctcttcagacttttctgaggacgttttcctacctctgcttttgaaggccattctgcagaacatagggttctttgttgatggttttttgttttttttttttttgttttttgttctttgaatatatttgccagtcttctgaccaccaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatgtctgtctgtctgtctgtctgtcttcggtctggggtacatagtcctggctgatcctgaaactacctggctctggctcttggtagattaaaggtgtgtgtcatcagcacacccaacctttgttttattttttttcaagttttatactccagaaggggagtgtcttagttagggtttctgtagctgtgatagaacaccatgaccaaaaatcgagctggggaggaaggggtttatttggcttacacttccctattgctgtttgtcatgaaggaagtgaggaatttaaacagagcaggaagctggaggcaggagctgctgcagctgcctggaggagtgctgcttactggcttgcttcccatagtttgctcagtctgctttctaatagaacccccaccacctgcccagggatggtcccacccacaaggggctgggttctcccctgtcaatcaactaagttaaaaaaaatcccctaaaagcctgccaagatcttattgaggcaattcatctacagtgactatagcttttgtcaagtcgacagaacactagccagcacaggctggtgagatggctcagaggttaggaaccctggctgctctttcagaggtcttgagttcaattaccagcaaccacatggtggctcacagccatctataaaaaatgagatctcatgtcctcttttggtttgtaggtatacatacagacagagcacttccacattaaataaagttattttttattttttaattttttaaaaaaccaccaacaactagccagcacaaggagttagagtgccaccacttgggaaccttttggttggggctgcagagaaagttcagcagttaagagcattgcctactcttagactccagcgcacacgtgtttccacacgaccttctgtgactccagtttcagggggtgaatcctactctgccttttgaacataaaaataaaagaagcctattggttgattgtaatgtgtactccataatatagggcatagtctgtgtatgttggatctgaccttacttaataattatcacttagtggcaacttaaaattgcatcattgattgtaaagtttttgattccttggtcatctagaaataatgattatacatttgtgtaaatgtgtgccatcaacctttggagatgatttattttattaagtatttactgtctgagtcatatctaattagggcaaataaattttttaaatagagttgtgttaatactgtcttttttccttcccattagtagttccagagaacctgctggtttagagtttagctcttgggagttgtgaaaacagtgaaggatgcttagactacttaacattcaaactgtaagtcaagtttatttctgtttttaatacgtttgcgattttagaatacttagagtaacagggaagtttgatgtgatgggattgtggattttttcttcaattttctgatgatgtaaacacttcctatttaactttctaatatgttaaagaaggggctggaaagatagtccagtggctaagaggacttctgctctttcagaggacctgggtttggttcctagcacccaccttccacagctggcaactgcttatactccagttccagggaatctagctccctcttctggacactgcgtgtatttgtacatatgtggtacctacacatacactcaggcacacacacatatgcacagtaaataacaaattgtttttaaaaatatgcaaaaggagacttaaaagtatttgatttatggggctggagagatgactcaatggttgaaagcactgattgctcttctagaggatctgggttcaattcctagcatctacatggtgcttacagctgtctataacttcaagttctcagacccttacaaggacatacataacatgcaggcaaaacaccattgcacataaaacagagatagataaataaataagagtattagatcattcttaggtagtgagatgaagtttctaccttttccagatacttcatttcatagtaaatgtttacagaagtgccttaatatttattcccatattatatgatgccgtggtcaaagttagtattgagtataagattaatggagtaaattacttggagtatcgatttctttaaatgtttttaaagtttctgcattctttaattttgacattaaaaaaaatcctctcagaaaactttgtattttctgtgtatgaaaaacataacacagagtccaataaaaagcaacttaaggattacattcagtgctcacagtcatctattggatggaacacagggcccccaatgaaggagctagagaaagtacccagggagctaaagttgtctgcaaccctataggaggatcaacaatataaactaaccattaccccccagagcttgtgtctctagttgcatatactacagcagaggatggcctagtcggccatcaatgggaggagaggcccttggtattgcaaagattatatgccccagtacaggggaatgccagggccaggaagcaggagtgagtgggttggggagcagggtggggagggtataggggactttcagagaggaaactaggaatgtaaatgaagaaaatatctaataaaaaattacatttggaatgtaaatgaagaaaatatctaataaaaaaaattacatccatttgaaacatattttgatactcatctttataataagaagagtgagggctggagagatggctcgggaattaagagcactggctgctcttccagaggaccctggtttaattcccagcacccacatggcagctcagggatccgaccccccttgcacagatataaatgcaggcaaaatatcaatgcacatgaaataaaaataaacaaaattttaagaagaaaaaaggggaggaggaggaggctgcctttgggaggggctgagagatggctctgtcagtagaagctgccactcattgcataagccccacactcccaagttttatttgcttaaaagagttttaaaataatttttaaaagatttatttttaatgatgtgtatgtgtatgtctgtgtgttagtatttggtgtgaagtgaacacaggtgtcagcagaagggggaagagggcattggattccctggagcagcctgagcgtgggtgctgggaactcagtatcctttgtttttgttattcaagacagggtctctctgtgtagccttggttgtcctggaacttgctctgtagatcaggttggccttgaacgtatagatagccatctgcctctgcctcccaagtgttgagatcaaaggcactgtgccaccactgccctgctgagctcagtactctttaccagtgatctctctctttccagcccagattttaaaaatttgttaaaatattccaggtataatattgcatctctaaaaaagaaggaagttataaaatttttaaaatattacaataatatgtgtatgggcgttttgcctgcatgtatgtctgtgcaccatgtgtgtgcctgaagagggcgctggatcccctggaaatggagttacagacagttgtgagttgccatgtgggtgctgggaactgataatgggtcctatggaagagcggcctgtgctcttaactgatgatcaatctccaaggaagctgtaacataatgtcttccctaacaatacctgtacacaatagcttggtaaaatgttattcaataagttaatgaatttgaatattcagttcttaggtagagttattgactgtcttttgacacaggtagaagcttgtatcctatttaattaaactgttgagtactaattgctttatatctgtcctatatatcttcaacaattcctcattgtccctcttttagaccctctggttaatcacctttagaagactggacttccggatgtctactccatctctattgaattaaaccatgaaaatgaaggctacagtcctggcaatcgtctgtgagccttagttccgttgcttcacagcatttgagacttcctcagggaacgcacgatggcatcggcggtggttgacagcggaggctctgctctggagcttcctagcgatggaggagaaaatcaagaggtcaggcatttaatatatctcatctctgtcttgttagtagagatccgtacatgagtctatcgtgaaatgaatgagggatacgggtactcaagagtggacgtgtaccgtgcataaacttgtagtggtcatggatgtgtttgcatgtaacttagtgatgggcgagaaaggtgctccactgagtgatgtgagatgagtgtgttagagagggctgggaggagcgagggcacgctagcttagggacagcttaggtttctgagagtatccattttcttagactatagagaatgagagatacactcattgtgtgtaaatacccaaactgcagttgtctgaagttagaagcttatgtttgctttccttgtcatttttatttcttagttattctgttatgtctaattcaggattgatctgtcagatttttaatctaatatgtgcagttatttgtatagttagaaaatgaagttttgaaattttctgccagtaggatttttgactcttttgtgtatttggtcattttcttgttaccgaaagaaagcaccgaagagtgagaggtaggagaaggaaagagggtttctggtccccgctccttagcgactgagaattgtcccgtgctgcatgcagatgtttgcttggagacaccttggaagtctctctgtgaaagatgctgctgtccctggggttgatgtcaggagaatggcacagtggcatgcctgaggacagggaggactcagggctgtgttctggggtcctgatggttcatgcttgcttgctgtcttttcagcctctgagacccatctgctggggcagacttctgggatgtacttttttttttgtcaagtgggtttgctaactcctccgtgttccctttgcatttaaagactgcctctaaaacgggtgcagagtccattgcaagaagccaccactagaacatccctcccaggtcagcttcttcttcctttaagattccccttctgtatattacccctggaggtgagctgccagggatcctggatgctgattggcaggtgctgcttctctgtcaagttactttcctgggctctatagctttgcagtgttggtgttttattacgtgaggagagctgccgtgaacagtatatttacagagtacatttatgccttgttgattaggatttacttcttctcctcccttacacggaatcacaaggattcctgctcagaacttatcacggagggagacagttttagataatgaatttaccaagttgttactgactaatgatttacgtggtgcgatgggatagtgataatctatggggggaggtcagaagatggcagcgtgcttagtaggtacttaaggtgctgtggcacccgtgtggggacaacttccggttccaatcccaatccatccatttgttcttttaacagaggtcagctactcaatatgggtcaagtactttataggcaccgaggttaaaggacttcacgggagcagttaaaaatgtgttggggcagagctgactggagaaagtggttaattgatagtcaggcttctctgaagaggtgacagtttagggttgttaagagagaaacggtcatagacaaatgtaagtggaaagaattctaggaagagaaaagagccactagttttggaaatacttgatgttccaagggtaatctgaagagaatgcagaggtggagttttgcctgtgagcggctctccagtgatgtgcttcctgtatagggaatagttatagctgaggatggcagtgccacggacctttataatcatggcccctgagtcagaggaacagctaagatttaaaacgtagtgccagagctggctcaccaggtaaaagcacttgcccttgcagaggacccaggtttggtgaccagcacccacatgacagctcacaaccctctgtaactctagttccagggacccaacaccctcctctgacctgtggcgccaggcaagcatgtgatgcccagatactcatgcaagcaaaaacctatgcagttaaagaaaagggcagggccagagattgcttaacaggcggagacattgatctgtaagcctgagaattgagaactcaggtagaaggaagagagaaccctctctatccagtgtcctctgacctctctctttgtctatctgtctgtccgtctctctctctctctctctctctcacgggcacacacacacacccaccacacagactgactataagcatgtaaaaggtagaacactaattaactaaaagcaatgtttttcttgattataaaagtgatacaagctgggcggtggtggctcacgcctttaatcccagcacttgggaggcagaggcaggcggatttctgagttcgaggccagcctggtctacaaagtgagttccaggacagtcagggctatatagagaaaccctgtctccaaaacaaacaaacaaacaaacaaacaaaaaacaaaaacaaaaaaccaacaaccaaccaaccaaaaaacaaaacaaaacaaagtaaacggcagatgctgatgagtgtagacgtaaaagtcattttgaagacaaatataatgatgtaataagatctgatgtacttaatatcagttaccaaatatgaggggaaagttcagggttaagaaaattattaatattacttattttatttacatgagttcactgttgctatcttcagacacaccagaagagagggcattggatcccattacagatggttgtgagctaccatgtggttgctgggatttgaactcaggacctctgaaagagcagtcagtgcttttaaccgctgagccatccctccagcccccagtgaatgtccggggctttcaacaaggacccttctgtgagaagattccttattaaagatttatgaatgtattttatgtgtgtgagtgttttgcctgtatgtatgtgtgtgtaccatcaatcagaagaggcagggaacctcttggaactccattacaggtggctgtgaaccaccttttgggtgctgggaagtgtcctctgtagaggcaacatgtgatcttaactaccaagcaatttcttcagccttgagagcaaattcttagtgaaatgagattttatgaaattccatatccagttttggtaaaatctttctttagatgtataatatatatatccataatcctatttagttgttaagtattgggacattttctttaatgctaactgctagcgagagattaatagtcatgtgtggtgatgcacatctgtaacactagcactcgggaggtagagacaggaggctcatgagttcaaatccagctttggctacttaaggagacatcatctcaaaaactaaaaagcaaacaagtagctctgcatggtggcgcatgctcgggaggcagaggcaggtggatttctgagtttgaggccagcctggtctacactgctagttctaggatagcctggactacatggagaaactctgggaaaaagctcaacccaacccaaccaaccaaagcaagcgatggcttgaacagacaatattgagacactgccttaagagagaaagaaaagactctaacaaagaagcacactttcccctcggaaagcgggggtcagtgctgtggatggggtcagcccgctcagctattcttcacacaaaggctggtgacacaaagaggtctcaattctttgaagtgaaatggttgtttgtttctgctaacacaaagtgtgaacagagctgccaagatggcctggcttgtaacacctctttcgtcaggcctcaagacttgtgtgcccaggacacacgtggtggaagaagagattgactctggcaagctgtcttctggcctctctatataagtaaataaatgtaatttaaaaagttataaaaattatgtaatagttcacacagacagacagacagacacacacacacacacacacacacacacacacacacacacacgtacacactgaaaagtatcacctaggcagctatttgcacatacgggaatacgatatgctagcttttattcttgagacaggttcccatgtagatcagtctggccttgatctcaatgtgtagccaagaatgatttgaacctcctgactctcctgcctccgcgtgctgggataaaggtgtgtaccactcttcgtgtggagctggggatcgaactcagggcttactgtattcttgggaactgagccacaccctcagctccggctgaggtttttaattatgtgtaggaatggtttgtcagtttgcgtgtatatatgtgcgctgtgtgtgtgcagacactagaagagggcatccagtccctagggcctggagtcgcaggcagttgagctatcatgtaggttctgggaatcgaaccagggtcctttgcagaaacaacaagtgctcttaatcatggagccaactattgagcccggggcatctgagctttagaaatttaaatcaggatttataaggagaacgtgtgccatttactctgcattctatagtgtgaggcaggaatagaaagacagggttattgtgtggggaaaaaagacttagttgcctgcagttggctcctttcttcaggatgccaggagtgctgtgaatgagagccatccgcatcctgtcttcccaggtctgttgccgtgctgagagtttgcacttactcatggtgagggcattcacacctgggctacaagttatggttagtgtgtggttacgtcattttttaaaaactgtgaatagaagtttctagatgtatatgccccagtacaggggaacaccagggccaaaaaaatgggaatgggtgggtagggaagtgggggggagggtatgggggacttttgggatagcattggaaatgtaattgaggaaaatatgtaataaaaaaaaagtttctagatggggttggagagatggctcagcggttaagagcactgactgctcttctgaaggtcctgagttcaaatcccagcaaccacatggtggctcacaaccatccatcatgagatctggcgccctcttctggagtatctgaggagagttacagtgtatttacatataataaataaataagtctttaaataaaaaaaaagaagtttttagatgacatcaacttccagcgaaacacattgggaatttttccacttaagtctgtgagagcagtgtaagcaaacaggaaaacagagaaagcatgtaatgacaagggggcatcctcagaaagagtcctaaggaagtcatcatcgcctccaatcaagggagcaaatcgtgagctcttgtgagggatgcagtgtccaaaacgcagagaagccccgcgctaaagaaagagctgcatgcatcgtggggctccgtcttctctggctggatcacccagaggttgaggctccatgaagccaagcaaaggctggccaaaaaggcacaaactcacttcttctgctgggagatactggcattctagtcagccaggcagaagggtccttgttgaaagcccaggacattgactgggggctggagggatggctcagtggttaagagcactgactgctcttccagaggtcctgagttcacttcccaacaaccacgtggtggctcacaaccatctgtaatgggatctgatggcctcttctggcatgcaggggtacatgcagattgaacactcatgtacataaataaatcttattttaaaataaaacaaacccacaagggtcatgtcttacatagtagggctaaattagctctagaattaaggatagttggactttaaccttaaaaactggttcaggagggtaggggtatatgtgtctagcctgtacaggaccctgggcaagatccctggtgttgccccctgccctccacctgaaaaagctgatcggtacgtaactgtccactgtaatactcttaaggcaagaacgtaagtgaaatgtatcatctagtagtggaaaatttacgtaagctttatggagcacgcagcactgaagtgcaccacctgagcagcttgttaaatggtgctgtagaagtaaggcagcagagtctgaggtcagcagtgggaaggaagctccttaacaaacacagaggaaggaaggaaacgagaagggcagaaagcagcagccgtccactgcccactgccgtgccgtcctagcttgcttcaatgtggtaccatggcaggttctgtcactgccgacacatctcattcctgagctggtgttctgtgtggcgtgcgtgcgtgcggggccaccttgagctcaccatcctcttgtgctgggagcggaggtcagcatgcccccctggcttcctgcctagctctcaggatgagcagagcagagtccaacagaaaaataagatgtgaagaagcaacagctatacattttgtaaatttgataactaaacctataggtgtaataattttaaatactatgtaagataaaccagaaattaggcagcaaggacatcatagtaaaattgctcaaagccagattcagagaaagactcttaagagtagccagaggcgaatcgcaggcaaagtgaagacaagtgtgccacacacttgagttgaagccttacaggtcagcggacgacagaatctttaaagtgctggagaaaccctcaggggttagatagaccatggcctttaaaatggcttggatacgatcagggcagaggtggtacacacctttaatcccagcacttaggaggtaaaggcaagcagatctctgagttcaagactagcacctgtgtggtgggtcacaactgtctgtagctacagttccacaggatctagagctgtcccaggatggcatctcaggataccaggcacacacatagccacatgaaaacatgcaggaaaaacccacttacacataaaatcaattcttcaaaaaaaaaaaaatgctgagagggtaaaacacctgtttatagttacatagttagtagcttggtgggtttgctcagcgggtcccaaacctggtggtgaactgtgtccaattcctgaacccataaaatggaaagaaccaactcctgcagattgtgtcacacacacacacacacacacacacactaaaaattttaaaatgagttttccacctgagacaaaggctgaaagaatttatcataaatatatatgaactataaaaattttaagtaatttttttaggcagaaattaatgattccatttggaaacttggttttatgcaaaatgaaaaggcctggagaaatggttagtgtgtggtgaatataaaatgttttttgaagagtaaagcttgttgtaaacacttaacatgtgctgtagctctcctaatgtgcttagatagatacaattttttgtttgtttgcttgaaacagaatctccctacacatccctggtgggctggccttgaactatgtagactagggtggccttgaactcaaagatctatcttcttctgcttccagagttctgggataaaaggtgtgtgccactgcctggctagttaaacctagttttattgatattaaatgtaccacatgtacacaaaataaataaaaaccaagcatgtgtaaaaacaatagacacacaaacgtatagcggacacgtgcctgcaatcacacctcttgggaagccgaggcaagagaaccgttatttctgggtcacagagtgaggctgtctcaacaagccaaaaccaactgctgttcagtagtttattaaggagtttaaaggcagctaggtggtgggggcacacccctttaatcccagccctccggagacagaggcaggtgcatttctgagttctaggagaccttgtcttgaaaaaccaaaaataaaacaacaacaaaacccaaaataaataagtaagtaagtaagtaaataaataaatacaacacatgtaccaacagaagactgcactattcatttccagtgcccgcagtgaaatacctgagcctgcacactttatagacggaagagctgctattgcctcgcagttctggggctcaaggacacggtaccagcttttctttagttctggtgacgggtggggtcataatcaaggaatgaggtcgcctggcaagactgaaacatgctgtggccaggccggacaaggctcattataattccctcactgtcacacagaactactccactgcttttcaagagtgttttcatgaaaacatttcagctgattccactgccacgcagtccatcttcctcttaacaatgcccctcctagaatcaagcttccattacttgaacccatagaggatatactttaacctgagggaagccgcagacttcttcagaatataaagaacagtaaggcgggggaaggtgccccattgaaataggaagaagggctgggggggtgtggctcagtggttaggaaggcttgcggtgtaatcttgagaattggtgttcagatcgcagcatccacttaacaagtactccagggaggtggaggagagaggctaactgctgcctgctggcttccagactagctgggaaagcatcaactccaggttcagggaatgagcctgacctatgtgtgtgcacacacataagaaattaaaaaagatgatgtgaataattgtatggctggccagtaaacaaacaaacaaaaaacaacaacaaaaaacaaagggtgcaacatttttagccactgaggaaatgcaaattagagctggagaggtggctcagttgttaagagcacacgactgttcttccagaggtcctgagttcaattcctagcagcgcatggtggctcacaccatgtataatggaatctgattgcctcttctggtgtgtctgaggacagagcactcatatacataaaatacacggataaataagtctttaaaaagaaggaaagaaatgcacattaaatggtcaaagatcctgacacactcaggctgattgtagtgtggtgccccgtgttggggaagatgagcagttgggtgctcagacatttctgatgggaatgtcataagatccaggttagaaaagaatttgacaacttagaattaagtgtagatcactgtcttatttggcagactcccaccttatatactgaggcagggtctctcacttgagtatagtttgtcagctcagctccactaggatcccatctgcctcctgaacactagagcccacgaggctgctgggatccagaccttgattctcatgctagtgtgtgagcgccagcacaaaaagttaaacacgggctggagaggtggctcagcggtcaagagcactgactgctcttccagaggaccggagttcaaatcccaccaaccacatggtggctcacaaccatctgtaatggggtccaacattctcttctggtgtgcctgaagacagcaatagtgtactcacataagtaaaataaatatcttaaaaagaaaagttaaacacacacacttacaaaacaatatgggggctggagacatggcacagcggtctttcagaagacccaggttcaatgcctagttgcacataatggctcgcaaccatttctaagtccagttccagtggatccagggctggcttctgaaagcaccaggcgcactggtggcgcacagatgtacacacaggaaaaacacttaaagagaagcagctcacagccccaacccccagcgtgctgattttcacatcaaattatagaaaaggcatagattaatgaggtagttccgcaggtgaaggtcttgccgacctcagcctctgggatacacaaagggagatgaaaatcagctccctcaagttgtcctctgacctcgtgtgcatgcacacgcatgtgtgtgtgtgtgtgtgtgtgtgtgtgtgtgtgtgcgtgcacatgtgcactcatactaaaagctgaggctgagatacagggcgagagatgtggagggctgggctgatggttgctgggatctgtgtgtgagccgggtgggccgttgctgagggacaggggaagttgtgtagtgttctgctggctggctggctgttgctacaaggatacatgcttatgaaagtccaaggactgcgtcttaaaacgagcatctcaccttcctggagaccattagaggcaactatggaaacacagttcttgtgcactgctgagcttgacgtctcgctccttcacgttcggcactagggaggcagaggcaggggcatctctgagttggaggtcaccctgtcttgcatggtgagttccaggccagcccgttacacacgtgtggtgctaggatcacgttgcacttccttgtctgattcgtgtttcagcttgctaaggcatctgagggtactcccgatttatactgtgaaggaaaatacgggaaactaactataagcacttgttgtatactctttaatgtcattctcctaccccaagtccagtggtaagggttataggatgaacaccggtaggcttttaaaaacgtttgctttggtgggtttctaatttgagggatgttgcaggatatttgatcacactgtgaaccctgcaattgtattgtttattgaaaaagctgtttctagtggggctcagcccttaatacacacttttaattccaaacaatgaaggcaaagttagtttgtagaaggaagcacccatgtttgaaagtgatgtctaattgagtgacaaagtgacgaatgtaggtacctagattctgcattatgtgatgtgatgtctttgaggacttaaggtgtgacgtttgctgtctaacaatctcactgtccagccgacatctatgtacttataagagaatgccctatgtagacagcatcgatgttaggcaaacagcttgtgtcaggaggactttgaatagaaattgtccttttcggggggattaaaaacggaaaaggaaaggatctggccagctgtggaggctacaggagacatgcataacttcatgggaagggttatattgggagccaagtcacacacacatggcttgcatgcagtaatgtggggaagaagctggtaaaagtggtttggtttttattttttggatgaggctgtagttaaaaaaaaaaaaaaatcccataatgaatggcttcacaaaacaacttaaatctttcggttctagaatctagaagtttgaaatcccagcgttggtgagccgtcttctgagagcagggggagtccgtccaccttatgcccctgtgtctttaagtgggcttctctctacccccacctgtgtgtccaaattgccctctcctgtaaggactggtgagatgggactatgcctagtcctagtgatcataccttagcctgtatatctctacaaggagccatttccaaataaggtcgcagtcacagccaatacgggtaaaaacacctacactttaagacataattcaacccataacaatgtggagttcgtcgttttgtgttttgaccttttagaagggacaggatcattattaaggcttttcgtgcaaaggaggaagtggcataggcggttttgaatgggctgcgacaaggtgcccccactgaggagacctccagaccagccctgctgatgtagagagaaagtgggccagcgactcattcctcctgtgatccctgctttgcgcatagctaagtttaaagacctaggagatattattgttaacttattatctaaatataaaagacagatttagaggaaaacaaaatgtgagaacagggggagatgctgataagttaatccacgatgttagtgttttacgtgtggtgtttgaaacggaagctgagcacagggttggatggagagcggtgctgctgggggcggggttggggagggggctgcctagggagggtgaaagtgaaaagtgaagctaagaggagtggtgagggtttattggcacccagggaggagtcagagggtaaaccggaaggtggaggtaaggagaggagggagggagattgaaaggaggagttgatggttatgtttaagagccgacagtggaggtgtgtgcctttaatcccggctcccaggacgcagagcaggtgatatctgagtttgaggtcacactggcctgcacagacagaccctgacctgaaaaagcaagagggggcagcatagacaggactacatgttagtctaggtgccctattgtatgttgtgcttggctctattaaagatttattttgtttgtttgtttattttaagacagagtttctctggctgtcctggaacttattatgtagaccaggctggcctcaaactcagatatctgcctgcctctgcctcctgagtgctgggatcaaaggcatgtgccatcaccgcctggcttaaaagatttatttaaaattttttccatgtttgtatgtctctgtgcatgtgtgagttttgtgtatgaggtaaagtaacttgactcagtggagtagacttttccggcttgttgagtactatttgtatgagatttgaggtttcaaaattgtaatccagacatgctggaactcatctgtaatcccagcacttgaggtaccgaggcaggagtggatccagcacttgaagtaccgaggcaggagtggatcgctacaaagttgaggttatttgtgaggggctgggtaaagaaactgcctctgtgaaggctccaaccggtaaggtttttatttattgtgagcaagcttccagaggaaactcagagaatggagcagagagaaaaggaagcagactggatgtggccagggaggcagaagagcaggagagagaatcgctgcgggggtgggggtgggggtgggggtggggattgtgtgtgtgtgtgtgtgtgtgtgtgtgtgtgtgtgtgtgtgtgtgtgtgtgtgaatagtggagacagcaaatgatagcgatagcagagagcacagaacagcaggagggagaccaggagagcgctggagcctagagcccagcaaggggcgagcaggccaggagagcttgagagagggtggcgggagagagcaggttataaggagggaagagccaggagcccagcatggactttgaagtgcacggcagtctgtgagtagggactgcagagtcctggatgcctcccacggctttgatatgcaaccacaagtagcctcgagtcagtcccctctgccagacgtcaggggaaggactcctttggcagcttcacaagttcccaggagtgctggctgctctctgaccaccagaaatcctcctgtagttcagctccagctcattcttgacttaacagaagtcatctgggccacatagttagctcaaggctatcctgtggtgcctagagaagccctacccggctgtcctggaactccctgtgtaggcccggagggtctggagctcctggggacctgccagcctatgcctcctgagtgctgagtgtgcttgcacaccccactagagtatcttttagagaagtataaaaggtaaggatatgtgagaacttagcttttatctaaaattttaatatagaaacatttaagccccctccccaatcgtccaagaaagggcctagtaaataacctaggcaggatttgagaggatggggctggttatagccccgacaggagaagagtgtgtggaccgagggagtgtgcagaactgggtccttgagtatttttgtgccgtgacactcgtgaacttttcttctgttctctagggtgaattgatggcaagtgcacagtataaagccatctgatgctaaatttgcttctaaaatacagttatagttgggaccgtcacatgtatgtacctgtcgtcccagctatttggaggaagattgcttaagttcaggtgtttgagaccagcctgggcaatgaacaaagtgagcctgttgtctgtcgaagtctttagacagacacaccagaagagggcgtcagatcccattacagatagttgtgagccaccatgtggttgctgggaattgaactcaggacttctggaagaacagtcagtgtgtttaactgctgagccatctctccaggccccggatatttccactattcaagggtgtgcgcctccctccagcaaccctcttcctctgattacgccctacttcccaagtctcacctttcctctgtagtctattcaaagtttgaatctacctgtgggttaagccattttctgtgccagagccctgatgatcaaactgtttctggaaacaccctcacagatgcagctagggatgagacttactaacagtcttttacatgtcccccaatccagtcaagttgacaatcaagattgagtgcaggcacagcagacatcctggaaattgtctcagctgtctggaagattcctcttgttttcctcttgtgttgggttgtctcaggcttgtaccttaaactctttgttaagtttatgtgtctgcttttttaatggctcaaggctgggagtttgaccctgggacaaaagcttcctgtctgaaacatattttatactttgatcgacgactcgggtgctttttccagcttctgtggatgctctgttttttgttgttgttgttttttaagatttatttacttattttatgcatatgagtacactgtagctgtctttagacacaccagaagagggcatcagatcccattatagatggttgtgagccatcctgtggttgctgggaattgaacttaggccctctggaagagcagtcagtgctcttaaccactgagccatctgtccagcctgctctgtggcctcaccactgcgaagtatgctgcgtctccactcttgacttgctgttagactgtgatttcttgcatctgctaacccatctgatacacacctttccttcttcccggggtttgttgttcttggctcttttttgtttgttgcagcatctttgttccttagtgtaagacttaaaacgaagtctcttaccttttttagcgagctttcacaagaaagtcaagtatgcatgctttgaatttagctcttaactcacgagccttgattacttcatttgtctcttaagactgtaaaagactatcccagccagcctctccatttctttgtcttatacatccatgtatatatgaaacacatgaaggacactgtgtggactgaatgaccttgtgtgaagccgagtcacagctaaatccagagttgtccaacaaaaccttgattgttctttccctttgcttttgtagggaggtgacacgggccctgactgcccggcagtgattgtggagccagttcccagtgcgaggttagagcagggctatgctgcccaggtgctggtctatgacgacgagacttatatgatgcaggatgtggcggaagaacaggaagttgagacggagaattcagaaacaggtaagacactgcagagagtccttgttacctataactcctatcttttaaccagccatctattttatgtgaaaaggtgttttgcctgcatgtatgtctgcatgggtgctgggaacccaacccaggtcctctggaagagcagccagcgctcttaactgctgagccatctctccagccccataagttgttttgtaagcttcagtattactatttattgttgggggaagcttatactgaagaacctattataaaatgccagttagcataggatggacattggtgtaaaaatctttgtttaaagcgagtttatataagtataggagagtcctatgttataattcttcactatacaacagccttaaaagttgttggtttttgtttttgtttaactacagatattcactagttatttacttataaaatcagtaggttagtatacaagagtgatatttcctaataaaaaaaatgagggtagtattctctttctaactggtttagcccttctttgaatcagcattgctggagcagtaccgttttgttttgttttgttttgttttgttttgttttgttttgttttgtttgaagcatctttgcctgtcagattcctcttccttttctgtcttcttagacatcctggtgttcccattagtatgtatttcatcagctatatgtgcatttgggaattagtgtgtgtaattcttaaggaaatctttttggttttgctatgaccatgaaaaatttccctaaatcattttagtgacttaaatagtagcaaacaacaataacaacaacaaatcatagtctggtaatgttttggaaaaattcttattggtttgcagtcctagtgaaattccttccttccttcttgtgtgtatgtgtatgtgtgtgtgtgtgcatgtgtatgtgtagttcagaagacagcttgtgggaattaattcttctttccttctattatgtgagtcccacagaaggaacttagttgtccattagtgcttttacacattgagacttctaacaggcttgaatatttagatgtatttctacaagtgtagcaaactttcccaattaccttttgagtgtctgatatcttttggttctggggccccagtggttccctcttaactactgctagctgtcagttccactcttttattgagcttagagattaggagctcttgttcttccaagcaaggatgatgtgtcagcaaggctccggggaagtgcagactggttcatctgatgacagggacccaggcacttcctaaagactcagtggtgggcgtggaggggtgccttgttctaggggcttctttttgagggttttccaggctgaaggaaggtccagggatgccttttcttccttaaaaattaagtcattattattagtgtattatcaattttatgtgtaggctgttttgcctgcagaatctagaagtgggcatctctgaaactgatggatgcccacattacagatggttgtgagctgttatgtgagtgctgggacttgaacctgggtcttctggaggaacaggcagcaccttaagtcacctctctaggcccgaggtttcctcgaatgattgatttttgcatcaagttgcaaacttttaaaaatgaaacgaccatataggattcgcacaagtagacacatcagggtgccagagcaggttgacacatgttactgtgtaattgataataaattcttcattcatttcaattcaagtaattttgcatgagaaatgagtgtaacccagttaaggagtcctgagggtgctgattcatcccattcgcaggacagatgtgaatgaatggctgtggtgttgaagaggaggcttggagctgggctggccgtggtgcacatgtgtaacctgactacccccgaggctgacactctaggggccgtggatctgaaggccagcccgggctcaggataccaggcacggagaaaaaccagttgctcttgcaattattttccacaagttgtgttttaaaattgaacaccatcttattttgaaggtcactccggcccccttggcaggccttgaacttggtacaggcgtgttgcttttgtctcctgagagcaggggtgatagccatgctctactgtatcctgcttgctctcagtactgccctttagtactgtttttttaaacagtagaaggaaatgttaggcagatcacttatattactctaatatggtaaaggttcctcagaacttcagtttgcatgttcatttgctttaatttttatatttttatttatatgagtacactcactgtagcttcagacacacaagaagaggacagcggatctcatgacagatggttgtgagccaccatgtggttgctgggaattgaactcaggacctctggaagagtagtcagtgctcttaaccactgagccatctctccaggcctcatttgctttcttgatcatgagttttaatgactttacaaggattattagtggccataggttattttttgttttatgcacacaacatgctcccacaaatagtttttgttgttgttttgtttgtttgtttgtttgtttttgtttttcaagacagggtttctctgtgtagccctggctgtcctggaactcactctgtagaccaggatggcctcgaactcagaaatccacctgcttctgcctcccaagtgctgggattaaaggtgtgcgccaccactgcctggcttagtatttttatattagaaaatctgagcttgagtttgttggtttttaaaagacccacacactaagtggattatacttcttacagagcatagacagatgggtaagggtggccaaggcttagctgagtctgtttcagtttgctggtgggctgggatgggagggtcatttttcatagtattaaaagcttgtaacagaaactctaaacatgtagatgttttaaaagaaactgactgagaagaaatgggaaggtctcggtttttatttggtgaattgggggaattaagactatagaataagggctgctgagttggctcagtgggtattggggcttgtcttacaagcctggcagtctgtttgatcctcagggtctgtgatgagctggaaggaaagaactggctccacacagctgttctctgacatccagatgtgcaccatggcacaggagctatgcacacacatcatgaacacagacaagtaaaaaaaatgtatagaataggatttccttgtaaacgttttctagacttcttttaaactataattcattccctgtctctctgtctctctgtctctctgtctctctgtctctctgtctctgtctctctctctctctctctctctctctctctctgtgtgtgtgtgtgtgtgtgtgtgtgtgtgtgtgtgtgtgtgtgtgtgtgttttgagacagaatctcttagtgtagccctggctgtcttagaagactacctggcctccaggttacagagatcctactgcctctgcctcctgggtctcgggattaaagtcgtgcgccgctgctacacctggcttatgattcatattttattagcctaaaatcatagttaatttaacttgttctttcatctctggtggtcacattgaagtttttcttcttttgttcctctatacccttacatgtctgacagagacactatcctcactgttaagtaggttggagtgggtgggttcatggcccttcattactttgtatgtaagaggactgactccccttttgatcgtaattttggtttactttgcttatctttcttttaaaattttccattttttctctctgggcttagtgatgatactaatatcctcttaaaggttgtagaaaaaactgagaactgtaaaacttttaaaagtggtatattcatctaattttatcacaagcagctgtgaggcactgaagattagtaatgataaagagtctttaggagcagcagtaagctgtggagggtgggtgggcttgtctctgggggcttgaaataactcccagagccacacacttccgcagcacagcctgctgacatgtgggcgtgatgagagggaggcgctgattggatcctctacagagatttttaatgcttatttaaaaatatagagatatgaagtaagttttattgaatgtcaagagttagaaattaagcagataaaggcgccacaagactcgcaggctcttaggaggaagcacaaccatggacctcacatctctgatataggatgaattctgaatataggctgaggtgtagcctagtggtaaagtgcttatctactatgtgtaaggtcttaggttcaatctcaagtaccatacgaaaataaacaaatgccatttgataaaaattgtagtggaagaggcgcgaaggctggctgttgtgacttgaagggtgacttgagaaactgaagtagtggccataggaagagtgggctccatacacagcatcccagtcaaatgtaccctgatcccggacaagggaggggctacgcagcacagttagagatggtgacatcctggagagatgaaggaaagatggttttaagaagcagatgatctaaataaataaataaatgaaaatgaaaaaagaagcagatgatcttaatggtcaggtttgattttgagttgagataaggtatctaagaagaagtatgtaggtatttacagatggatacaggagtaaccaggattttgtcacaaagaaaatggctaacttatggggagccttagtaaaagaaagcatagcatggaagaggagggtagtgctcagctctctacaacagagctgtttctattcttggctcccgggctcaggggagggcccacctatacaactcaaacaggaagccactgccctggaaaaagaatcgccttggcaaaagctgggaccttggtcaaggatgcacctggttggatgtcagtgccacagtgaggggggcaggttaagtctcctagtcttactctccccttttctagtccctgcccagtctctccactgaacaagcccagttagaagctgtgtgagcccctttagtgcagctgctctccgggggtggaaagagccaggatggatggaagatgcctagtgtaactgcagcccagtgaccaaagggtagagacaggtttgggagttatccttactgaagccatggaaccagttagttaggccgagggaggaggtgtggcagaatcctcccatgggcctggatgagaaaaggacatacaattaaacaattacttttagaaatgtttgtaatttgaaaagcatgaagcattctaaaagcgaatatgagagagcgtcctgggtgacagagtttaagtatctttctctggcaggaaggagttccgcctttgcttacctacttctgccttcagttttcctccacatcactcagttggcaatgcttaaacctttcagtgtttcactgttataaaataggaatttaagactgtaaggacgaaggaagtagttacaggacagttcttgaacaagtcttccattggcttcattagcaggctttcatatgtctgcaagtgtattcagccagaacacttaacttcgcatacatctgttgtatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagccgactacagctcactttgcttgtcagccactgtactgctctttgtttgctagatttcaaaggccagtcttctgccaagctcagtggccctcgggtcatccagaagtgcatcctttgtggaaactacactcccggctctcttccttcctgcctttcacaaggacttttccaaacacactgagcttcctcttccattttatcacctgtagtctgcttagcactctctgttgtagccccgtgtacccgagactttgtacagttgttattgtcaacattaatcactcttctgaccgcccatcatgctatctggatagttactttcttatgtggttcttgcatatgtccttttccttcatagtaaggatgaaagtaaccttgaaattgtgtgtggtggatttttgtgtgtgtttgtgtgtctgtgtgtgtggtggattttgtgtgtgtgtgtctgtgtgtgtggtggattttgcgtgtgttgttttgaacatatgaaaggtagtcaggaaatacaaagcactaagttttttatcttagtgaagaaccattttatggccacgtgtggtgaaagttacctgcagtctcaagactggggaagctgaggcaagaggatggtgactgagtccagcctggactacatggaaccagacccagtttcagacaagtaaatgaagtaaagaaagaaaaagggagaataatatatatttatatataaaagtttatataaagtcttcagtatttctttgttgaatgacctaatgttactcagaattttgaaagtcatccaaaaatacctgaatgtggtcatatatatataccattgatttttaataattgattatatctaagttttttttttaacagtaagagcaatggaaaaattaggaagctttacaaagaataaacaaactgaaagtcatcaccatcagtgagaaagattgctactttttttttttttttttttttttggtttttcgagacagggtttctctgtgtagctctggctgtcctggaactcactttgtagaccaggctggcctcgaactcagaaatccgcctgcctctgcctcccaagtgctgggattaaaggtgtgcgccaccacgcccggccagattgctacttttaaagatctaaataatataattttagtattggcatagattaatcttttaaaatttatattattatttgacatgtcttatgctgcccaggttggctccaaaccacgggctccagcagtcagtccttctgcctcagcttcccacgtagctggagcaattccctgtgctgccatgctcagcggagcgctgctgtgtgaagttgttgtgttatcttcttctagttgttcttggaatgcatcactagtagatctttctggtctttttaaggctcttgcatctctcctttgagtagccgtggcgacactttgctttgtattcagccaccaaggcataaaaaaattatcgtcgtacttagttaccaagaagctttaaaaaaaaaaaatctgtttttatgggctggcatgatggctcagtgggtaaaggtgcttgccaccacaagcctaacgaccctacacggtgtagtgaaagaatagacccttgaagattaacaacctctgacttccataacttgtcctgacacacacattcctacatacacactcacgaatgtacaacaaatatataaatactgttttagtgggcaacaaaaatttgtatttaaagattagctgaaatttagaagaataaaattttttgtgtaatttaataagaaaacaatggttactttttaataaatgaaagtaaaggtttataagcacagtttgaaaaaataaagtcagatttctttactgaaatatcagaagccggatttctgtcttgaagacttaggcctagtctgactttatgatgagctgtgataacttccatatttgttataccatcagaaatcctccctgtggcacaaaaggactcttttaattagaaaatattgttgccacagggaggtagaagatcgacttgagaaactggggacctggcaaggagccccagtcctaggatcccctgaaggtgagacagattgagccagaaggaagacaatgctggtaggtcggcttttaatttattaagaatgttacggtgttattgttatagttatttcatctactttatcatatttgtgtttaaagaatgacaaaaatttctccctaagaagaaatgataaagtagtgttttttcacctaagcggttttcttcccatgttgtcccctcaccttgccttgtaactaccgctgtgggaaagttccagcatggtctgagaaaggcctcttctctcccttctgttgtttccatgttcttccaatacagatgttttccaagtcctttaaaatgttttctttcaattgtctgttttcttggggttggtaaaacataaatcttaaagttaattgagttttctttctggaattaactgaattataattttactgtgactaaagttgtctagaaggcattattggagaagagctttagtattttaatatctatgtttcatttagtctgagaggccgtcaggagttaaaaaccattacttttttaccagtagaggaagaaggtgcttccaatttacacacagtgagaaaccactatttataaggcacatcccaattcagagatgtcaaagtgtgaaaaactgcatcatagaattattgaaatgtgatattttataattttgaatcttctccaaatatgcaatttccatttacttggaattagacattaaaatatctagtctgtgataaatggggatgggccgcagtgtggagggctgcagtgtggagggttgcagtgtggagggctgcagtgtggagggttgcagtgtggagggctgcagtgtggagggttgcagtgtggagggctgcagtgtggagggctgcagtgtggaaggttgcagtgtggagggctgcagtgtggagggttgcagtgtggagggctgcagtgtggagggttgcagtgtggagggctgcagtgtggagggttgcagtgtggagggttgcagtgtggagggctgcagtgtggagggttgcagtgtggagggctgcagtgtggagggttgcagtgtggagggctgcagtgtggagggttgcagtgtggagggttgcagtgtggagggctgcagtgaagagggctgcagtgatgtggagagatgcagtgtagagggctatagaggagagggctgcagtggagtgtccttacgtgagctcacttagctttcagacttcatcactgcctctcaagacaagattctaaaactccaagcatttgctgagtgtgatgcttccactcccagcatttgtgaggttgaggcaggaggacccttagttaaaggttaccaaaaactgtgtagctagagtctgccttaaaaacaagacagatgggctagagatgctctgtggttaggacggctgctgaccttgcaaagacctgaatttggtacccagctcccacatccagatgcttacaactgcctgtaactccagctccagataacccaaagcctttgtctagactttgagtacccaagtacaagtgtgtgtacacatataggcacacacaaagcaaaaaatggcctaaagcaagtagttgttctgccaattggtaagcagaaataaaaaacgaaccatttaagatactatttatataaacatcagtgtttcagtcgttgggggtttgtttgtatgttttgctttttgttttgttgttgttgtttgtttgtttcttgagtcagggtttccctgtgtagccttggctgtcctgcaactcaaagcaggttggcctcaaactcagaaatccatctatctctgcctcctgtatgctgggagcaaaggtgtgcgccatcactgcctttcaaacatgtgttttataagagaagatgaaaaatacattaaaaggtcactaggaaggattgttttgttttgttttgtttttttcgagacagggtttttctgtatatccctgactgtcctgtaactcactttgtagaccaggctggcctcgaactcagaaatcctcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagcactcgggaggcagaggcaagcagagctctgtgagtttgagaccaacctggactacagagcaagttctaggacagccagggctacatagagaaaccttgtcttgaaaccaaaaaaagaaagaaaaagtaaaaagaaaaaaggcagacagttgaaggagacaggctagtttgtagagaatctgtctccaaaacaacaggggagatgaggaccaacatccgaagttgtcttctgactccacacacactgtgtggtatacatacacacaagtgaatgtgcatgcatacatacatacatgcatgcatgcatacatacatacatacatcatacacagataaaaatgaagtgttcatgaagacaaaactcttaaaaatacttaaaattttgctagataacagtatatctataacaaatgttactaatttggctgagtccttaatataatggtctatactctaaagtctattgcctaatttttggagtttgcaacacgatgctattgacaaatgcactgtgggcaggaataataatgaaacatgtctggctctgtgacaagagaagataaaatctgctttttcatgaccatccctaatacaagccaattttattaactgtagtccctaatgttgttaatgctttggccctgcctcttccctttcatcttctatctgaccaactcagagctttccaggcatggctgaggagggaaggtttcagggtcctgggttatagctaagaatgttttaccaaacatacttggaggcagggccaggcatccatttagtgatctgcctgcactcactgagggcctgctgggtgccaggtcagagctgacttttcatgtggctaacaagagcctttgctctcagtaggccttcagctttgtagagaagattaaacaagtttatgccgtatatggtaatagaggacatgggactcccacagagaatgcctctctgagaaagctatttgtgaagggtttggagtaaccagccaggtagagatggaaaggtctggagggacaggcttctctgagttgccagaggaggtccagtgtggggaggcaggggaggggaggagaacgctttggaagcggtgtgtccaggtccttagctttattaaagggaagtaatgaagtgtctgtaagttttaagccaattgaaacaatacatgcagatttagttgtttccaaaatgttgcgtactataaacaaaacaccttccaccttccactttgagttgaggtaaaagttgtagcaattaagatgcatagttggggggctggtgagatggctcagtgggtaagagcacccgactgctcttccgaaggtccagagttcaaatcccagcaaccacatggtggctcacaaccatctgtaacaagatctgactccctcttctggagtgtctgaagacagctacagtgtacttacatataaataaataaatctttaaaaaaaaaaaaaaagaaatatgttgtttaaaaaaaaaaaaaaaaaaaagatgcatagttggataggtgtcctttccttcggaggaaggaactgggcacctagtgtggtgctcatgcagaagaggaggagtcagtgctctcgctgtcctccacgtgcacggttgagtgtggttcttactgtgacgtatgtatgagacacagcgtatgtgacctgtatgtatgagacacagcatctggcctgatggagcgccactctctttgctgaattggaggggttatgtaggaacattattttagtcttttgggctaggaagcccaagttaatgtttttcttttggttttgatatctataaataaaagttgtcttgaaacacttttcctacttttcaacactttatactatacacgtaggcgttactggcacggagagacagtgtttggggcctcatgtcatactgagtgctgggattaaaggtgtgtgccaccactgcctggcatatgatggaataaaaaaaaaagcaacatacaaaatttaaaacatagacaaaaatatcaacacatgcccactgagttattatgggtgttgtaaaccttggcaggattgtacatctcctgtactctcctgattactcttgcatcgtggttcccatagtaaccatgggggtggggtcactgctgctctagtgtgaaatcctacatggtcatttagttgccaaaaagaagtgagcttttagttcttactaaattacttgtagtttcttacaaggatggggaataaaaaacgtgatttagtacaataaccatacactcatcagcctgaagtaactgataagatgtatgctaagcaatgtgcatgcatattaagaagagtgcttgctaaaaaatacaggaaactggatgagacacctaccattgttcactcaggtcattttttaatagggatatctatctatctatctatctatctatctatctatctatctatctatctatcatatatatgataaaataatcacttgaagcaggggagtaccgaaatgaacagggacttgtgacatcctatttaaaatgataacttcatacaatagtgttgtgaactagcatgcctgcatgtgtattctttctcccaactaggatgctcttctgtgaaaatgaagggccatttatcccagtattcacacttaactgcatgttagctttctttgctggcgtatgcagatgttcctggcatctgccttacatatgtctgtctttgctcataacagatgctggaccacacttgctgtgtgaggccccctttggggttaagattaggacttaagtatattctaagttgatggtttaaagcttcattttattttgacacctgcagaattagttttattactggcttggggtagcttttccttccattattaaagtggcatttctctgactgtaagtttttctaacttttgaagtggtgggtgtgtacagtgctcactagaaaggataacagcactggcagcagaggtagctcagcggttgtgtgtttgcctgcacatgaaaggcttgtttgggatgctccctgctgtgaatgagaatggccccaggaggctcagatattctaatacttggtacccaggtggtggaacttctctgggaggattagaaggtgtggctttgttggagaaggttcgtcactaggggtgctttgaggtttcaaatgactcatgtcattctgagtctctctgccacatgattctgtctcaagatgtgagacagaatcagctgtcctagggccatgtctgccaccatgcttcccacagtgatggtcatggactctttcttaccctctgaaactatgcaatcttgtcttggtcgcagcgtctcatttattgaagcagctgtgaatactgtgaatactggcatgaagcacgcctgcctgcgtggccctctgtgtctgctgaaatgttcagaagagtgagtatgaatattccatcgaactcactctgagtcttctgggaccttccttagcaagcagttgtccgtgccatgggctctcactgtctgtgcgtgacagtctgctctttaagaaagccaagcttgttttcagggcagcgtccatgccatcctctctgagtttgcggcacctcctctctctcaccctgtcctggagttgggggcatgcttattagttagtctgtggttttgtgtgtgcgtgtgtgtgtgtgtatgcatgcatgtatgcatggatgtatgtaattttgagtcaggaccttggctacctgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaatgcagcatagagtaaaaatacgcatgtaatattgctcagaaagtcacaggtgagctggatgtggtgggacacaccgttagccccagcactcaggaggcagagggttcgaggtcagcctggtctacagagcgagttccgggatagccagagctacagagaaaccctgtttcaaaaaaacaaaaactataacaataaaagacatgttgaacttcatttaaaagccagtgaagtgttgttcttaattctcatccatgtatttgtttacttttttatatttacttgtgggtgtgctaatgcccccaccttggtgcatgtgtagaggttagagggctctctttccatctggaaatccgggagatcaaactccagttgtcaggctttgtcttaagtgcctctatctactcagccacaggctggctttgttattttaactgcccctaaacatttcatcaggctctcttcctctacatcagaagttctcaacctgtggggtttaaccctttcactgagagcagagtaaaacaggtatttatattatgattcatagcagcagcgcacttacagttatgaagttgcaacaaatacaactttatggtcggggtcaccacaacacgaggactgtagtaaaggttgaagcattaggaaggtgctctgcattctactgtggatctattcttttttctcactaataactaatatgtccggtaggtgctaaagaggtggctcagcaatattgattggctatacccttccaaaggatcagtgttggattcccagcacccacatggtggctcacagccatctgtaacttcagtgtcaggagatccaatgtggtcttctgacccccaaacatgcaggcagaatacttatacatacaagataaccattaaaatatgtcataggcataaaaaacattaaaatgtggtatgtactaagttcaactgtgccatatattaattacacattaaatgcaaccttatgatgcctgatccaggtgtgttctctctctctctctctctctctctctctctctctctctctctctctctctctctcatacacacacacacacacacacacacacacacacactcacacacactccatgcggtttgtcaaagaggacaacctgtaggtgtcagttcttccattcaccatgtgggttccaggtcttggtggtccgcacctttagccctgcctaagccatccttctgccctcttctttcctttaaaagcccttcattactgttgtgtttctgtatgtgagcacgcgtgtgccatgaagcaagtgtagaggtcagaggacaactttcaggagtcagttctctcctgctgcgggttctgggagtcagactcagagagccacacttgtatggcaagtggttgtaacccttcaaccgtctttccagtccccccctaccttggcattgcactgagggtctcacacatctaagcaagtgttctacactacagctacaacactaaagcccccagctctgctttaagtggtgggaaaaaaaaacaaaacccaaaacaacctctcatgtattgtgctattttttcatgtcatttagtttcattgaatcttatattgtttttttcccccatctgtatgacaaaacatcttttttgaaaaccattgcttttcaaatctgagcacatattagaattatttgaagggcttgtaaaaatacagactgctaggatagaattttttgtttttcaagatgaggtcttgttatatttgttacttaggctggctacatttgtgaggtcaaatggtcctcctgcctcagccttcctggtacattgggccacagctggtcaccatcatacctggtgcgcacgtttctggtttaatgggtctgtgtcttggcttgacattttcagtctaataagtctaagtgataccaatgttgttggtcacaggagatgttttcataatctcctttgactgcgggaacgcagtaatcattgtagttccttattctgatacaactactatagtaatggggtatgtgtaaaagatattacaattcttttgtgtcctggaaagaatacaatgcattactaaccttaattcttgaataagagctgttgtgatagcttggggactaaaggtgcttgaccccgcacttgcagatgtgagtttgatccttagagctcacatgacagaaggaaagaactgtccctgaacgttgtctttttacccccacacttggactgtggcatgggcgcctttccaatatgcaataaatacatggaaaggaagtgataaagccaggtactacttaacgcgtgggctgcagtgacagacaggatgagcagtttctgcctttggggacttgatgtagagaacgtgtaagctcatcatacttcgaagctttttgtcacaaatcagattatgtaacaacggacagtcttccttacataatatttagaaacagactgaagtaggctggtgggtcgttgttctcaagcagtggagaccaaatgccttgtcctgtccccttacagttgagatgcttaatcttagtgtaggccacattaaactttgtcattaaagccaggcatggtgcgcaggcctttaatgggagcatttgggagacaggtaaatctccatgagactgaggctagcctggtctacagattgagttccaggacagccagggctacataaagagacaggagaacaaaggtttaaaaaaaagaaagagaaaaatgaatacattttactgttgaggacatggatgacaggtaatttctttaggggcagagaagctagtaagtcaacgtcggataagctaacgtcctaaatgccatctgtgtgtgtctgtgtgtgagtgtgtgtgtgtgtgcgcgtgcgtgcgcgtgtgtgtgactgtaaaggtgttcctacctttctcttacctttctccatcctttctctctttcccctttctccctttagatcattaaagggagttttaattgcacataggatgaagttcagttgacgattattaccgttctgtgcagtgctggctgggagttaaactcaggccccatcaatgcagttcaagcattctacagctaagccgacctggggtttttgttgttgttgatgttgctttttgtcaggttccttcttgccttggcttctgacttccaagtgtgggataatgtgtcactattgcctggaattactttaggaactgaagacactgaaatttgcctcctttcatatatttaaaagtaataagggcaaacaaaactgaaaagcaacaacaaaaataataacaaaaaccccaacaaaatatatacaaagtttcattattatattgctaggaatagttctgaggattttatatactagcataatttactctcaacaacaccatgctgaataacgtctgagtgtagaagcaggtatttcaactcagagttagcaggctccagagcccaccttcaagcatctgtgaagagttgtagtatcacactccctctcgacacacaaacacacatactgacttttaactgcttctattaagttctgttgggtgttgggctgcagagattgcccagtgattaagatccttgacggttcctccagcagacccaggtttgagtcagcccttggatagtggctcaaacatcttaactccagttccaaggcatccactgccgcctttgacctccacacccactacttgaaaggtggtgcacagaaacaagcaggctaaacacatctcacacacaagaaataatttatgtatacacacacacacacacacacacacaaatcaaaaaagcaagtctttaaaaggttctactaggtcatgatatactctagttttttaagtattgattttatgtgtatgagtgtaagtcacatgctgaaggttactttggacgtcagaagagggcattggcattggctctctgggagctggaggtgcacacagatggctgtgagccacctgatgtgtgtgctgggaaccaaagtggggaccttcggaggagcagggattgcccttaatggctgagccatttcttagccccaacataatctgctcctagaacagactgccttccatctttcatttcctcctttgacatttttccttaccggttagcatcgacagctttgagataaactaggtagtaaatacttccccaaaattcaaaccacgagaaatggtttggactttttgggaatgtgaagatagtgtaaattggatggttttgtgcagaggagaaagaaaaatgtggagactgtgagtgagattttgggagtgagaaaggttgcgtgcattggctctacaagtcgctggctgtaagttagccaaattgattcagtctggctgtggtttggtgccatctggtggtgcgtttgtgcttttataggcctttgttgtctggagtagcagatgggaaacaattacagctttttgtttttctttttgttctttctgagctagggcctcaggtagctcaggctagcctcagactctcaatgtagtagaggattatttaaacttctcaccctgcctccccttcagttctcaagtgtggattacaggcacgagccactctgctcagctcttaatttaagagcattggctctaagactccctctccgtcagtaatgacatccatgggggaacctgtaatcccagtacttgggaggctgaggcagaaggattgtgagttcaagaccagcccaggttacagagtgagatcttgttttaacaaataaacctcactgccgctctagttccttatgaaacagcagtgttctgagtagctttctccactctgagtacctgcatcatgtcattctaacagctagtaaacagttgttctaaggaagagggctgtcatggtcagtaccaatgctatcccctcaacaagtttcagtttataggtggtgaactcaaggactggaagtcactggattcatagggaacagctgactcagagaacttttacccagctatattatgtttgcatatatttgattgaactttcatgatttgctccataaagttacagtaggctattttttgttcgtttgtttgtttgcttattgagaagacatcaagaaccaggagagagcactgagaattttgtggtttatgtagagactgacaagctgtgcagttgaagtttgcattctttagccgctgcaataggtggggctagaaggctggaagggattgtgtcaaacagtgtgagtaagacaagttgtagcttcaaggtcgcatgtgcctgtggtccttaccatccggaggttgaggcgagatgctcacgagtttgggccagtgtgggctatgggacacgatcaaatcaaaaccaaacaaacccaagaaaatggcttgcaaaatactaaactgggggtgagattagggaataagttaatttttatccaacaaatgtggaaaatgataggtgtcaaaattataagcaaggataatagatgtcccaaaactgtcaaattatatcggtcattaactgtgaccttaaacacatctgttctttataatagactcagcaaattaggtcaaacatagaaacaggtagaaacctaatagatttaaaaaaaataaaatttataaaacagataaatatttcaaaaaaataataactgaggggaatgacagtaataaaaagagtttagggtgaatatcttggattgagacaagggggctcttaacacctgggtgaggagttctgaaattaaattatgggtatttaacaacatagctgtgaggcagcaatgaaaaaccaaggtgttaaacagttgctatggttaaataatagtattggggaggctacagagatggtcgaatggttagcagcactttcccagagggcctgagctcagttgccagcatggttccatatcaggtggctcatggttgcctgtaacccctgctctaggggatctgacgcccttgacagaaatctacatgcatacagcgtatactcacacacacaggtgaattaaaaaaaaaagaatctggcctgtggtggcagcacatgcctttatcccagcacttggcgaggcagaggcagaggcagatgtatctctgagttcaaggtcagccgggtctacagaacaagttccaggacagccaggctacacagagaaacccttcttaaaaacaaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagccctcgcaccactcctggcagcctgggataatgtccaggactgtgaacttccaaaccaacctgctagaaaagtgtgttcaccgtctctgcttggatctgaggctggtaatgcaggaggaaacccgtgcatggtaactttaaacctcatcagaaacacatggctggggagttacaggccctagtagcagacttagtactgctgtttcaactgatattggctcaaagtgccttatgagcatctaggctcacggccacggaacaaatgctcacttactcttttgttgttgttgttttgttttgttttgggtttttgtttttgtttttgtttttttgagacagggtttctctgtatagccctggctgtcctggaactcactttgtagaccaggctggccacgaactcagaaatccgcctgcctctgcctcccgagtgctgggattaaagatgtgcaccaccacgcccggcgctcacttactcttaatgacagaagctcctctctgctgtgaacttagagcccacagctgccctaggtgctgagaataaaggatggatgagtgttcagccctaaacaggacatttccatcaccacctccaaggctcagaaaacacctcggaatgagaagtgggaagaacgcaagagctggaaaataaggagaagggctgtgtgcaaattgccaccgtgggcctgacacagcggctctgtcttgaactcaagaagatcagttacctgcccgaggaactctacaggactagacctgtcaccaggcagctgtggatgggggatggctctctacccttccctgctgcactgctggatgctgaaacgttctaggaggggcgagtctttgcttttagttgtgaccctatcggtgagcccaccgtcttccaatggaaagttccaaccccaggatcacacagatggccctggataaattcagtggttcacaaaataaaacatcattaatgtgggaaaggcatttctaaggaggaggcggcttaataggagtgggaaggacgtgtaattagaatgcagtgtatatatgtatgaagtattgacagataagagaatacctgctgggaatgtttaaagtgtaatcagggctgtgagatgtcagtgggtaaaagcacatgctgtcaagtctgacatcctgtgttcattccctgaaaccctcagactcgaggagggggctgagtccccccagttgttctctgacctccacacatgtgtggtggcatgtgcctgtctctccccgcaataaaacattcaaggtgtaatcgaaagaaacataaaaatttagtgacactcttccatgatcatagcttcatttattccaagtaaagactggcaggtgaagtccatctaaaaatacatgaattcacagtaacgttccagggccattatgatgttagaagaattgttagtgatgaaatcactgtgcttagactgaaggacaaataccacgcaacagtttcaatggatccaacacacatttgttaaaatgtatcatctactgatgatacagacttgaaacctcataaggggtagtactaaaaatgtagagaaaattgagtatgatggcccatactcaatacagtaaataccatttacttaaagtaaatatcatttgtcaggcaatatctttacatgccattgttactggaggtcctagctaatgcaataatgcaaagggagtttattttgctgtgatacaacaccttgaccgggaccaaaagcaacttgtgtaggaaagggcttatgtcctctacagtacaggtaatgtccatcactgagggaaggcaggacaaggactcaggcagggcagggactgaagcagagcgagtgctgcttgcttcctattgcttagcttgtttccttacaatcccaggaccacccacccatcgctggcactgcctgcaacgatctgggccctcccacaccaatcaccacaagaaactgtcttacaggacagtctggtgggggcattttctcagttggtctctcttcctgacctatgttaacttgatgttaaaactagccagcacaggagggacagtcttgaatgatgagaatagacagggttgagagtatgtctcagctgtaaaccacttcccttgtatgcacaaagctcctagttcaattgctagtaccatgtagatacaaatgtatctttatatgaaacaaatgtcattctttgaaaatgggttagtatttgaaatctgaaagactatcatttatacttttttaaaaaaattttttctcatacattaaatcccaactgcagttttacctccctccacaactcctggtcccaccgccctcccgtccagatccacttctctatttctcctgctattttcaaaaaaagagcaggcttctcagccatcctccttaaaaacagatagagcaggcctcccagggatatcaactgaacatggcataacacattatagtaaggctaggcacgcacccctcctgtcacggctggaccaggcaacccagcaggaggagaaggattccaagagcaggctagagccacaccccccactcccataagaacaccaagctacacaaccacaacatattcaggtcctctgagtaagtcatggttgtgatctgtctcagaccagtacagggtccatgattgttgcctcagtctgtgagcccatgtgagccctgcatagttgattctgctgctggctgtgttcttgtgttatcaatgcctctggctcctgtagtccttcccctccctcttctgcagggtcctcttggcttcgcctagtgtttggctgtggctctctgcatctgtgtccatcagttgctgggtgacatttctgacagttgagctaggaactgagttcctcatatctaccattaaagttgctatggaggttcatcacacagaaaagaaaaagtataagggttgctgtatatagcagcagtaatcattaagaaaatgaaatataatctcacagtaaaatccaagccaaatagaacaatctccattaagtacctaggaataaatctgacagcatagcatgcggcctgtttactacagtaatgtctcacgcgttgtaaatctaagtagatcagagttatttgttcttttaatctttaatctgaagatacataagagaactaagcatgataaatctagtcttccttttccagcataatggaacttttccagtttccttcttgtcaaaaaccaggaggatttgcttttggcagaatttgacaagctccttttcaaggagagatctttcaggtctaggccggtggttcccaacctgtgggtagtggcacttttggtgaacctctatctccataaatatttacagtgtgattcataacagtaaaattacagctatgaagtagcaacaaaaataactttatggttgagggtcaccacaacatgaggaactgtattaaagtgtcacagcgttagaaaggttaagaaccattgctctagacaattctgcaaagaagaagggcttgtgtccttgtcttctgtccacagagaatgatttctgggcaggaggaagggtgtgggcttagtatacaatgctctgcatttaaactccagaaggaaaggagagggaggagagaagactgcggagctggggaaaatataaaatacaggcatggacggcgggtggggtgtgccaacaatctcagtgcttgggcggccacggcactttcaaagctagagctagagagttcctctgtcagagagaagagagatggagagatggctcagcaggtgagagcactggctgcccgttctatggaccagggccccatccacatggtggtcctccaccacttgtaattccaggggatccagcaccctcttctggggtctgtggatatcaggcatgcgtgtgatgtagactcacattcaagcaaaacacccatccagacacctaaaatttaaaaacaaaataattaaagcttgttttcttaaaaaagtaagtcaggtaacatatatcttgcaaaattatttccttcttggccacagtgatggaatgttatcacaagacctgtagaacagagcagagcctagaagcagcccccatacatacagagtcaagtgtttaaaacgaaagaggggctgaggtgcttgtgtacaccttgaatcccagcattcaggaggcagaggcaggtggacagggctcctcagagaaaccctgtcttcaaaaaccaagccaagaccaatccatatattaaagtgagagaaagggaggagaaaatgtgaaaaaaaaattaaagtgtactgcggggaaataatttcgcaagatacactgagagtctagaaacagaacatgtatgtccacatctagtcataatagacatccatgtggaaaataaggagtagagacggactatttactaaagcatatatatatatatatatatatatatatatatatatatatgtgctctacatatgtgtatgttatataaacacacagatgcataaggataaatagagattgtacaattgcaattgttttatgcttaagggatttattccttatcttttgtatatatactttgtgtctagctcctatgtaaacatccaatttaatttgattagggaacttttttatgtttatacccaattatatatctttataccctgattaaatgttattagatgtcttagatgcagatggtttttagtaagcactattgttaatacgcttgcacgttgcttagcatacatctaaccagttacttgagctgtggcccatggtccttgcgctaaggcatgtttccctctatggacatggtcacggcagacctcactgcagttagagggaacctaactcatccatgttctttggtttgtcttcggaaggtttttccgttttgtacacatattcatgcatgctttatctttttacattgtccttaggtagttttagaataagattacactggcctcaaaaaatacaggcggctctcccttactttgccctgttttcaggaagaattgaatgttaattaaaattgatgagaattgtgtagtatctgaaaaggtattcaagtctggagggttttgagtagagaagattttggacaatattttaagttttttttttttttaacagttttcttgaagtttaccatttcagctaaagcacgtggatatttctagtgattcacgggccatgtttattagcataaagtttcctaaagcattttattggatagcgggtatcaactcagtattctgactttaatatccagatatgtatatattatgacacatacatatgtataatcagtacatattatattttattttctcttacgatgattcttgctgagcccagaatccctcttggctttatgaacttcctgtttgcagctgcattatgtaatttttcttgctcttattgcttccttcctctttttttctctttttttcctctttctttttttttaaactcagtttttccatctttttgacttgaatgcttagtttgtttttgtttttgttcttttttgttttgtttttgcttttgagatagcatctctatatgtagccccggctgtcctggagctcactgtgtagaccaggttggccttgaactcacagagatctgcctgtgtcagtccttcagtactgggactaactgtgcacaccgtgacacacttcagcttattgattaattgtttttaaagactgttcctgactgctcagttttgttttagatgtgttacatataaatagttggatgttttgtattttataattaacttctgaatatttctttaaatttaaaatttatgtgtgtgtgtgtgcagaacacaggcaagtgtatagacccagttcttatctttatcaactgagccatctttgctagctcctaaatatttgtttcttagttcttctgtaatttacttatctgaaatattatttaatgtcttgtgtgggaaaataagtataattagacatcaaaatttgaaattttataggatgaccaatttgagttatatattaagtaacagcttggcaaaagatacctgaaacatatgtgctgtagtctgactatgttacccttctacagaccagaaaagacaatctcgtgtacccagccagctccagaccactgacaggacctggtctcaatagaaaaaaagtcaaagactcttgaggaaaaagcccccaagtttgacacccctgccccctttatgcctgtaattccagtggaggcaggagtgttagagttcaaggtcatcctaaactacaaaggaagtttgtgtctccccgtagcccccaaaagtcttacttagcacagtattcgctcatggcagagagttctcttagcatgtgcgaggctctaggttcaatcaccactgctggaaaacaaatgacaaacctcttagagaaagggaactgggctggagaggtggctcagcagttaagagcatgctgctctttggcagaacccaggttcaattcccagcaaccacggcaggcccttcacacccacctgtaactcccaactctttgagcacctgcactcatgtgcacatgctacatatacacagtcataatttaaagcagcaaaaagatcattaaaattttaaagcaggaacaacttgtctaatagagaaatttggtaaatacaattgggtaaatatatgcactgaaatgctttgtacaatttacaaagcacccgggtggtggctcatacctttaataccagcattcaggaggcattggctgtcttgtctacagagctagttctaggacagccaaggctacaaaaagaaaccctgtcttaatttttttatttttaacaaagcatgtatttaattacattaacaaggattgagtgtagctccttaatgaaaaacgttatgtagtgtaatgccattcatttatctaatgaaagaatgtgaatgaaacaacatcaagtatggtcacacaaataagtgaatgtagtcatgcaacagcaaaaaggcttgattcaaagaattggtttggagaatataattttaacccagcccttctattattacttttaacaaactaccccgccccagttttgcatttacaatgccaactgttgcctggtgtggtgatgcgtgtttaatcccagtcctcaggaggaagaggcgtgtgcgtctctgtgagttcaagtctagcctggcctacaaaacgaatccaggatcgccagggctgcaaagagaaatctgtctcaaaaaagaaaacaaaaaaaccccaaaaaaccaaagccaactatttactaccccacacagattttgaggtgtgtggctctgatgtgtggtccgtgggttcttccacgaggctgcagtcttatcagttgggttttcatttcaagacttgcttagagctgtctcccagacagctcatggtgctgcacacagcgctggcagggtcctgagtccctttattcctgcccactgtctggctttgcagacttggagctgacagtgtcctccttctagggtcctgtcccagccacttcagctttattctgtttgtccagggagagcaggattaagctacatatccttgaggaggagctataaaaaagaaactgtaatgagaaaattttatgacagaagtaggatgttactcttgttcctggcgtgaggttaagaatatttggtatctgggttcaaattctgacccttttgtagttatttaagcgaggagcctgagctcctgcagcactcagtgaatggaacagtaatgtctgctgtgtggggatgtaggcagaatataagaaagtaaagaaagtacttagcacacaggcttttatttggtgagaggtaaggttaggattacttggtttctctgctctgccaggacttataagtaatttttatacagtattgtctttctatagttttattagcagaatgagtttattttaaggtatatattataaaagctgtgtatttatacttagttaaattctgcttataactgtttgattatggagacttgaaaaaatgcaaatgtgcttgtgtattcataaggatatatattagattcttgataaatgccatattgccagtttgtacctgtatacattctagtagcaggccattctacttattattcgcagtaaagtgttggctttcgaaagcctgtttttaaggcagggtagacttgccttaagattagaggcattgtgctttcatatgttctaaatgtacagagatattgtgttttccagtgtttttgcattattttctctgtacatatgttatgtatataaattattatgcaaggatatatgtagcttctattctctaggtgcttaaatgtaagtcagacaatgatgcagataatcagggtgtacattcagcaaagcacacacacacacacacacacacacacgcaagcttatacacatacacgttgcctccgagatacctaaaatgcagtcagctaagttgtcagacttcaagctggtcctatattgagaaatctgttttattgtccttaagccattgacttgtcacctacacaccacctacacaccacacacaccccttcggtttccatttccttactaaatagaatacatggaaaatgtgctactggagcagaaattctgatttgttatcggtttcattgatctgcctacagccatccaattaccctttggcattccttatctttcttgatacagaaactgttaaaagatgctgcctgtcaatgggagattcttatttcaaaatgatagtagaaaaaaataaaagctatcagttagctgactccttttgacctatgcttggcagtcttaggtaaacccatctaatggtgctgggtaaacttataaaaccatatcgcgttatattactgtcaaactttatttatatgcagttaattgagataaaatctgtaaccctaccattacagatgattactttttattcagcaacttttattgaacgaagaataaaatgtattggaggtgcattttacataaaacgtgtgtcaaataacttcggaatgacattttatttcagtttttatgttaagaaattctgaaacaggcaaggcatttaattaggtcttattccctgtatttccactaatttatagccactaattggccattattttcctttcctgttacagtgtgtatttgtaaggccagtttcaaggtaaacgagttttttaaaagctgtctgaagatatctttaagctatgaacgaatacgttcatttgtccaagtcaagcaaatacaagagagggcacacgaatttcatgaccagcaaacccagcgactccagtctccccgaggctgccgggcggctcttttctgtttactaattacctgtctagtgtactctgacttctgtcgagaagacaggaccaagtcagtttttgaagtagttggagactcctgacttccttagtgatgcttctagaatattttctaggtacaagttttttaaagtgcagttctttcgactgaactgattgtatgttgcataagcgccgggaaggccaacccaagttaaaaagccacctccgtgtacagctgcgggactaggtatgaggtcttttctaggaagaaaaatttgattcatggctcttttccagaggggacatttgcagacttcgcttccgcagaacgtgaagcgcgcctcttcctgccgaggcgaggcccgcgtccccgagggcggcctgcggctccccagcctcatgtgtccgtgcggccgccggctgccggcgcccgggactgacttcctgtctgggcgcggggcggaaggatcgcgttgccagccggggccgccgccgcccctgccgttaggtggtggggctgctgagcccggcggcgggaggcgggccggccgccgcttcctgtcggaggacgcgcaaggatccgggcgtcggagtgtgtgcgagtgcgtgagtgtgtgccgcccgcacggcgtgtgtctccggccgcgggttccgccttctcccctgtcgccgccgctcagggtgtaagtcaatgtgaagcagcagttccagccccgggataaacatggcgacgtctctgcatgagggacccacgaaccagctggatctgctcatccgggccggtaagcacaggggaacttttctcccgtgcatcggtgcagcgggcgagggggcgcccggcgggcggggagcgtcccccggggcggtcagcgccccgggtccggtgtccgtctccggcagccgggcggccgcggagaggggggagtgaatgaagtaatggaggcgacaaatcaggaagtgatcaccttggagagtaacctgcctcggatccgggctgtcgctccggggagagcggcggcggcggcggcgcagcagcggcagcggcaggggccgggcgcggagccgcggctaagttggggagtcagcgcgggcgagttgcgcgcttcgccccagttgccggggaaccaggaagtgagcggagctgttgtccccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacttcccggtgccgagtgggacgccgccgacccggcacctccccgccgcggctaacggcggccgtgggggaaccgggctgctgcccttccttccctcgtggggcgggtgactgagggtggacgggaaggacaccgggtgtattccgcgcagccggcccggggctgcgggacagcggagggggacgtttattttggtccacagtaagatgaaagcggggagcggggcgggcgggagggcgtcctggccccggggaagtctcggctcggcattgccccctttcccctcccccaaacctcccaccatagcggaagcgcctgggagaggacagaacgcgcgcgattgacaggcccgaggttccaatctgcgccctgagctgttccaaataagaacgttgatttctgggggcgggaccacgggcccgagccgggccaatgaagattgggcgggagtgaagctgacaatgtacgcatggaattggagggaagaggagtgtaaacacggaagtggccgcgggggtgggggatgtgctgcgccactgctgcagcggaagggcacggacttaagttacatagaaaaagcagctttacttgctagcagacagcgcagcgagggcctcgggtcgatgtggcactgctcgaacactgttgcttaccgaaattataagcgcatgcggtccctcctctggttctgtttcacatctccatcgatgtcggattggaagatgagaaattgtaaccaaacggtagtgctgtaaaagatcagaacagtctttttgcacctattgtttttagggatcttgaaattggtagtttggtggacaaagcagttcggtttggaggaaaaattatgtttatctctaaatttaacggaactttaaatataaataaaatctggactgatagaactgcatgtgctatataacaataacgctgaatagtgtgttttggctgaggcatattttacacatttcaaaagtagggaaatcacaatttattgagcagcgtttaaatgcctttttgaataggaacttttactgaaggagaggaacataatggaacttgggtccttgttaaagtcagtccattgatcagtatgaattagtgtacagttttatgttgggttagtggtgttttgagtgtcgagtgtgtatagttaaagagatactgtttggggcaggagagatgctcctcggttaagaccacttgttgctcttgcagagttgctcttgcagaggtcttgggttcagttctcagcacccacattcacaaccacctgtaactccagttccaggggatacaacccctcttctaaacaccatggacacacatatggtgctcataaatacttagacagaagcttaataagcctaaagatgttatttccaattcatgtgaatacttatgagagaaccattgcacagtttctgcagtgagaaccttgagaaacactgtagagtaagaggacttaacttcacaagtgataggtttcttttctctgcctgagctattagaactaccactaaaactgaatgtggcctgtagataatgcgctgggagtgcacattggaagtcagtgttcctacctttttataggcattcttgcttgtagggctgaggatctggaccaggcctccagcaagctgggcaggatgctttacctcagggctacacccgctctgacacggggtttctaagactttagatgccattttccaaatctacttgattttcgagagctgcttacagaaatcttataactaatgtttttaaaatcacagtgtgccatgaaagagttctacacgctgttatttcttctttcttgttcatgtaatccaaagactctttcaggctctttgaagaaaatttaaggatttgctgatatacttaaagctagttcagtaagttcaaagctggagaagaaaatacgaattaaaaaattaagattctatagtttttattgttataagtttaaatgatctctttatctacttgagagaagtcatcagatacaagcaagcagatgaaaaataatgtgcaagtgaaaaagtagctgtaatgattgcagtaattacctgaggattgtgtaaaatgagtgacacttgggaacaacttagagaataaataagctttgaattaagtgatgttagtatcacttgtttctaagcaactgtagatcatcgggtagtgccattgctatatcacgacaggatatattgcttttctctataacttaagtatcatatatatgtagtcctttagttattaatatttaagctattaggagtttgagcgaaggatgaaataacttctttataacaaatcagtatcatcttaagattcaaaattttgtagtcaagacttattattcttactaaagttacatttgggtgggacatggtgatgccagcctttatcccagcactgaggaggcagaggcaggcagacttgccaggactgcctactcacaaacttgcttaaggaaccatggaatcaaggactgaagttttctaattagttattgataatactttgtcgtagttaaccttaacttaaccacttaacctctttagcatatgaccaggtaatctctaaggacatttaaagctgtcaaattacaagtgtctcaacacatttaatgcagaggttaaaatataagaaagaaattcatatgagtatgtcatagagcttaattgctttagacaacctttgaaaacttatatgtatttgatatagtataaaacttgaggcttagttctggtgtgtgtgttaatgtctgacattgttactttcctaataatgtatgtgaacattatgtgtacatgtctggatttgagggaagatttttcagtttaaaacatctgatttcttaagtgtacaatccgtgaccacttctcctctttttctctcctctcctctcctctctccctccttttccttttttccccttaagatgggtctcattatgtagctctggctgtcctggaacttgctttgtaggtcaggctggcctcgaactcacagagacccacttgcctctggcttctgagtgctgacatttttttttttttttccttttgagaagaggaaatttttctctggaaatacaggctagtttctaagtgtgaatgcatgtacataccagaagttgacattaaatatcttcctcaatcactctgccatattttcttgagacagaatttctcatctagcctacagattcagctagattggctgtcctgagatagatccttctgtctctgccaccttactattactattacagttgcctgccaaccagcagtgtactgggacttgaggacccagctctttatttgggtgctaggtatctaattgagattgccctgcttgcaaggtaagcacttttaccaactgaggcaccttcccaaaacagcacaagttgtgtggttgacaaaacaatctgtatccgtggtactctctctgtatccgtggtactctctctgtatccgtggtactctctctgtatccgtggtactctctctgtatccgtggtactctctctgtatccgtggtactctctctgtatccgtggtactctctctgtatctgtggtattctctctgtatccgtggtactctctctgtatccgtggtactctctctgtatccgtggtactctctctgtatccgtggtactctctctgtatccatggtactctctctatatccgtggtactctgtctatatctgtggtactctctatatatctgtggtactctctctgtatccatgatactctctctgtatctgtggtactctgtctgtatctgtggtactctctctgtatccgtggtactctctctgtatccatggtactctctctatatccgtggtactctctctatatccgtggtactctgtctatatctgtggtactctctatatatctgtggtactctctgtatccatgatactctctctgtatctgtggtactctgtctgtatccgaggtactctatctgtatctgtggtactctgtctgtatctgtggtactctgtctgtatctgtggtactctgtctgtatctgtggtactctgtctgtatctgtggtattctgtctgtatctgaggtattctctctgtatccgtggtactctatctgtatccgtggtactctatctgtatctgtggtactctatctgtattcatggtactctgtctgtatctgtggtactctgtatctgtggtactctatcttgtatccatagtacttgtggtacttgggatttctacatatgcatactccagcagttcagaatttcagatatgggtgtgattgtgttgctcttgaaaacaatcaaaaggtagaattacatgtaatagtatggtggtgcgtgcctttaaccctagaactcctgaaatagattcacaggcagatctctgtgaattcaaagccagcctgatctacagagtgagttccaggacagccagggttacacagagaaaccccttatctctgtctgtctgtctgtctgtctctctctgtctctgtctctctctgtctctctctgtctctctctctctctctctctctctctcacacacacacacacacacacaggaagaaacatatatgggggtgaattgtatgacttagtggtaaggttctgtatataatctccagtataggaaaaagttcattgtgaaagaagttaacagtacattgcaatatgagtactcagatttatatgtcagcaagttaaagtagtgccagggcataaagtcaatcaataattaaacataaagcagttttctttaggaagaaataatgtcagagaaaggcgggcgcacacagatcttgagactccaggaggctttcaggggaatcttaaaaggtcaacccgtttttcagaacatagttacttgcctttcaatcttaaccagtgcacagaagcaaaaatttaaagagtcccagggtatgttagatatgctgtgtttagtggcacaggtctgtcatcccagctacttggagactaaggcaggcttattgcaaattcatggcttatataggctatggagtgaattcaaagccagcctgagtaagcttaatgataccctatctgaaataaaaaataaaacagggctgaggatatagcttagtggtagactgcttgcctgctgtatacgaggccctaagttcaatccctttaaacacctatctctagtacatacctgcatgtatgtataacacgaacactttttaagctgctggattattctagttatttctcttttatgcatgtttaagtaacatgtgtattataaatgagtaaatatttttgaagttaaaaaaaagattgtttttattgaggtaaggtcttgtgctagctagcccatgctgtctaacctaaaacttctgaaaattgggatttcaggcataaagtaactgtgcctagctaagtgttagtttactaatacaataactatctgtagataacatattcaaagtctttttgagattctcagtaatttgaatgcagaagtgttttctgttttggctgtcatttgatacagttgctagccacctgtgggtattgaatttttgagatttgactgggaaattctattttgaaagtttttatattgattacatgctggcatggcagtattttggatatgttaggttaaacaaaagatactaatttcaggatggtagacctcttccccttttagggccattaatatcccttttgtacttttaaaatatggctaaaagaatttaaaattatggcatatacttaattggctaactttggattagaaagttattttaattgccttcttatgttttataaagcagtattggttgatggtcaaggaagacagatgtgaagatgaaagaccccggtccccttctttactgcagtggtttgggtctctgtcactaccctgtctggaggcattagaggatgtccttagtcagtgcagaacttgagtggtgacctaggaagtacgcgttacggtgctgtgtttaggggaaaccactgacacctaatgaagtatttctcatttttccattgctctcaaactccattgctagtaaagtttatttctgacttgagaacgctgctaagagctagatccattgccagcgttctctttgcaaagctgggaggtatgcctcttgtcagacttaattaccaagtttggtattttgtaacagctgttgagtgagtctgcagcagtgcacatacaaataccagctgaatggagagggatgtggagtgggcatattcatccacaggaaatggcgcacaggccacgtttgttgatggcatggtcaaatccacatcattttcaaggagacttggccagtgagttaaactgctagaaaatgagacctgtccaattacatattagtttgcttctatttttaaaccacgttgttgagtttctcccgtgactctcatgcagcgtttattcaggaagcggtgaggaggaggagcagcctattgtagatgctgctgctttcactctctcactttggtcacagtgcactattacattggtattcatatctttacacatgtgcacttctcagtgtcgtttgaattattgaagtttttttttaagatttatttattattatacataagtacactgtaggtgatttcagacacacaagaagagggctcagatctcattactggtggttgtgagccaccatgtggttgttgggaattgaactcgggaccttcagaagaacactcagtgctcttacccgctgagccattgcaccggcccagcattgaagtttttaaaatcacagaaatggaaaggtattaagtctctgttaccaaagactgttttagaaaattacctgttgactcctcacttctataaaatgggtaacatattcttggaaactctcattatattttaatttacctgacgcttggcttttagatttttatttatgtttagcattgagctgcagatgaacatggtagctcccaaaatagaaatcactgctctttaacacgctgttagatttcagaataacaggagattatcttacatctgcactgggattggtggtactttctgaacctgttcacactcaggggatccagttggtagcacagcactgggcccgtgatactcaattgacactggctgattatacttaacgtattggactttctagtttgcaacttataaattgtgggtatttaaagtaatagtaaaatatttgggggttataatttgttaaatttgggactcttaagtttgaggtcagaagtagaagcaagaaaattttaaaaaactaattggaattgggtgtggtagtagacccttgtaatctcttgcttagggagcagaggcaggaggattgccagttcaagatctctgctgtgtctagagtttctggctattctggccatatgagattctgccttaagaaacaaaagcagaccagaccagaatggagattcattggtactaatataaacagagcatttcaagctgcttaagaatttagggcgcatgatatgtaattgttaggcaagtatttttgttgttgtttataacttatatttaaaaatctgtagctttattgccctatgacttttaaatacttgaagctaattgtagtacagtacagtttttagaatatagcttcataatattacataaggaattacttacccaggatagtttattaatagcacctaagacaacagctaaattacaacaccaatcctgccttaaagagaatggctcccgagatgacgtttaaaacctgagaacttgctttctggggtttgttagtgtactcgagtcttctagaggcccctgtgaaaagcagtcgcaagcgtggtggtgtcttttacacttaatactaagtttgttaaagttgaatagctgaatgaatcctttgcctctctgaagctgcagacaagagtaagcagggtcacctaaagatagatttacgtagaggtttggctgcctctccggatccagttagcgttgagcagatttccataaatggaaagagcaactggagagacggagtaccttgcttgggagtgtggacggcgtgcgtaacaggtgctagaacaggctgaagttttaaaacatgctccccaaatgacttcgtttctaaggccgaggtttagcatttggtgaatttggaggctgtaacagtttttctctttaaaattaaaatttcccgagacaggccagaagattcatgtctgtacttgtggatttgtcatggttttatgaaattttatgaacattcacaacaagctccttaaggggaacatggtgaaaaaagtcagtcaaattaaaatctagtatttatgtttcagaacttctaaccatagagattagtcagtataattaagtcagagtgtgaaataaatgcacagccaagataatgaattcttgacatttctcctattaaggtcatggggttgtccttagtttgacacgaaaaagaaatgcatatttgtctttctctctctctctctctctctctctctctctctgtgtgtgtgtgtgtgtgtgtgtgtgtgtgtgtgtgtgtgtggctagttagcttagaggtggaacacttgctcagtaatgggaggtgttgggtttgatccccagcatctctaaactaaaccaaggcagttgtgagtccacagttgggttaagagagctcccttaactaaaggggcttacacgtttacaggagcaagcagtcatcacactgaattcccacttcgtgtcaagaactgtatgtgatttttcatggcttttttggaaataaccctgctctgtgagtggaaactgaggcagaagagaataagtggattgattgccttagtggcagactaaaaactcaagctgctagtatctgaaagtgcaaacctgtgtttgtgtacttgactctttcacaagtcatttgatagcaaagcataaaagaaatacaaaccaccatcttttcatgcaccccacccacccacccacccacccacatacgcacttatgtgaaacctagcgaagtgagtctcagaaaagaataagcttactataaggaaacttctgaagtgctgtgacaataaaactgataacccttgtctggaggttttccactcacaggagactatagaaattgaagttatgccttaggctagttagaaaaaagtttcttcctgatttctattggctgttatattgttcttagtgatgatgcataagattacataattgtcctatattgctcttcacccaacctctcttcctggtccctaaaccttgtggatgagtccctaagtttttaaattttggtctaaaatggatgcaggcttcataattcaagattcttttttttttgtttgtttgttttcctttttaaaaagatctgggaactccttactaacttgtcagcctcgttggggttttgcatctgagatcgggtctgcctataaaccccagaatagcttccaatcccatccctgccttaaccttgcaagtactggggtgaagagcgtgtggcttagtcctggcttattggttgcttttaaaatcagtattcactttacagaacgtagacattagttttattattattattattttactaagtagttaacaaatagtcaatggcttatgtagaattgttcacatggacaatcaattcatacatattcagtaatatattttaaattgttagtgttttaatttttaattaagaactttgcttttttcacagtggaagcatcagttcacagcagtaatgctcactgtacggataagaccattgaagctgctgaagccctgcttcatatggaatctcctacctgcttgagggattcaagaagtcctggtatgtgagctacccattttttcctattgttgggtcacattgtttcctattagaatgaagaagttaactgggtggtggtagtgcacacctttaaatcccagcactggggagtcagaggcaggcagatttctgagtttgaggccagcctggtctacagagtgagagttccaggacagacagggctacacagagaaaaagctctattaaagaaaatgagaatagagaagtaagctgttgatgcaaaggagttacttctagagttcttaaaggtctagacatacacacctgatatcaggaactaatacgaaaggttctaaaaatctaaaaagtactgtatttgtttatgttccatgtttgttttcttgattctggttaaattgtaggtagttgtagtcctatagtgggacaagttgggccctttgcttccgataaacttttcagtcctttactctgaccaaacaggcagtaactacatggaattggccatggtagagaggaaaaggagtttattaatttattttatattccttttagcttgtgagataagattgcttttataatttatttattcattttttggggggcaggctgattttaatagtggtggtgtactaatttgattttgtcctaattttaattcattgtgtagaaatctagtgtaagttgctaagagtagccatctttaaaaggttattttatgtgtataggtctttgcctgcctacatgtctgtgtcccgtgtgcatgcctgatatccatgggtgccagaaaaggatcggatcctctgggacgggagttccagatggttgtgagctgccatgtggatgctgggaattgtatcccagtcctggaagggcagccagtgctcttaaacactgagctatcttcccagtcctgcagccatctttttaattggattaggaatccaatgcattcttcaaggtgtggtatttttattattcatgcgtatgtgatagaaattgaagcaacattattgtatgtaatagaataccagatgacaagctgtatgtactattttagtgatggcctaaaattaacagtttttttcctttttcgtattttaaaatgaaatataactatgtactttgtattgaacatatatttataaatttaaaaaattttatattatgtccttgtattcctcagttaatgaataatggcaaatgtatgcaacaaaagtaattactaaaggactggactattcctttcactctttccctgtgaaaatgtaaaatgttgctacgattaactaaaagtttaaagggagttggagagatagttgaggggttgagagcactgcatgctctcgtggaggaccttggtttggttctcagcacccacccacatggtggctccagttctagaggatccgatgccctctctggcctttgcaggcactaggcacacagtgcatgccagccgaaaatgtgcacacacataacatcatttttctttaagtacctaaaagtatgaaaaggaggttggctgtcaacatggctgtcctaatgtcatttactcgtgtattataaataggtgggatattcagtgacttgatttcttcaggcacaaggtcttatctttcttgctttggataattcttttgtaaagccagcctcttctaatattgaactatccacataggaaactataataggggtaggaaattttaatttttcaacttttttttatagtggaagtgtttgtccctccttgtatatcaactccagagtttatccatgctgcgatgaggccggatgtcatcacagagactgtagtggaggtgtccacagaagagtctgagccgatggatgcctcgcctatccctacttcaccagacagccacgaaccaatgaaaaagaaaaaaggttgagtgtgcgtcacttgtgatgcatctttcccatcttgtctttttgttggttggtttggttttggttttcgagacagggtttctctgtgtggccctggctgtcctggagctcactctgtagaccaggctggccttgaactccgagacctgcctgcctctggtgcttttttatttttaaattattttgggggtaaggtctggtctatatatagctcaggctgtctttgaattggtcattctcctgcctcagcctccccagtattgagatgaatgcaaacatttgccactgtaatagtctgttaaaacacaggaactcacgcgcgcgcacgcgcgctcgcacacacacacacacacacacacacacacacacacacacaaacacacagctaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaagaagatgaagttggaggatcacaaagactacaaatccttttcttaagccaaatgctttcttccttgttatttcctctttctcccatcctggccctgggccatgggtcctcccttcctcccctccatcctcttctctttgctaccaccttcttctcagactgctttctgttttcttctcttccttctccctttccctttcccttcctgtgacttcccatagagatctaactgcctctgcctccccagtgccaggattaaagtcctgatgttcttctttaaaagaccaagcaagggtgaggattggagagggggcccagaagttcagagcactggttggtcttcagattctattcccagcacccacatgactgttcacagctctctgcaaatacagctccagggatccgaaacacagctgcctttaactccaatttcatggggtctgatgccctcttctgggcaccagactcgcaaagtggtacagaggtatacatgcagacaaaacacctgtgcacattattcaaacatttaagattgccagtataaacttagcagtgggtaaagagaattcccactcactaagcctcatctccgtggtaaagcgtgtgggccagcacatctccacagcgctatgcacacatctttcctagttagagtaaaatcagaaagaaaggaaagccttagttaaaaccttgtttcgttactttctgttgctgtggtgaacccgggaccagagctccttgcggaagggtttgcttggctctcagctacagaaagtgtagccacagcgctcacctcagctcggtgcattttctccattacagctcatacagaggtcacagaggttaaatatgtcttaaaacacagcacgctcttttattcagttcccactaaaaacctttggctcaaggaacaaatataattaaaacaaaaagacaatcactcaccactaggcaaatgatctgagcagatatggctcgagagtccaaatggccgatctatgcatgtgagtcatttcaccattgtcagctgtcaggaaatgcaggtgaagacacacagctgttccccttcactgtgtcagtggctaccctcaagaacacagaaggcacggtgctcgtgcctgtgagcctagcacaaaggaggctgacagtgacagcaagcttcacagcccaagttcagtgcatggagttcacggggggggggggggggacggacaccgattcctacaaattgttctgtgtgcacatgtatgcatgtgtaacactgttggggcacacacacagtgtaattaaacacagcacacccaccaactgaacaaacagaaaacagcgtagcaagtacttctgagaatggcccgtgtggggtagggagtgacacactcctatattattggtagaatgtaaatcacagggctttcaacaagctacagatagagctagtggtgtggtccagccatacctgtcatatccatgaagggatctaagtcagcgtgtttcatgtgtgttcagtcagggaatcagtctaggtgtctatcagagatgagtggaaaaataaaatgtgatctgtgtctgtgtgcatatacgtatgtgtgcacatgagatgtgtacacacaccagaatgtttagccacgaaaagtaaatcatgtttgcaggagaatgggtggagccaagcaaaataaactagacttagaaaaacaaacagcatgttttctcttagggaaccaggattgaagaaaacaaaatgttatagatgggtaaggtgacatatggttgtggtatcaatactcaggtggttaaggcaggaagataattctaggccaggctggaccatggaagtagaaagggaggcagttcggggaaagaaaagggacctggcttggaaagaggccacaaagatttgtgtggagcagtgtctatgacggaagcatgctgtatgtctgagagcgtggtaataaaacccatttcaagtaaaacattacaaacccgcatggttctgtggttaccgctgtttgggaggcagcgtcagaatgccattatccgtgtggtttgtgactgtacgtgtgaagcacagggtccttctttaagcttttactgtggacgtgtgtgctgtggtgcgtacagagggcacagggaaactgcacaggcagctgagccggcagtctcaccagcccccagaccgaatttgtactgaggagcggtgggatgcatttcacactccccttgctaatctgtctgcctcgtgagagaaacagggacaaactcgagtgaccaaagcatttactagacataatcacttggagagtgtgttttattttcttttttaaaacttcctagtgtatctgcaagttgacaaggaaatttcaacatttgcttaaaattctagaactctctggctcccagtatgagtgagtatttactatttgtgttcatttgagctcaaagaggcctcagatgatcagagcctctgcagcatgtaggtgaggttgttgctgactgaggaggagagggagaacatgagcaaacttccttgtctaggcttgtaggaagttcttctagcagcatcggatggtggctcacacctttattcccagttcttgggaggcagaggcagggggatttctgagtgcaaggccagcctggtctatattgtgagcttcaggacatcagtccaaaatttagtattgatgctgtccttgaccataaagaaaagctggaagttcctgacttgctttgtacagttgtcatttctactaaatgttttatttaaaattacagaagtgtttacagctccttttgcaagcatctttcatctattctgagtcctgagtgagggaatgcgctccatgcatgctgggcaggcgccctccactgagccacaccacacctcccaccatgctgaggaggctgtcccttaaactcactctgtggcccatgctgatttcagtctgcttcctagctttccgtggttctgtgccaccacacctccttggcactgaggatttcagtctgcacattagtatctagtttagtgaggaatgtctttttagagagtctgcttatttctgttttcagttcatgatttctttatcttatattttcagttggccgtaaaccaaagacccagcagtcaccagtttccaatgggtctcctgagttaggaatcaagaagaaagccagagaaggaaaaggtaatttgtggatggtcattttggaaataaaataccccttttatttttttaaattttttaatggctttagagctctattatagaaaggcgggggaaagagagaaggcagaaagagggagagaggcctgccatggccatgtggagagaggggggaagggcgagagagaaggagggctagagatgagagtaagtttttaaaaaaattttaggtgacatttttgcaggataatttctagtatatgtacatatgggaataccatttcttagtatttctcaattaggggtggaccaacattatggggagcttttagcaaaatagctatgcctcaaagagatgggatagccattgtatttggtaatatccacaggacagtgcaaaccattgttttgggaccatgtgttagaggacaggtttatgtgacactcatcctcacacagaagaggctacactcatccgtctgtgtgggagtggaagtcagtctctgagagccagtatctctgaactgttaggattgcattcagggtcagtcttggcaacaggcgctgttatttaagctactctggccttctactacatattttctgattctcaagacagggtttctctgtgtagccctggctgtcctggaactcactctgtagaccagactggtctcgaattcagagttccatctgcctctgcctcctgagtgctggaatcaaaggcaaccaccacctggctgatttttaaaattttttggtgtgtttgtttgttttctttcttttcttttaaagatctgacattggaattacaagcagttatgagtgctaagaattaaacccaggtcctctgctaaaagcagtcaatgtttttaatcactcaaccatctttccagcccctatgctttctaatttgttgtgtttgatgatttccagtaatattaggcatatgtgtctgatgatcccataaacaaattatcactatttaataggtaaatgttttcaaactgataatcttaaactttttattgatatgtttaaatttgtcctatttttaatgtttattgtgtaaatctactgaaaactgtgtaatgattccacagtgaattttggttattagttatatctgaaaggaaaaaaggacaaactccaatttcattgttcttttcttatgaatttggattggaactggtttcagaccttgatttcctcttctgccctgggtcatattacatttctactgtgttaggttttgtctttcagtgcagattgagaggctaaaggatggaacacagccagcaggagtgcctgttttgtagatacctagaatctacattgtccagcaccgtgtcaccgccatgaccgatcctgaaacctgggtccaggactcatgacagcatagaatctagggcttacatcttaagaactgggtgtggctcacacttaatccagctctcaggaggcagggatcgcttgaatttgaggccagcctgatctacatagcaagtttcagacctggaaaggctgcacagtcagacttgtctcaaaaagaagtagcgaatatatagttgtaaatgaggatattttatttgcatttaatcatgttagtggatttcaagttaatgcctgtcattgtttttgctttgtttttaaaggaaacacaacctatctgtgggagtttcttttagatttgcttcaagataaaaatacttgtcccaggtatattaaatggactcagagagaaaagggcatattcaaacttgtggactcaaaggctgtctcgaagctctgggggaagcataagaacaaaccagatatgaactatgaaaccatggggcgagcgttaaggtgagaatgaacacaggctggttcttaagcagaaccgacctgtctctttagagcgtctgctagttgttaaagtgtttgcttaaagaaaagctaaaaaacaaatcccgtgatataactgaaaactttgaaataatctagaagaatattttaagcttggaaatagatggggaaagagaagtttggtctatatgccaaataatttaacattgggaaatccttaattataggaggtgactctgcatttacaactgttatagaatagaaattgtttaccttgtaggccttgtaaaaagttaaacccagactgggtatagtgcccgtgccttgtagtcagttgaaaattgaagttaggaggatgatttcaaagtcatcctcttttacagagtaaggttgaagccagcctgagctacaatgagatctgtaagaacacactttccagagtgaatgtacttttagtccctgcaaatggtgtaaatgactttatctcgaaaatgaaaaaatagccaatgtacacatgatagtgtttatttatttgagacagttcttgctatgtagcccaggctggcttggagcttgcatctattctcccagcttcccaatgctggtatttcaggcatgagctactagtcagtattcacatgttccatgattattccaggtaaagtcaggttgttccagataaagtcaggttgtttttgtaacaaattagagttgcttctattaccaataaagtattctgtctatgttaagcttttcttaagggagagaacaaggtgtccatggtggaatgtactgtgatctcatcacttgggaggtggagggaggggggtcagtctacagctggaagctggcctggtctgtaagagaagggccgtggggtgctggagataaagcactgccctaatagggagtctaggttcacttgttggtgctacaactgttttggacacatcaaggtcacagagctatattagctacttcttactgatgtgacagaggcaacctagggaagggcacatggtaggactcgcctcattcccagcccgacaacagcggtgaacgctgctacttagcttgcccttcctttttatttggtctgagattctgagaagagtgctgctcacagatagcttggttcttcccacttcaactgaatctagtcagccctacgtgcttctagatcttgtcaaatcaacagtcaatattaaccatcacagggtcctgtggtatgacataccaacttcattgtcaccaaatctgtaatcttaggtgtaggccaagtggaaggagccctcataaacaggaataagtaaatgtttctgtcacatgtacgtgtggttttattgagtaagatgtgatagtacatttgattaatttagtcatttttcccttgcagatattactaccaaaggggaattcttgcaaaggttgaaggacagaggcttgtatatcagttcaaggacatgcccaaaaacatagtggtcattgatgatgacaaaagtgagacctgccctgaagacttggcagcagctgctgatgacaagtctttagaacgagtgtcactatctgcagaaagtctcctgaaggcagcaactgccgtccgaggtgggaaaaactcatctcctctgaactgctccagagcagagaagggtgtggctagagttgtgaacatcacctcccctactcacgacggttcctccaggtctcctactaccactgcacctgtgtcagcagcagcagctccaaggtgagggagacgggagagctgtagcagagggtttgtgtttgagcgctccttggaacaaatgttgaatctgtatcggccagcactatagggacacttttaaagtgctggatctttaagtatacttttagctatatttagtggaacacacctacagtcctaagtactgtggaggttgaggaaggagaatcataagttcaaggcctgcctgtgctacagagtatgagttctaacctaagggtaagctagcaagaccttgccccaaaaagctggtgacgtagctcagtggtaaaccctcgcttagtgtgcaggagaccctagggccatcaccgcaactgtaaaagttgggaacgctgattctaggcatttgcatttgtatttaacttgagactcattttcccatttagtgttaaatataaccagcttgtttttaatctaccaggacagttcgtgtggcaatgcaagtccctgtggtaatgacctcactgggccaaaagatttcagcggtggcagttcagtcagtcaatgcaggcacaggctcgccgttaataaccagcaccagtccagcctcggccagctctccaaaagtagtcatccagacagtcccgaccgtgatgccggcctccactgaaaatggagacagaatcaccatgcagcctgccaagattatcaccatccccgccacccagctcgcacagtgtcaactccaggcaaagtcaaacctgacggggtcaggaagcattaacattgttggaaccccactggctgtgagggcactcacccctgtttcaatagcccacggtacacctgtaatgagactgtctgtgcctgctcagcaggcttctggccagactcctcctcgagttatcagtgcgctcctaaaagggccggaggggaaatcagaagccaaaaagcaggaacacgatgtgaaaactttgcagctggtagaagagaagggggcagacggcaataagacagtaacccacgtagtggtcgtcagtgcgccgtctgctatcgcccttcctgtgactatgaaaaccgaagggctagtgacgtgtgagaaataaataagcacgttccgggcgggcactgcagactgtcagggttgtcctgacagacatttgcaaggaagtcatcaagaaagccagaggagggttctcacacaactgtgcatagaagaaagcaatcagacgtactggaagtaaatgacctatcccatgtttcagtgggaagtgaactacacattgagatgctgacagaaaactgcctcttaagtaagaacaactgaaccctcaataagaaaagcctgaaagggaccaagcagctcactacactatcacgttacactaagagttggaacactaacacctgtaagaggttacatagttttcagtgggggggttgggatgggtgacgtccattgttacaaagagcatttcttgatgcattttatatgcataccagcaattagcactgtgcttgggcagtgctcacttaactggtgctatgtgaagactctgctaatacaggtatctagaatgtgaactgagtggatccaaaagcttcacacagaggagagcaagatctagtgcgcttttgtttgtttgttttgttttattttttgattttgaatatatatatatatatcatagcttaagctgttttaaaacaaaggccttagactaattttcggtttcctttcttgaaataagctaatggcttgtttgtgtaaagcttttttattaaaagaaaaattttaaaaatcttgtacctagcacagtattgttatagaatttccatgtaacattttctatggtagtttaagtctgtcggtttcttaattgtgaagacattaacagttggctccggccctttactgtaccatacctgcgtcactcgagtcgccctgctgtctgcagacacatcggtatcagttcttctgtcattcgacattcaggcccgcatgaacttgccaggtagctccagtgcctggtgtttgtttcctttctcaccctttttccttttctccctaattttctctttttcttttttagttgacatttaagaggggaagtaccagtgttcagatttgaactataatagtttgtatattcaacatttgaagtatattctattttgttgtactcttgtttcaaagtgtattcaagtaggttttctgaaatatagaagtgaaatttatcttgtggttttggtctctggtgatatttttcacaatgctcacaagccagcccaggctgtcgtttcagtcaggccacagaagtctggtgttttcttaatgactgcctgaagaaatgctactccggtttcgtctttgtcccattatagaaatatttgacaactctctgcacattcccacttcctttataactataaccacataagaaatacaggtcaggaaattggccaatcataatggacctatacatgtgaaacactttcagcactagtggtagcggcgtgcctggcatgtgcaggcccctgggtctggcctggcccctgggtctggcctagcacctcccaggtactgagttgcttccgttcagtttgtttcccgtcacaccttttatgggtagagagctgtggcctggcctgtacaggtgactgtacaggtgaagactgaaggaccagagtcacaaatttaagtgtcacacagttatagttaggtcctcctgtacatggtagacgtctatctttttagaaatgtagatgaaccactgaatatttttggcctttgtatctttaacatgctatttatagcagcaaagatttttaccttttctagccttttttaaaaaaactaacctgattttaaaaattctgtgtatgggtgttttgtctgcgtggctgtgtacacttgtgtactggtgcctgaggaggctggagagaggtcaggtcactagatggttgggagctgtgcttggcgttttgaacctgctcttctgaaagtgcggtcaccactccactgctaaaccgtctctccaggtctcattccacaagcttaggtaacgatactttaaaaaactaggttgatttgattactacttttggagttaccctcaaaatttacctcttaaatacttcatctctcaaaattgagtattgtcaagtattgaggattgtcttttggtcaagtccctaaaactcctttgcaaaggtccatgctctctctgcgtcctgagccacgcagaacatacacagactttggttaacagctaaaggtgctaacttttaagcagatactttcttctgcattcagctgattagaactctcttctaaaagcaacagaaaaagttttcaggtaaacatataaaatctagatttgcaaatgtaactccagctttcggacttcaaccccctgaatgataagtcaatataatgtttccatcttgtgtccagcatttttggagaaaagccacaaaaccatggcttgatgcatttccagcctctccaggcctttgcactgtgatgaacggtctgtgtttactccttaggtgacttttcagcattctctccagatggccgtgtacagcttcagagaccccaggctggaccctttgctacagaggatctcacttcagcaaccatccttgtgtctcggaaagaggtgcctcctacccatcagagtgtctctttccctggcccagtagttaacagtcattcagtattttctaccaggccacttttttcctcaatgggaagccaacctgcagtgctcattgaaggtcaccagtggcctagcttacaaacacaattctgaaaatgttttcaaagttagagcgtgtacatgcatgaaggtcaaggttcagaagtcagttcttctcctgtcatgagactcagtcacaagcacctttacctagtcttctcaaacattccacacgacatttttacacctaatttactttgatgtgcctgcagatgttgtgtacgaggtgctcatggaggccaggagagttggcgctcctgaaactggagttaaacttggagctgccatgtaggcgctgggaaccaaacaaacccgagacctctgcaggagcagccctaacccatgagccgtgtctccacccacttaccttcaccctcgcctccccatcaaatcttgtgccttagttttgcttcccaaagttaacttggcttcccatgacatgcctctggcttattctcagcctaaatggctctcctccggtctggcttgacttccaaccaaggttttctctgtagggcttaccagtgtagaagggatgggaggagttagtgcgcgtgcacaagcaggctctactgaatgttttattaaagggattccgtcgtgaaggctgttcttcagataggtgcccatgctttttccttaccaaacctcagaccagactagattttgactcttactggctcactttatctaattgccacatcacacctcttcccaagtgctgcattaaactcattccctgtagtacagtgcgttacttctgccagggacctgtaagattatctcagacacatcatgcacatctggccattctcccaagtcctgttgatggtatgttcttgtgcgtgcctgcctccactcctctggctgtgtagcccaggttgtcagaaaacacatcgtctttctgcctcagactctagagtgctgtgattccaggaagctagtgcgccaaaaagccaaaataaataaaagtggatttcatgacaccattgtgatttctttaaattcaatagcatcctgcccacttgtctctttgctagtgtcaagacctttttatcattgagacatatccatggcatctccactcccacctcatctttacttttcttactgggtgggagttaagcatcagaacaaacaaataatcccatagtaggcattggaaaccttacttgggtggggaatgtctactctgaggctggggactggcatgttgggaaggggagctagaaaagcaccaagtctgggcttggagaatcaggctgggcagagctgggcgtggaggctcacactgccatcctagccctgggacactgaggcaggagcactgctgcaaatttgaggtcatcttgggctacatagcactaggccagcctgggctacaaagtgtatcatttaaaaaaaaaaaaggttaaacaaggaggataaagccaacatgccaaagatgataaggggcaagaaacaaagacattactaatggctgagccactgactgcaaatctctgttgaacagccatctctttcttattttggctttcaaatatcctaggctggccttgaacttgctttgtggttgagaatggccatgaactccggaccaccctgcctctacactcccaggacactaccatgtcctgctagtagttgtttttcctggtgctgaccactgagctatctccgctccacatggccttgaactattcagttactccaagtcctctgatgctgtaacttgattgtgtccccccataactgagtcaggccttgtggtaaagtactgttggcccctggtgagcgagtgagtgcatcaggcccacaaacatctcaagtgctctagtacattggggagactagcttgaccttgacctgggggtggaatgcaggggtaagccattttggagggagggctccatccttgggaccaagacacccagaagctagaatgtgtagttacttctgttaactgtcaagatgaaaatttagtgtactaatggatagtgtgtaacaccatatagtattacaagatccaaacaaactcccagattccttttagaccaaagagacaagatattaaaagcactctttgtaagtccatttattaaccttaagtaatatttagaactcatacattaagatatttaccattttaccactggaaggatattttgtttggaagaggcttcaacaattgaaagagaactccaggttatctttttgactcttatatttttctagaaaacttgaatccagtcatctggctttttcaagaaagggtcttgacatatagcccaagctggcctccaagacgtgagctttcttgtctcagctgaatgttgggctcatgtctgtcgtcttggcaaggtttctcactaatattcttagcaactgttccagagctgttcctaaagctacttataaaaagcacatcccaggagaagtgattggagtaatcttcacacatctaccaacgtcatcacaacagaaaaggcacaagtgcctagcagtgactaaacagtggaaactaaagaactgaatgctacggaatttctttaaaacacaacagagaagtcaaaggcatagcaaacaggaattatttgtgaagaatgtacacacaaagtcaccaatcccccagggctaaatagttccttagtgtacatcctgttcgatcagcaaatagagacattttaatttttaaggaattaagactgtacctgcatggttctaaaatgtccacaatgctagataatccactttattttacattaagatataaaaaaataaatattaccatgcattttttttcccactgacatttaaaaatcccacaaataaataacttgaaatgatgtctagaaaacttcctacatcttactttaattctgaagggcttacaaactgggtttttataataccctcaactaaaaaacaagaaagcctatgctactaatgcccctaaatggtagaggatggtacacagatgaacaacaagctcaaactggagtgcaaacaccttttcaatgcgggttttagctggaaaggtttgtgaacaatgttttttcaagggcatgctggaaatgatggagagtagtggcagaaactgggtgtccttttccaggcaacttcctatcctagttcagtttcccaaaacatccctggttaagacgcttgtgattaaaagagctcatggggctcctcgttaaagctgaagtcacacaccagggacaggtggtccgaggggtaatggaaggatgggagccggttgggcccaatctgttcttcagtgagtagatccagggcggacgtgacactcagagcatgtctggagtaccagatatagtccagcgtgtggcgacactcgcctgaggtccggatcttccaggttgtgtagggaggctccgactgtccatcgggactcagcagcttgtaggcgctgttgaggttgaggctggaggacgcaaagtgtttgtagacctcttcggttggctctgcgttgaagtccccgcagacgatcagggggatctttgctccctgggtgatgttctgcaggttctggaggaggtcacagccctgagctgaccggaaccgctcccagccagtgcgggcttttaagtgggtgacagcaatgcagaactgtcgcccagactccttgcactccagggtctgtgcgatggccacctgattggtttttagggtcatggctgtcagcctaatattggtgctgctgataagcttgaatcggttttggagaaaaaataaggcacagccatctggaccgttgttgtgttccacatctagacatggtgaccagggcttggggaaaaacgtgccttggtagcccagtctactgaggagtggctggaaggtgtcaaagtagtggtccacttcctggaggcacagtatgtctggctggtaagccaggatctcctccaggatcaggcacttcctctcttcccatttgagcgcttccacggggcactgcacaaagttgtctttgccttctccgagagctgaaaaggaaagccaaacacctgtcagcttctacacaccacgacctcgaagacaatggggaagcctggggtggtggtgcacacccttaacttccgtactgcgacggctgagacgggtgggtctccctgacttcggctaaggctacagactgagcccctgactacaaaggaaaagttaaaacaggaaagaaaagaaagaaaaaaaactctagtgggtagaagcttggatgtctgacatttgcctcggatgctggggcaggtctgtctaagctgtgctaacacccagatgaaataacctcacactatctgctgaagcaagcagcagggtttttatatacaaaaaaaaatttcatatagctgtattctaggatataagacttttgcttttaggtttagaaaaaccgttcttcacagtcctggggatataaaaacttgtcaatgtaaataaacactagttgtaaccccgactataagaaagccaggtgaatggatataaacataggactcaatgaatgggacaaatgagtagctttctctccttacgaatgaacaggatcattccccaggggatagaatcaaagcgcggccgctcagggtggacgggggtggatctaggttaacatacatggtatttgtatatgaaattgccaaagaataaagaaaagtctttttaaaaagaaagattggtgagtcgggtggtggtggcgacacacacctttaactctagcactcggaggcagagtctatgggattcctgagttcgagtccagtctggtccagagctagttccaggacagctagaactacacagagaaaccctgtctcagaatgaaaaacaaaaacaaaaaaaaacccaaagggaaaaaccctctgtctatgtctaactacggggcacaggagtaagcactgagtgcaggtgtctacagaggccagaggccgggcatcccctgaagctgtttgctgtgggaggttagtcctgctctcaaccaccgaaccatcccttcacctgcaaagatgcctttgctcacaattcaactacaagataaaaggcactaccacatataaatggctgataagcctagtttataaatcagcaggtataataagaggggccctttaatgccacaatttttttttaattatcccctcccccaagacaaggtttctctgtatagccccggctgatctagaactcttatttctcctcctctgcctcccgagtgttgggactaaaggcagatgccacctccactcatctgccacaaataaaaatgtcaggaagagctaggaactggccaagcagtacccctctctggttttgttttgagacaaggcctcacatcacagctcaaactggcctcagactctaggcagtcatcaaggcacatggtcaccacggccatctacagctcgtctcaactgctgtccccaccactcattcagtttgtgacctgtacatgctgtcacagactcaggctgtaggcaacagaatgcctaaggttgtcctgctgaggtgctgaacagaaagctcccataagtgcacacaggagggactgggaacgcacagcagcagacaggaagcctcggcagcctttgctgcgcaggcacagcaccaggcctaccttgggcgaggatgttccactgcatgacgcgaatgggagagtggctgctggagcaatctgtcctcaggtccacaaaatcccgctggtagcggggtggccgagtgtgcagaacagccctgcattcctccagaagttccttaggatcgatgggctccagatgttcggggtcagttgacaccaagtactccgggtgctgagcagctgcactgctgttgacggtcttggcgagagcactgtagagtcgactggtgccgtttcccatggaactcactgcaggagaaacagtcccatagccagctgtcagtcagggccttcactgtccctctccggtatgagccagggccccactgcctgtgggcatcacgccatctctaggggtgggtgggtgatgggagcttctggcctccagcgtcttacacgggcaggtaatttaagtattgctgctaactaatctctcgcgaaactaagcttatgcttgtaacctcaatagcctcttgtgttgacacacccgcccagtcttatacaagcatcctttaaccaaagacacagccttctcccaagtttgtatcttaaagaattggattttgtgcccggcagtggtggtgcacgctgcacacctttaatcccacagagggaaaggaaggcaggcagatctctatgagttctatgccagcctgggctacagagggcgtttcaggacagtcaaggctacacagagaaaccctgtctcaacaaaccaacaacagaaccaaacactccaatgggttttgaagggtgaacgtagaaagccgaggtcctagctgtgctgtctgaggggaccaccccctccccggtagtggtgggtttaaccttcgcttctctcattttcagacgtccaatcagggatggggcttcttggagaatcctgtgatcagcattgaacatattctcattaaaaaagtacagggtgaggctggagagatggctcagcgggtaagagcactggctgctcttccagaggtcctgagtccaatttccagttgtgagtgtaccagtgtgtgcaggtaactgaggggaggccagaaaagggtctggactcccctggagctacagttccaggtagtttgtgagctgtccaacacaactgctgtgaactgaactggggcttcggtaagtatgcattcttattcattaagccatctctccggtcccaacttactgtctcttgagagacaaagaccaagttatctttattaaaaaaaaaattgggctggctaataacaagcagttggttcaaattagtgaccctggctggtcacagttgtccctgagtatcaaaatcaattggtgtagtcaggtgtatcctcttttgtttttgtttttttgtttttttgtttttttttggtttttcgagacagggtttctctgtgtagccctggctgtcctcgaactcagaaatccgcctgcccctgcctcccgagtgctgggattaaaagcgtgcgccaccatgcccggcccaggtatcttctttttgttaattttccttaattcaaattggtcctccccacctagatattcaagtctaaagaaaaaattatttatacaaaagctaactgctcaacaaggaatacataaaaaacacaacacaaaggagggcagagtgaagggaacactctatcctaaaagcagaagctggcaggatggcccagtgggaagagctcctgctctcatctctagtctgacaacccgagtctgatcctcagaatccacacgatagaagaggactgactcccaggaactgtgttctgtctcccatgcatgcacacatacacagaaaacacatataacaaatgttaaaaacaactcctaactgtcccttagtcatcacagttagtttctcgacatttctcctgaaagccagcatatcacatactagcatacaaggtgaatgagaggctgagttacctgggacctagcctcaaagtgccaaaaataaccagaaaagtcttttaaaaggctggcatggttgaacactcaaaactttaaccccagtgcttgaggtagtggcaggcgatctgttagttccaggcagccagagctatgtagtgagaccccatctcaaaaaataaaacaaaaaataaacttaaagaggtacttagagatacaacactcattgtgaatacacaccacttactgagtccatcacagtaatctccatcaacccctgcctcacccatacaagcacagcccacatttgcacatcaacatctcactgtttcaatgcccactgtgtgtcagacactaccctagcctcctgtagacacactggtgaccaaacagaccaaccccttgttcccaggcagcannnnnnnnnnnnnnnnnnnnnnnnnnnnnnnnnnnnnnnnnnnnnnnnnnnnnnnnnnnnnnnnnnnnn

SEQ ID NO: 1142 - DNA, 2680 bp, Mus musculus
aaaacagtgaaggatgcttagactacttaacattcaaactaccctctggttaatcacctttagaagactggacttccggatgtctactccatctctattgaattaaaccatgaaaatgaaggctacagtcctggcaatcgtctgtgagccttagttccgttgcttcacagcatttgagacttcctcagggaacgcacgatggcatcggcggtggttgacagcggaggctctgctctggagcttcctagcgatggaggagaaaatcaagagggaggtgacacgggccctgactgcccggcagtgattgtggagccagttcccagtgcgaggttagagcagggctatgctgcccaggtgctggtctatgacgacgagacttatatgatgcaggatgtggcggaagaacaggaagttgagacggagaattcagaaacagtggaagcatcagttcacagcagtaatgctcactgtacggataagaccattgaagctgctgaagccctgcttcatatggaatctcctacctgcttgagggattcaagaagtcctgtggaagtgtttgtccctccttgtatatcaactccagagtttatccatgctgcgatgaggccggatgtcatcacagagactgtagtggaggtgtccacagaagagtctgagccgatggatgcctcgcctatccctacttcaccagacagccacgaaccaatgaaaaagaaaaaagttggccgtaaaccaaagacccagcagtcaccagtttccaatgggtctcctgagttaggaatcaagaagaaagccagagaaggaaaaggaaacacaacctatctgtgggagtttcttttagatttgcttcaagataaaaatacttgtcccaggtatattaaatggactcagagagaaaagggcatattcaaacttgtggactcaaaggctgtctcgaagctctgggggaagcataagaacaaaccagatatgaactatgaaaccatggggcgagcgttaagatattactaccaaaggggaattcttgcaaaggttgaaggacagaggcttgtatatcagttcaaggacatgcccaaaaacatagtggtcattgatgatgacaaaagtgagacctgccctgaagacttggcagcagctgctgatgacaagtctttagaacgagtgtcactatctgcagaaagtctcctgaaggcagcaactgccgtccgaggtgggaaaaactcatctcctctgaactgctccagagcagagaagggtgtggctagagttgtgaacatcacctcccctactcacgacggttcctccaggtctcctactaccactgcacctgtgtcagcagcagcagctccaaggacagttcgtgtggcaatgcaagtccctgtggtaatgacctcactgggccaaaagatttcagcggtggcagttcagtcagtcaatgcaggcacaggctcgccgttaataaccagcaccagtccagcctcggccagctctccaaaagtagtcatccagacagtcccgaccgtgatgccggcctccactgaaaatggagacagaatcaccatgcagcctgccaagattatcaccatccccgccacccagctcgcacagtgtcaactccaggcaaagtcaaacctgacggggtcaggaagcattaacattgttggaaccccactggctgtgagggcactcacccctgtttcaatagcccacggtacacctgtaatgagactgtctgtgcctgctcagcaggcttctggccagactcctcctcgagttatcagtgcgctcctaaaagggccggaggggaaatcagaagccaaaaagcaggaacacgatgtgaaaactttgcagctggtagaagagaagggggcagacggcaataagacagtaacccacgtagtggtcgtcagtgcgccgtctgctatcgcccttcctgtgactatgaaaaccgaagggctagtgacgtgtgagaaataaataagcacgttccgggcgggcactgcagactgtcagggttgtcctgacagacatttgcaaggaagtcatcaagaaagccagaggagggttctcacacaactgtgcatagaagaaagcaatcagacgtactggaagtaaatgacctatcccatgtttcagtgggaagtgaactacacattgagatgctgacagaaaactgcctcttaagtaagaacaactgaaccctcaataagaaaagcctgaaagggaccaagcagctcactacactatcacgttacactaagagttggaacactaacacctgtaagaggttacatagttttcagtgggggggttgggatgggtgacgtccattgttacaaagagcatttcttgatgcattttatatgcataccagcaattagcactgtgcttgggcagtgctcacttaactggtgctatgtgaagactctgctaatacaggtatctagaatgtgaactgagtggatccaaaagcttcacacagaggagagcaagatctagtgcgcttttgtttgtttgttttgttttattttttgattttgaatatatatatatatatcatagcttaagctgttttaaaacaaaggccttagactaattttcggtttcctttcttgaaataagctaatggcttgtttgtgtaaagcttttttattaaaagaaaaattttaaaaatctt

SEQ ID NO: 1143 - protein, 600 aa, Mus musculus
DFLRERTMASAVVDSGGSALELPSDGGENQEGGDTGPDCPAVIVEPVPSARLEQGYAAQVLVYDDETYMMQDVAEEQEVETENSETVEASVHSSNAHCTDKTIEAAEALLHMESPTCLRDSRSPVEVFVPPCISTPEFIHAAMRPDVITETVVEVSTEESEPMDASPIPTSPDSHEPMKKKKVGRKPKTQQSPVSNGSPELGIKKKAREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCPEDLAAAADDKSLERVSLSAESLLKAATAVRGGKNSSPLNCSRAEKGVARVVNITSPTHDGSSRSPTTTAPVSAAAAPRTVRVAMQVPVVMTSLGQKISAVAVQSVNAGTGSPLITSTSPASASSPKVVIQTVPTVMPASTENGDRITMQPAKIITIPATQLAQCQLQAKSNLTGSGSINIVGTPLAVRALTPVSIAHGTPVMRLSVPAQQASGQTPPRVISALLKGPEGKSEAKKQEHDVKTLQLVEEKGADGNKTVTHVVVVSAPSAIALPVTMKTEGLVTCEK

SEQ ID NO: 1144 - DNA, 46589 bp, Homo sapiens
  misc_feature (1)...(46589): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttcatcacgttgcccaggctggtctcaagctcctgacctcagctgatccaccctcctccgcctctcaaagtgctgggattagaggtgtgagccaccgcgcccggccctatgttatgttatgttatgttatgttatgttatgttatgttatgttgttatgttatgtttgttatgttatgttatgttatgttatgttatgttatgttatgttatgatttctgagatggagtgtcactctgttgcccaggctggagtacagtggcatgatctcggcttacttcaacctctgcctcccgggttcaaaagattctcctgcctctgcctcccaaatagctgggattaagtcgcctgccaccacgcccagctaatttttgtatttttagtagagacgaggtttcaccatgtttgccaggctggtcttgaactcctgacctcgggtgatccaaccgcctcgccctcccaaagtgctgggattacaggggtgagccaccacacccggcctattttattatttttaaatatcaattgtatctgtggttatttccccctttttgttccatgtttatatatatatatgtatatatatagtgtatatatgtatatatgtagtgtatatatgtatatatatgtgtgtatatatatgtgtatatatatgtgtgtatatatattctctatatataaataatatgtatattctattttcttgacaacctttgccaaagtgtgtttattttattaatcttttcaatgtcatcttctggttttgtgaatcttctgtatttttgaaaagtattattttctggctaggtacagtggctcatgcctgtagtcccaacactgtgggaggccaagatgggaggatcggttgtatccagcaattcgagaccatcctgggcaagtaatcctcccacctctacaaaaaaataaaaaatagccgggtgcaatggtacacacctggagtcccagctacttgggaggctgaagtgagaggttcacttgagcccaggaggttgaggctgcactgagttgtgatagcagcgctgcactcagcctgggcaacagagtgagaccctgtctcaaaaaaaattactattttctatttcatttttcttgctttttattatttattccttctagtttctttaggtttgctatgttgctttttccatctgtgaatcaaatgctgagcttgtttatttttaaaccttttatttctttactaagtactgttttaattaaatcacacagtttgacatgttgcattttttattgtaattcgtttctagatatttcttagtttctttatgatttcctttttattccaagggttctttaacatatactataagaaggtcgggtgcggtggctcacgcctttaatcccaatattttgggaggccgagccaggcggatcacgaggtcagatcgagaccatcctggctaacatggtgaaaacctgtctctactagaagtacaaaaaattagccgggcatggtggcgggcatctgtagtcccagctacttgggaggctgaggcaggagaatggcgtgaacccggaaggtggagcttgcagtgagcccagattgcgccactgcactccagcctgggcgacagagtgagactccatctcaaaacaaaacaaaacaaaacaaaacaaaacaaaccatatactataagggaaaacattaatttgactacatcaaaactggatgtttttcccagcactttgggaggcaggcggatcacttgaggctgggagtttgagaccagcctggccaacgtggcaaaatcccagctccactaaaaatacaaaaattaactgggtatggtggcatgtgcttgtaatcccagctactcgggtggcagaggcacgagaatcgtttgagcctgggaggcggaggttgcattgagccaagatgataccactatactcccgcatggatgacagagccagaccctgtctcaagaataaaaaaggcaaacagcaggctggcagaagatacttgcaagataaatctgaattgttatttagaatatattaacattctatagatcaataagacaaaaaatgcctttatagaaaaatggccaaggacatgaatagtctattcacaggggaaatgttaatggccagtaagtatttgaaaaaatatttatccttaatacttaaatacatgcatattaatacaacaatgaaaaattttttgttactcaacacatggcagaaatttaaaaagtcagcttatatcttgaattgacaagcatgtgagaaaaatcgtaactctaccaaaccactggacttgcatagccactttggacagaattacatcaaattaaaattgtactgataagctgggtgtggtggtgtgtgcctatagtcttagctactcaggagacaaatgggaggatatcttgagaccaggagttcaagactaccttgggcaagatggctggacccttgtctctaaaattattttaaaaaattagccaggcatggaatatgactgtagtcctagctaacttaagaggctgaggtggagggtctcttgagcccagaagttcaaggctgcagtgaattatggtcatgccactattctctagcctcagtgacagagtgagacccataccaaaaagcaaaagacaaaatactttatgacctagaaactgtttgttggtatatgatgtggaaagactctagcatacatgtttaagaaaatgtaattttttttgcagaaatatttctaaaagtgagaaatggaaactatttgctaatgtgatgaataactttattagataatgtgatgaataacttagataatgtgatgaataaaatggggtaaatgcatacactggaatactttgtagcatttaaaaagaatagctatatttacgtatactgacatggatagaatgtaaatcttgaatgattaaaaaatacattttagaatggcatatatagtttaatgacatttatgtacctagagcatgtaaaataatactgtatgtcattcagggatacatacacaaacacatacgtatgtaaatatatacacatgtgaaagtataaaaagtagaatggaagaatatacaccaaactcatgatagcagtttctctgggggttgtattcaaaaatgctatcttcatctgttatatgttatttcttgggggaaaacaattttacagcataaatgagtagttgcaggttctggttgagaaggggatatgactatgttacattatttttagcaattcctgtgtggtttaaatccccctaaaaatgtgtgagatgggttcttaaactaggaacatagatgactaagatttctaacctggtaagatgatggttattgataaataaatgaaatctgtagataaaggatctttaggtatcagttggttattcaagtagagatgtttattatacaattggaaattaggacctatatattttttaaaaagtaaatcaagacttgatatgctgatttttgaatcagtatagaaatagtattgaaaagtccttggccaggcacggcggctcacgcctgtaatcccagcactttgggaggccgaggtgggcagatcacctgaggtcaggagttggagaccagctgaataacatggagaaaccctgtctctactaaatctacaagattagctgggtgtggtggtgcattcctgtaatcccagctactctggaggctgaggtaggagactcgcttgaacctgggaggcgcaggttgcggtgagccaagatcacgccattgcactccagcctgggcaacaagagtgaaactctgtctcagaaaaaagaaaaaagaaaaaaaaaaagtcctaggtgggggacttttatccccctagtggggggataataccattactggagagagtggagaaggagagagaaggtgaggctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgtgatctcagctcactgcaaccttcctctcctgggttgaaatgattctcctgcctcagtctcccaagtagctgggactacaggcatgcgccaccacacccagctaatttttgtatttttagtagagacgggctgtcaccaccttggccaggctggtctcaaattcccaacctcaggtgatccacccacctaggctccccaaagtgctgggattacaggcgtgagccactgtgaccagcctaaaatttttcataaacacgctaaacaagaattatatatgggtccttgtaaagtttcacaagaattgcaaattttttttcccagtgtattcaagatactacatattctttgatgataataaacaactcaaacccttgaaatgagttgtcataaatgtcgtttaaactatagagatcattaactattctaactcatgtacatttgggtgcttaatagatgctattttaaaaagttgtttgtggcctggcgtggtgactcacgcctgtaattccagcattttgggaggccggggagggcggatcacgaggtcaggatatcgagaccatcctggctaacacggtcaaaccccatctctactaaaaatacaaaaaattagccgggcgtggaggcgggcgcctgtagtcccagctactcgggaggctgaggcaggagaatggcatgaacccgggaggcggagcttgcagtgagccgagatcgcgccactgtactccagcctgggcaacagagcgagactctgtctcaaaacaaaaacaaaaacaaaaacaaaaaaacgtgtttgtctaacacccattagaagagactagctgcagggctgggcacagcagatcatgcctgtaatcccaacactttgggatgccaaggacggaggattgcttgaggcaaggagttgatgaccagccttgataacatagcgagaccctgtttctataaatgaatgaattactgaattaattaatgactagctgcaatacttagctgacagtcttctaagagtagctgctaataattggacagaatggtttgtctagtataaatcataaagtgaagaatcaacaagtctcaaggagagcctggcccagggataagttaaaatgcaaaaaacatgaacctaagtcagatcacacctaagctaagtatgtatcaaaaacagtaaatactggacccttgtcagaagattttcatggttcatgcctcaaaatgaatgctattgtacatatgacagaaggacttacaataaaattacttttaggagttatgatcctcctaactcctaaaaggaatctaaaattagccatagtccttttcctctgaaaaaataaacatttcattaacaaaaatttgcctctttgaacccctattaaaaatttatgccttatgaaggcttttataattataaataatttaacatccttgggtggtaattatacccactgtatatacaccctattatttaatttcatatataagcagtcttgtgtatcatattgtctctaagactttcacccttggtgggtggggagttctatatgaattgagaagggttaatttcttccttttgttatataatttagtgctaccagcttaataagcacctataacagaaacttgcttaaagtaagtactggataataatttgttgaataagtgaattagtttatgacggttcgaagatcttcattttaataatattttataaaacctgactattaaataaatcagtaacataaaaagctcaaatagacatttaagcagtagtataaaatatatgaaataattcatcttttttctttgtacatctgtagactgcacttctgtaactattgtctattttctgatgttgacagaccaagctttacttggtgctcctaaactatatgattccagcttgttgtgcttcacagacatatttttcttacggttttcttgaccctgttttttccctaaacatgctcaaggtaccaactttgaatttcattgtttagttgtatgagaaaaacttaagacagcttggcctcttcctattctctcattcacttctcaaaacttttttcttccatttttctcttttaacttcccattgctttacctttgacattaaaaaaaatcaaccattttgcagtttatcatactataaatataatagtagtaaaatggatttaactttttttataacttctaaattttatagaagactgttttgtaagagttttgaccttgaagtaacaagacactttgtaacctttgttaagtaacttcttggggcctcagtttcccaatgtgtaaagtgaaggagtggactaactgtggttctctaataactagctggagtgcagtggtgcgatcacagctcactgcaacccgaaactcctgggctcaagaaaatggcctgccttagacttgagtcgctaggtgcacaggcccaccacaatgcccagctaaggatgatgcttactttaaattgattggcaataaaatataaaagctaccatgtcccatacatggcaggtttacctaattcaagaaagagatccttatttaaagaggagttgtactttggaaatagcatgtaggttctttttttgggagagtgaggatcatggtgataggggtagggtaaaaggaccaagagaataaatgaatattaggagaaatgagaaaaaatagtcatgggctatgtaaatccattctgatgctgcactaatgttgggcaagcttttataagatgatatcgcattaatattaccactgaaaacatttttttctctacacagttcagtcaattcggatcataaaaattgtcaccttgttattttaaatttgtaatgccagatctttttgtttattcagcaaatacttattgagcacttactctgtaggaggcactgttcctttatgtaagttttgtgtgcagacaactttagcataaccctttgtttcaaacaatttatgtattattaaattctgaaaccagggaagcattttaatgaagcgttattcgtcattatattggtttgatttcctgtgttcagtaaatttatagtcattaaattggcgatttatctcccttgtccattgtattttaatatgtatttgtaattaggttagttttcagcaagaattacttttttttgaagtaaatgacaatataaatttgtttccaagtgagccaaacagaaatgaaagggtacatgaatttcatgattagcatattgggggagtctcatctccagaggttggtgtgttctgtttactaaatacccgtttaatgtgctctttgacacttctgttaagggaaaaggacgaagttggtctcagaaagtagttggaaactccttattttccaagtaatgctttcagaatatgttctaggtatgactttgttggtgttcctgtcttaaaagtgcagatgtttcaagtgaactggttacatgttgcataaggtttgaaaaagccaaaagaagttaaatagccacctttatttacagctgcaggactaggtattagattgcttccaggaagaaaatatgattaatggctcttttccagaggggggacaattgcagacttttcttccgcagagcgtgaaatgtgcctcttcctgccgaggggctgtgtcctcgcgcggctcccggagccgtttcccagcctcaggtgtctctcgccgcaggctgcggccgctctctggagcaagcgtccgggacttcctgtttgggcgcggggcggaaggatcgcgttgccagctgcggcggccgccacagccacagccgccgccgccgccgccgccgccgcccctgcccctgccgcccctgcccctgccgttaggtggtggggtttctcagcccggcggcgggaggcgggccggcctcggcttcctgtcggaggacgcgcaaggatccgggcgtcggagtgtgtgcgagtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccggtaaggacaggggaacttttctcccgtgcatcggtgcagcaggagagggggtgcacagaaggcggggtgactcccctgtagcagtctgtgctgggggtacagtgtccacctcacagtcactggggcggctgggggaaaggggggagtgaatgaagtaatggaggcgacgaatcaggaagtgatcaccttggagagtaacctgcctcgaatccggcgctgtcgcttcagggtgggttcggcgagcagcagcagcagctgccgggctgagcgctggcagcgggtgctggagaacggagccgcggttaagttgggcactcgggggcggacgagttgtgcgcttcaccccagttgctgaggaaccaggaagtgagtgaggctgttgtctctcggctgcgcctgccacgctgtctggccggagaggccgctgctgcccgcgttcgggggcggcgggcttctccggcgaacgctcgccacccccgctcggttctcccttcagacttcgtccacaattccatgacttccgcatggaccaggcagccaggggcgatgtccggtggaccgatacccgccaaaaaaaaatgctctgaccctccctcctccgcacattcccaccttatgcagtctcaggagtaacggtcctggacagggtcacttaataatgttgagtaaccgggatgatgtttcaggggcccgcctccctttgctcatttaacgggtggctgcgaagaaactaggtttatgccccttccctcgtgggttgtttttttagggggagaatgggaagaacacggaatatatttgtacccctgacctggagggttgcggcgtcagagaagaacatttatttttgtaaacagtgggtgaatgttaaggagcgaggcgggagggagggagtcttggccctagggaagtctcagcacggaattgcccccttcccctctacccccccccaaacctcccaccacagcggaagcgcctcggaaaggacagaacggacgggattgacaggcctctggttccaatctgctctctgaggtgttccaaattagaacgttgatttctgggggcgggactacgggcccgcgctgggccaatgaagattgggcgggagtgaagctgacaatgtacgcatggaattggagggaagaggagtgtaaacacggaagtggccgcaggggtgggggatgtgcggcgccactgctgcagcggaagggcacggacttaagttacatagaaaaagcagctttgcttaatagcagacagcgcagtgagggccctggatcgatgtagcactgcttgaatactgtttacttactgtaatagtaagcatacatgttcctcttcccggttcctatttcatattgccatggatgggaagtggacgatgagaaatactcagggaacagtaattctgtaaaagatcttaacagtcttccatccattgtttttaggtaagggacttgaaattagtagtttgcttggcaaaactctgtgactcagttcgatgggggaaatcatgaacacatgtatcaaaatttaacggaagcgctctaggttcaaagtctgaaataatatgtatgtattgagtacaacacagtggtgaccagtcttttattctataaaatgtaaaaatatgtgtttcagaggttccaaaggaaaatgcagtttactgagtagtgattaaaacacatctgtttgacagttgctttctggtcagaacaagaacttaagtttagtaagagagcacaatgagaacttgattcctttgtatatattgtccattactacaatatgaattaagggatggaatttttggctttatattattggtactaacgatacgtgaagttgttgggtcaatgatatttctgtgaatattgaatatgtacagttcaagagatgttgtttccagtggctgcgaacacacggaaagaaccttagaatgcctttgcatcaaaactttgaaaaatactgtaaaggtaggagggcttcactttgccattggaaactattttttcgtaagcttttggaattaccggtgaaactgaatatggcctgtaggtattctccttggagtatatatgtgtgtatataaaagactgtctttggtttgaaaagacaaaagttttgtcttttgataaggggttttaaaaagtgctgttttccagctctactgcatttctgtactatatacgaatcttaaagtttatgataataatgttctgtaaagaatatgttttacatacagttattttcaagttatgtcaccaattatgttcatgtaatctgaagctcccttacaagccttattttagaaggaaacttgagagaggtttgctcttttacccaaggtttattcagtgtgttaaaagttagggaggaaagatggcccagaagattaggaatcatgattctaaatttttattgctgccaattttcaatagcattggtaggataatgtttctaaagtttgtatttgtgtaatggacagaatacctttttatctccttgagggaggtcatcaggtgtgacagagaattcttcctcacaaagattttacagtctggggagacaggtgaaaatctatataatgtataaatgtaaaaaatagttccagtgattgctataatgggttgatgattagtgtagaatgatatttatacaacttctagaggagataagctttaggttaatattttcagcataacatgtttctaagcaagtatataacacttaatattatcactgtcgctacatgttaaggtacatgttaagctcgaatatacttttgcttttcttccttttgaggtgttaagtatcacatgtgcattcctttagctataaacatttatgctgccagaggagtttgagtaaaggatgaaataaataagcttatttattaaaactcactgtcattttacaaagtatgtttgtagtaaagactcgacgtactttaaaatttcatggacaatatgatgtatgagaacgagccttgaccctgaagagttgaggatctatatctagctgtcactaaactagctagtgacttaacatctttagggcttcatttttctctaagaagacagggttgactagatgattgctaatgacttttaaagctctaaaataagtggcttggaaatacttaatggaaaggtagggcttctccttgggtttttttttttttttctaatattacaccatgtgaatgaatatgtctataagttcgttatgtaattggtaggttaacttcttttatccagtctttgaaaataaaaatgtgtgccaaattggaacttgaggctctttatatgtttaagtctgtaatatagtctaattaataatttaggctcatttctagtgtatatagcttaatataggaaaaacaaatgtctagcattgttactttcctaatatttatgttaaagtattgtgtatgaacagtctggattttctggaagatttctgccttattctcaagtatacctttcttgactttttcctttatttgtcttttcttattttattttatttttacatttgcgaaataaggtaatcagaagttttggtcaacaatgcagttattaaatgaaggtgaaatttttctggaaatttagcctaaatattttcactgacagaaaacaaatctattttattaaagttcattatgaaattgaaaatctcatttctgatttactataaattggaatatgtagtctcaatcttgaaaagatcaaattgaaaaaaaattagcagtatgaaaagaagttaaaagcagtatgtgaatagatacattaaaatgaaactcaaggaatgacactagttttctttttaaaaagctcatttgaaaatgaatttaagaaattacccttcacaattcattgcagcattggtactaaaattcatgtaaaaactgagttacatggtcacatcagtcagtgtgtaaatagccaatcagaatcattcaacataaaactattttagaaacaaatttggttggtggagaagggcaggcagcagaatgttcttgataactatttaaaataattcctcatgtttgataattgtttaaaatgattccttgtgtcatctatagcaaaatgttcaaaaggatgcaaagaaatgcttaagaagagctttttaaaaaccatttatctgtgagtagacaaatactgttttacttacagaatcataatttttattttttttacatttattttattttttgagatggagtctccctctgtcgcccagcctggagtgcagtggcacaatcttggctcacttctgcctcccaggttcaagtgattctcccacttcagcctcccaagtagctgggattacaggcgtgagccaccactcctggctaatttttgtatttttagtagaaatggggttttaccatgttggccaggctggtcttgaaatcctgacctcaggtgatccacctgccttggcctcccaaagtgctgagattataggtgtgagccacagctcctaggctagaatcataatttgtcatctacaccctgatgtttatgtttagaagctaaaacttatataagcatggggatagaatttggttgttattaattacagttgatgaattacagctgcgcttctcaaaaaccaaactctctgacccggattctgggagtcccaagagcctttcacaggatctgtaaagacaaaactgttttgaaaataatactgggacattatttgccttgtcactttcaaaagtgtacagaggagttaggagctatgtatagatgggttattccaatagattgaaagaggaaggagaattcagctgccttctattgaatcaagtataataagatttgcaaaaatgtaaaaaacaaagctacttactttttgttttttattttaagttatttttggccaggcatggtgatttatgcctgtaatcccagcactttgggaggccaaggcaggaggatctcttgagtctgggagtttgagaccagcctggacaacatagtgagaccctcgtctctaaaaaaaaaaatcaaaaaattagctgggtgtgctgatgcgtgcctgtggtctcatctacttgagacgctgaggtaggaggatcacaccccaggagatctaagctacagtgaaccatgatcatgccactgcattccaacctgagcaacaaagcgagaccttgtctcaaaaaacagttatttttcataaaaaatattatttatggttgcagtaatgggtgtattattttaaatgaattaataattttgaagttttctttgtaatttcaaatatgataaatacagataaaatctcgaggtcttcagtattttgagtgtaaaagtgtcctcagataaaaaaggtcggaggatagctgaattacagtgttgtttaggtctgtactgtatggtagccactagccgcatgtatctgagtacttaaaatgtagctaagaaactcaatttttaattttaattaatttaaacttaatttctggctgatctcatcttgcagagggcagttcgctctccccctccgagagtgtaaaaaaaaaaaaaaagaattgccattctttttcctttttatactttataatgcaagtatattgattaaaaggtcaagggggaaaaggtgaagatggagtattccagacctttaattaccttttccccctttttattgccttcatttgtattcttcatttacctattactggtatagctttggggcattagaggataagtagtggtaaatcgggtgctgcagttgactgaagaccttgtactattagtttatagtgttgcttataggagaataccactatcacctaatgaagtgttttctaattttttttcactgctctcaaactaaattgctactaaattttatttttgacttgagaacatttttatgaactagatccattgccagcattcttttatgcaaagctgagaggtatgcctcttgtcagacttaattaccaagtttggtattttgtaacagctgttgagtgagtctggaatagtcttcagtaccatacaaacaccggttgattagaaagatagaaatggaacaagaagatatttaccaatattaaatgaaggtacaagcaaatattatttttggtactgtaataaaaagtaaaacagttcttgaaatttatttcaagggggattgaccagcaatagccactaccagtggtaactagaaaatgatacctgtcagactacttttagcttcattgtttctatttttaaaatgagttatttattttttccttctataaatttcatagatgtagaaagataccagtaagtcaagttttaagtaagataaggaattctacttttcagctcttgcttgtagcttgcgtactttgattgcacgacactgttaaattcatgcttattcttaaatgtgcaaaattatagtttaaattttatttgaattattgatctgaacaaaatagtatttttttttgaattacagacacaagtaggagaaatatttcttaaatttctgttaaaagttacttgacttatgtaaacaaaaataaaaagatagtgctcacttttacaaaatgtgttaagttttggaaactggcattagtacattattgtaaattgatctgagaacagcctcttagatttttgtattttgcattattttagttagtaaataaaaatgatgagataaaattagtaagcagtaaaaaagtaatcagtgttcctcttaacatgcttgtaacttacaaagtaagtttattttacatttttatttagttttgaaatatcttccatttaatgctctctgaactgtagattgagtgttctaaaatctgaaactgagcactgatgtgacactcgaagtgctcattaaagcattttggatttttagatttgggatgttccactggaaatatatagtgcagatatatatttttttaaattcgaaatctgaaacacttctggtcctaagcattttggataaggcatgcccaacctatagtagtataagcttcatgaggccagaaatctgttcacacttgtgtcaggtttatagcacagggtctgggcacatggtaaatgtcagcaacgatttgtcagttgtacgtagagtattagatcttctggctgataacttcataggtaatttatgcatattttatgttgtcatcgtaaatttaaagtatgaatgagtaaattttctaagtatgtattttactctgtaaatataaaatatttctgagatataatatgttgaattttaggggggaaggggaagttgaggtcagaaatatgtgcaagaattacaccttgaagaagtaatttccattgacataacaattttaataacacaaaatcatggttttgaaaatgtgcctcaaactatgtaagaattcagggcacgtaatatgtaactgttaggcaaatttcattttgtttataacttgaaacattaaaaaaactggtaaaattctcttgctgtattattattgaatacttgaagctctgattttaatatggtaaagttttagggtgtgtcttaatacaattacataaggaattagtttgcccaggatagtttattaatagcacctaagacaagagctaaattgcaacacaagcagactttaaagagaatgcttgctagaataaattttaaaaactggagaattgaaggttttttttttttcttagtgtatgtgagtattgtagggaggcactttgaaaacaataattgagaatgataatatgtcttatacttaataatgctaagttttcttaaagttgagctacacaggctgattgaatcctttgcttcagtgaagctgcagataagagtaagcagggtcacctaaagatagatttacttagaggtttggctgcctctctggaaccatttagctttgaacagatttccataaatggaaagagcaactggagagacccagtaccttgtggatgatgtgcaacaggtggtaaaacagtcattggatttttaaaataaatgctttccaaatgactgttgtttaagactgaggctttagcatttagggaactttgagatgaactggattttttcccccaattaaaagtttcctggaaacaattttaaaagattcatatcgttagtgtatagtgcttatgaatttgtaatatgactttatgaaatttgtataaacatttacttttagttcctttaggggacatcttaaaaaaaatctgtcaagttagagactcttaaatattcatgtttcagaacgtcttactaagttaactgttcaacattttaagtcaggatgtgaaattaatatattattaagataataaaatttgttcttgaattgctgattttcttgtaaggtcagtgggttgtccttaattcagtacataaaataaatacctgcctggcgtgatggctcatgcctgtaatcccagcactttgagaggccgaggcgggtgtatcacctgaggtcaggagttcaaaaccagcctggccaacatggtgaaaccccgtctctactaaaatacaaaaattaatccggtatggtggcatgtgcctgtaatcccagctactcaggaggctgaggcagaagaatcgcttgaacctgagaggtggaggttgcagtgagctagatcatgccactgcactccagcctgggcaacagagcgagactccgtctcaaaaaaaataaaaataaaaatccgcatgtctgctccatgaaaagtctatgttgggaaccatggcatatgtaaagatgggttaagctagccccccagacctcaagaagtttataatcttacaggaatgataagaaattatcatattcttgctctatgagagagattaagttgcttacctcaggtaacagaaataagtggcagagactggaacccaagctgttggacctgaaagcccaaaccactgactgctgtacacattgttttacaagtaacataatcagcaaagcataaaggaagtgctagaagaggagagatacaaagcgtggtagaatttgaaggcctcatgggaagaataaactctaagaaaaagtcttaggttaaaacccactgaggctctgaagagagcgaggttaattataaagaaagttctcaagtactctggcagtaaatataatgcatgttgttatccatctttagtcacctctgcctggagagtacagttgtccctcagtatacctggggtattggttccaggatgtctcctccacctggcagataccaaaatcctagaatgctcagtcaagtcccttatacaaaatgctgtagtatttacactgtatttttaattgttgtattttttttattgcctccccctcccctgcaatattttctttttgttttttttttttgagacagtgtctcactctgtcgcccaggctggagtgcaatggtgtgatcttggctcactgcaacctccgcctcccaggttcaagcgattctcctgcctcagcctcctgagtagctgggactacaggtgcccgccaccacgcccggctaatttttatgtttttgatagagatggagtttcaccatgtttgtcaggatggtctcgatctcttgacctcgtgatccggacgccttggcctctcaaagtgcttacaggtgtgagccaccacacccggcccccctgcaatattttcaatctgaggttgtttgactctgctgatgcggaacccttggacacggagggcttactctactcagtcattcaagagggtctgtaagaattgaattaattgattaaattagcgcagcatggttctgttaggtgccctggctttaatggcaatacatcaaaatatataattgccctcacagggtttttaatctacaaccagcctctccctgacccttcctcccttcccacaagttagtattggcctaaaattgatgcagggttcaaatttcaaggatctttctttgttttcctttgagtaagattcagaaacttctcagtaatttcttttgttgttgttgttttgagacagagtctcactctgtcgcccaggctggagcgcagtggtgcgatctcagctcactgcaacctctacctcctgggttcaagcgattctccagcctcagcctcttgagtagctgggattacaggcatgtgccaccacgctcagctaatttttctattttttggtagagacggggtttcaccatgttggtcaggctggtcttcaactcctgaccaaggtctaccctccttggcctcccagagtgctgggattacaggcatgaaccaccatgcctggccaacttctcagtaatttctaatcaatgtcattggttacttcataatcaatattcattttatatcagtattcattttataaaatgtagatattagctttttaaaaattatttctgtaatttatatagacgaatagatatcaatggcttagagttagtcatgttattttatatttatttatttttcatttctctttcaggagtgaatatgtttatttcttagtaatatgttttagtcatgtgtttagtgtatttttaattgagtagaacttatttttcctccagtggaagcatcagttcacagcagtaatgcacactgtacagataagacaattgaagctgctgaagccctgcttcatatggaatctcctacctgcttgagggattcaagaagtcctggtatgtaaactgttcattcttatgttaaacgtgtcatactacttcatatgtctaaaataaagttttttgtttttttaatccaatggaattgttgggaattctcaaaggtacattacacatgaatacatgacagcagtaattgaactttatttgtcaaggcctccaagtcttaaatacttaattttcataacaaatgatacagaaaatacccactatagatagacaaatatttattaaatagctatttgtactgtcatgtctatttccttaactctgggcaagttataagccttcatagtccttcagagtatgatagatgggagcagttgcctgttaggaccactttcaatcctttattcaatgataaataggcagtaactccagagaaccacacatggtagagagacaagggagcttttgacatttttttcacacatccttcagtgtgagtttttatttttttgtggtccctcttagtctttaagaaaaactttgatagtcattttgtccaatcctgatttgtcctaattttaatttaatgcccaaatgttaatttgacttgatacaaaaatactggctcaccttctcattgggatttacaataagagcaaccatacttcttaatttgaatagaatcctgtgtattactcagagatatgagaataaatttgtagcatttttggtcagtctattaatctaagatagtatgtattaattgtatctcttaattgaaatagaaatgtcatatcttggttatttgtgcacattagaaggaagccagagcaacattactgtatgtactagaataccagataacaatttgtacctactgttttagtgactaaaacatcaggactgttacattaaataaaactttaaataccgaaaggtaatatttcttgtctgtaatgagcaagttttccttttcatattctaaaatgaactataggtgcttatgttttactgagtacatatttataaatctttcacattttgagccacatgcatatattacctgttaaaaaataatgacggatatgtggatggaaagtaattattaactaactcactattatactattattttcaaatgttttcacaactcttagaataatttagaatttttctacaattagtttgaaagtataagtgtgaaagagtggagtgactactcatgatccttgccttacccagaggattaacatttttcctttaagttgattttccatgcatttattttccttatgtagtttaaatcatatcgaatattcagcaaattaacttcttcagtattaagctcttatcctgctttgattaattcttaacacacctcgcctcttctaaatattgaactgtccacataagaaacattgatgggggtgggaaattttaatttttcaacttttttttatagtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaaggtagagtatatttatacatttctgagaaggcaggtgaaaatttttctcttatctttttcctcatcaagggacatagaaagtagtatatgctgtagatttaagattgatgttatcttaaccagatattctcaaagaatcaacattgagattttaaatttagtattttaacgtactcatactgtttaaaggagttagtatgtaaggcttgaggataattgcctgacaatgatatttaacaggtgttcgacacacagaaggcagatcagagattccctgcaccttgtcttactccatcttctccttgttgatccttttatgggtacttggttacttaaaaaaacacacacacacacgcacaacattttattctttattttacaaagtcttgtcttcccttgctttcatggatattttttaaaaagccaggcacgcctttagtcccagctgctcaggaggtgagaggatttcgtgagcgcaggagtttgaggccaacctgggcaacatagcaagaccctatctcaaaaaacctaaataaacagtgatatatatatgatatatatcatattcatatatagtcatactaaatatatatatcatttatatcatactatatacaatattcacatttattatatatcatgctatttttaccttataccttctgctttgaaacactaagattgctgatagagacttctgattgacctaaactcaccagtgggtaaagagcatttccacttactatttgacttctgctgaaatttctgctccccccatcccactaccacattttcaacatcatgaggaaatgggcagtaagtgggtctttttctgttgaaatcaaaggtaaaattggaaagacatgacattctaagtaattaggtattcatctaattctcctttcttctctaactcttcacattttagagtaaaatgcaaaaataaaggtgggtttgaaataatggtattttcttttcttcattaaatatagtgtttcagattgccacagtgtgtaccattctgtggtcattgttgtaagggagatgagaataagacagtgtcttcccacttgtaatacatgtagattatatgcatctcaagagaggtatacatgagagaatttaggaggaagagttacttcctgatgtaagcatttaaaaacaaaaggcatacatataaatagccttatttacccactgcctgctatagcacttggctggttgcatccaatgagagctgtcacaaaatacttaggaaatgtttgtttagatttaataccaggcatgatggctcacgtctgtaatcccagcactttgggggtctgaggtgggtggatcacttgaggtcaggagttcaagaccagcctggtcaacatgatgaaaccctgtctctactaaaaatacaaaacttagccagccgtggtgttgcatgcctgtagtcccagcttttcgggaggctgaggcaggagaatcgcttgaacccgagaggtggaggttgtagtgagccgagattgcaccagtgtactccagcctgggtgacagagtaagactctgtctcaaaaaaaaaaacaccacatttaaaagaagatggaaaacaccatgaaaaacaggggccatgtagggagccaggatgtgatatgatataatccaggaaatactttgccaatttaatacaattttatttatttctgtgaaagctcttagtgaccatttaaaaattacaaggctgggtgtggtggctcaggcctgtaattccagcactttgggaggctgaggcaggaggattgcttgagctcaggagttcaagaccagcctgggccaacatagtgagacctcatctcgaggaataaaaaaaaaaattagccaggtatggtggcacatgcctgtagtcctagctactcgggaggctgaggcaggaggatcacttaagcctgggaggctacaatgagccataatcgtgccactgcattccagcctgggcgacagagtgagaccctgtctcaaagaaaaaaaaaaaatacatgtaaccattctgtctgtacttactaccataagggagacaatgaagaataagagtatcgttatttatatttttgtggttaagtacatttgggatatacaaacttagataggttcttttttaatagcagtacttctttttattttgagagcctttaatatactaatgtgcattgtggatcttgctgtcttccaagagaagatagcatatggtgttctaaaagttaatatgactatagaacccattttcctatggaggaaatttatcaaggaacatgactttggacgtgccgctttatgagaaaatatattaagcctttttgcactaacttttctactaagttgggcttttgtgctagaatttaggagatgctgaagatgttagttttattactgtctgattcatatgtataaatattatttacattgagtaattaagctgtattctaacagagaccagtgaactttctgttttactttttgttaaaacagacttctgattacaattaccagaattctaaagtatatctgtgcattttgaaatacagatgttaagatgctttaattagctctttatataattaatctaatgcttcctaatgaagaatagagtgacatcagaaatctcagatgtagaacagtcaccaaatcagtaataatatatttgatcctaaaatatggccgggtgctgtggctcgtgtctgtaatcccagcactttgggaggctgaggcgggcagatttcctgatctcaggagttcaagaccagcctgggcaacatggtaaaacccatctctacaaaaaatacaaaaattagctggacgtggtggtgcacacctgtagtcccagctacttagggggctgaggtgggaggattgcttgagcccaggctgtagggagctgtgttcgcgtcactgcgctccagtctgggtgacagagtgagactccatctcttaaaaaaaaaaaaagtgtatgtatttatgtgtgtgtatatatatgtatttgattttaaaatacaacatacttaagtattcccaatttatttcttgagtctgcctctcacctgccagtgttcatttgtgctcaggattgaatataactaatttcaggcttaatcctctttcgtgtagaaaagtatatagcccttactttttctattcattgtggatgctagtctgtctgagagagccttatggcaaaaatgaggaggaacaaaagggaaggacacaaacctttattagacatatgaaatcacttggaagttttttttagccttgtgatgtatctgcatgtggaagtggggaaattgaaacacttatgcttgaattctggtgaattaactgatccagagcagtagagagtgtttgatattttttacttttcctcatttgagttcaaagggctttgcaaattatcagatcttctgcaataagttgctaaagctgtttctcaccatcctgtagaacagaaaacaaattaagtttttactaggatttgtttctattgctacactaatataaaagattggcaaggccgggtacagtggctcacgcctgtaatcccagcactttgggaggccgaggcggacggatcacgaggtcaggagatcgagaccatctggctaatacggtgaaaccccgtctctactaaaaatacaaaaaattgactgggtgtggtagcaggcgcctgtagtcccaactacttgggaggctgagacaggagaattgcttgaactcgggaggcagaggttgcagtgagcggagatcgtgcactccagcctgggcgacagagcaagactctgtctcaaaaaaaaaaaagattggcaaatcaaggctctgaccaatgtatatggcaatcgaggctctgccaatgtgtatgacagagattactactaactgctgtaatctaaaatacaaaagtgtttgtaatactccttttagaagcagcttttcatagagtatattcatctacaaattagtatccatttaaatgaataatgtgtaatcagaaagtctgctaatcgtgcctctcatatttttcttgttttcaacgtatggtttcaatatcttattttttcagttggccgtaaaccaaagacccagcaatcaccaatttccaatgggtctcctgagttaggtataaagaagaaaccaagagaaggaaaaggtaatttggggagggttgctttggaagtgagatgattttttttcagttaggtgacatttttgtatttgtaagaaaactatttctagtacatgcacatatgagaatactgtcgctggtaatagttcttaataagggatgtatcagcatcacgtggggagctttttcaaaatatctgtgcccagttcctacaccacagagattctgtaaccatagttgtatcatgggggatatagggacttggaaaaagtccaaaggatgtctgatacatatcctccttaagaaccattgacttacaggataatagcacccatcctcatatatagctacccataattcaaaggggtttacaactaaaccttgtttctaataatttctttcttttcttatttttgtgagacagtgtcttgctctgttgcccaggctggtgtgtggtggtgtgatcatggcacattgcagccttgacctcctggtcttaagtaatctttccgcctcagccttctgagttgctgggaccacaggcacatgccaccatgcctggctaatttctttctttctttttttttttttaattttttgtatagatgaggtctcactgtcattcaggcaggtcttaaactcctaggctcaagtgatccttctgcctcagcctctgaaagtgctgggactataggcatgagccactgcaactagcctgatacataacttcttaactgtttagaagaattcaaggtgagctaaatttaattttccaatcaataaatgtcagtcacatcagtcacaattcagaacaaaaccatgtttttgcttatttattgacttatttttacagacagggctagaatgcagtggcatgaccatacctcactgcagccttgcgctactgtgcttgtagcctcccaagtagctgggactacacgcacacaccaccgcacccagctaatttgttttttttttttttaagagatgggggtcttgtgctttgttgcccaggcggatctcgaattcctagcttcaagagatcctccggcctcacactcccagagtgctgagattataagcgtgagccactgccccttgcctatttttgctttagaatttgtgtatcctgattaaaaatgaaaacagcaccaaacctcccccattctgtgctttcctaatttgtggagtaagatgatttcaagtaacatttctttttaaaattatttttattatcttttttttttaattttaaaatcttttgtagaaacagagtgcccctgttttgcccaggcttgtcccaaacccctcgcctcaagcgatcctcccatcttggcctcccaaagtgttgggattatagacatgagccaccgtacctggcctttaattttcttgtcactcagattctgacagataaagtatcatttcagtagtggttttagatgtgttctgtctgcccatctgataaccgaaaatttatcactttcatgaataagtgttttcagaccaatattcaatagttggataaattttacattaatatatttaaatttattctgtccttatcaggtggtttgatttaataattttaaataattaaaacagaaattaagtctagtttaaaaaaaattgtctccagtaagcctaccaagaaatttggtatttcattaggtcaaaaaaaaaaaaaaaaaaggtgacattgaacacattcaggaactggtgacccaatttgggagaggcttaggatacttttcttatttccttgtttgtctttggttgttgtacacttctaacatcttaggtttcttcttttagtttatattgaaaactttaaaagttaacatagtatgtattagaaaattaaactgtaaatatacagttattactgttgtctttttaaataattcttatcctcagtggtatcacttatacttgaatatcttttgcttaacgctggagaaaaactgtgaccagtttttaccaattaaaatcacatctcattacaatttcagtcttgtattaaatttgaggcagtgtgttataatgtaattaattgaagctgttacagtcaaacctgtattcaaagtccagccagtgttttttcttctgtaaaattgtgataatagtcataggcaaattccttattacctggtaaagaaagcttctctttctgaatcctgttttccctaaaaccagaaatataatttttaataatttttttctatagagacagggtctcactctgtcacctaggctggaatacagtgacaggatcataactcattgcagcctcagcctcccaggctaaagtattcttctgcctcagcctcccaagtagctgggaccacaggcacataccaccgtgtctggctaattttaaaattttttgtagagacgggtccccctatgttgcctaggctattctcatactcctaggctcaagtgatccttcagccttggcctccttagaattgttcattttaacttggggatggcaacatgggtgcagtgagtgtttaaagataatatgagggattttgatgagtttaattcaaaacatggaaacattcagatatcttatgtacagggcattgtctatgttatacaaacatttcttccagagtaaaatctttgctcacatttactactatgtgaacaaaataaaaatgcaaaaaaaagaaaataactgaagattatacatggtttgttttaatagtttttaggtagtgatgctggtgtaatagggtcctagagatacaaatgtaactttgtaaagttaaaagtcattttttttgttttgttttgttttgttttgttttttgaggtggagtttcgctcttgttgcccaggctggagtgcaatggcatgatctcagttcactgcaacctctgcctcccgggttcaagcgattctcctgcctcagcctcctgagtagctgggattacagacatgtggcaccacgcccggctaatttttatatttttagtagagatggggtttctccatgtcggtcaggttggtctcaaactcccgacctcaggtgatccgcccgccacggcctcccaaagtgctgggattacacacatgagccaacacgcccggccgaaggtcagctttttcaggtcagtagatgcataatgggttgaactctgtgttattaatgaatttactggattttcagagaaagccacaatgaaagtgaaatgccagagacaaaacatcagtactttgactgaaggtgttggggtagtgctggcttgttttggaagcttcccacatagcctgtatcttagaactggatttaaggatagtaaacgaatagtgcatggaatcctacagatgacctatctttttcgtctcaggactcttttctgttctttttttcttgagacggagtctcgttctgtcgctcaggcagtgcggtgcagtgcagtggcgtgatctctgctcactgcaacatccgcctcctgggttcaagggattctcctgcctctgccttgcgagtagctgggattacaggcacccgccatcatgcctggctaatttttgtatttttgtagagatagggttttaccatgttggccaggctggtcatgaactcctgacctcaggtgatccacccaccttggcctcccaaaatgctgggattacaggcgtgagccacctcgtccagccttctgttcttctattaataagaaccttggcacctagaggttatgaagggaataaaataaaaacaatctgaaaagcgtcttctaatgaccgctgcctactactctctcctccataataagggagaaaaaagtgtgatactttcttccttttgggattaagttttttttttttacttgcccagattcctttttgttcttttatgcacatcctagccatcttccaagacttcatgatggcctcccagtccactttattttcactcttggaatcccacagacatattttctagattatttggaatataattaattatgcattgctttgtgatagatcttatattgtttcaaattgttatttatttcttgcattgttgtttaacttgtcatctactttctttccccttctcaactaaattataaattccttgaggcagggaccaggttttaaattcatctccttaagcatggtatgcgatgaataagcattttattctgcagaaatattctaatatttcctcattttaaaattttactagtagtgtgatccagagctaatgttacagttaacatttgatgaatacttgactaattttaaggaattaccatatttttccattttaggacctcagaatttaagatataagtatatataatgaaatcctttaaacattatcttccgtctattgggtgtaatcagtagaaagcgattagaaaatttttttaaatctgtttttagaggcagtaatgttcttttttctttcttttttcctgtgacagggtttcactctgtcgcccaggctggagtgcagtggtgcgatctcagctcactgtaacctctgcttcctgggttcaagcgattctcatgcctcagcctcccaagtaactgggattacaggtgcacgccaccatgcgcagctaaattttatatttttagtagagatggggtttcaccatgttggccaggctggtctcgaactcctgacctcacgtgatacgcccgcctcctggcctcccaaagtgctgggattacaggtgtgagccaccacaccccgccaacagtaatgttctttgctatcaagtcttaattgactggtagtacagaggaaaatgataagaaaatccttaaagggttgagggtagtttgcacttaataatacatatacctcagagttcatgcctgtaggtgaatcaaagaaaagtaagtttcttacaaaaagaccctaggtctgatgcctaaaagttttacacatttcgttgtattttgcttgtgtatccaataaaattactaagtcccttttggtgaattttgatcatggaatttaggcttatcatatgataaaggtgtaaataaatttattcagtttaaatctgtataaactaataaatttgattctgtttaattcaggttaactttgcctaagcaattatgcctttgcctttactgaactcaaaatctaggatagtgtgatatgtaatagtataaaagccagaacctgtattttagcatcataactgtaagcatacataggggataccatttttttaaaagtagaaacaggccggacacagtggctcacgcctgtaatcccagcattttgggaggctgaggcaggcggatcacctgaggtcaggagttcaagaccagcctggccaacatggtgaaaccctgtctctaccaaaaatacaaaaattagccgggtgtggtggaatgtgcctgtaatcccagctactcgggaggccgaggcaggagaattgcttgaacctgggaggtggaggttgcagtgagccaagattgtgccactgcactccagcctgggcgacagagcaagactccgtctccaaaaaaaaaaaaagtagaaacaagtatattcaggatttttatgatacaatgaaggacactttatttgcttttaattatgtatttaattatgttaatgaattttaatcaatgtctgtcattgtttttaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgaggtaaaaactcaaatgagctagtattcaaacaaaatttatgtatttctttatatgtctattagctgtttaaagagaagctgaaaatcctttacaacttttaactttgggggatattctagaggagcttcttagatttggaagtaggtggggagataggagtttggtctacgtgcttataattttaacataattggaaaattcatttttgcagaaaatgtgcttttgtacttaggagtgtttcttaatagaaattatgaagttgtaggcttaaaaaaaaattaaacctaaacaaattatggttcctaaagttagtttgttttttagtttttaggggtttgttataaatggatttatgttgataggaaaatttatcttaagttttatcagtttggctgggcatggtggctcacgcctataatgccagaactgtgggaggctgagttgggtggatcacttgaggtcaggagtttaagaccagcctggccaacatggggaaatcctgtctctactaaaaatacaaaaattagccgggcctggtggcgctcgcctgtaatcccagctattcgggaggctgaggtaagagaatcgcttgaacccaggaagcggaggttgcagtgagccaagattgtgccattgcactgcagcctgggtgacagagcgagactctcaaaaaaaaaaaaaaaaaaattatcagtttgataaacccacaaaattctttcattgtaaagtacatggcttcttctaattaagggtgtttttaagtgaacacattgtttatgtgacagtattcacatatctctactaagtaagtgtggcttaggtaatttttccagtaatatcagtttgttgttacaacctatgtaaatcagaaaataatttctaccattgtcagtatagtaaaatagtcaacggtaaggtaaattatttcttttaagaaaaagaatgaactttcagccagtttatagaccttaagtttgtaggaccttggccccaggttccaacttgattcctactctaaatttgtaaccttttgagcaatctaggcagtaagagtttgtttttttctcatctgttattagagataagggaatgtttctgttagtatccactgtatgtggtctttttggcgggggtggagtggggtgaagaaataatatacttgattcatttggtacattttccccttacagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggtaagtgaagcaaaccattagttacaatgtatttactttttaaaaaagtctccgtggtgaaaacaaaatgtccttttgcttaatattagtgttctaagaacccagtgttgtcaggactttgaaaagtgcttgatgttttaattatattttttattgttgttaaagtagatgtcttgctgggttcagtggttcacgcctataatcatagccctttgggagtccaagacaggaggattgcttgaggacaggaggtcaacacaagctttggcaacgtagtgagacctcctctctataaaataaaaataaaaaattgctgagcatggtggcacacacctgtagtcctaactactgaggaagctaaggcaggagagtcacttgagcttaggagttggaggttgtagtgagctaagattgcaccactatactccagcctaggtgacagactgagaccttatctccaaaaaaaaaaaaaaagtagatgtcttaaataacctgaattggtttttatggttttatagatggagcttaatgtaggctttagtttttaaaatatatcatggtatgtttgtgtcaaacatcagggattgccagtacctctgtaaaatttgggagcactaattttacacattttggatttgtattaatcttttactcaggagacctattttctcagttggcattaaatataatcagcttttttctttctaatgtactaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggattgaaagggaccaagtagctcactacgatatcaagttacactaaggcttggaacactaacattctgtaagaggttatatagttttcagtgggaggggttgggatgggtaatctcattgttacatatagcaatttttgatgcattttatatgcataccagcaattattactgtgtttgcacagttctcacttaactggtgctatgtgaaaactctgctaatataggtattttagaatgtgaattgaagaatggatcccaaaaacttcagaaagaggatagcaaaaaaagatctagtgcgattttatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttggcaaatatctgcatgttgccagtttctttctaattatgatgaactataatgttctgcttaacgtaatgaatttagtattttagttggctgcacttaaagaatttatatttgtaaaacactttaaaccatttgtttcacaatcagaccttttgtggattaaaaagaacaattactcttctagcccttttacagattaggaagttaaggtatctgaaggattacataaactatgtaattttactactgtctgtcactccatatcttaatgctctttctactacaaagaaaagttatctatttttacatgttttagaaatgtagatgaactcatacataatattttttgtcttttaattgatcacatactacttaggtcagaaattgtttataacagttccctttgtaatcttttaaacttttccataaatatattgatgatacttttatacaaaagctcaaagaaaaactcacttgattattttcccatttgggagttactctcaaattctgtctccttttaaaacatttccaaaatatttcagctttgaaaatcaatattaagtgctttggcacttaattgtattatcttgtttattgcactgtgacttcatttgtttgtcatgtcttccataatactcatttagagcaacgattatattttatgccatacctacccctctccccaagtgctgagcatattagacactcaggtcagacatttattgattttgggaacatttgctgagaatataagtcacatgcttaaatactttgcttctatgctggattcttaatcggttctaacagggttaaaccagggctatctagctacctctgctactctactggaaatttttttctctttgagaataagcacatctaaagtctagacttggagccaggtgcggtggctcacgcctgtaatcccagaactttgggagccaaggtgggtggattgcttgaggccaagagtttgagaccagcctggccaacatggtgaaaccccgtctctactaaaaatacaaaaattatccgggagtggtggtgcaatgtttgtaatcccagctcctcaggagtctgaggcacaagaatctcttgaatctgggaggtggaggttgcagtgagccaagatgatgccactgcactcccttcagcctgggtgacagcgagattctgtctcaaaaaaaaagtctagacttggaaacatacatgttgacagtatatactgatcagaatgttgcagattgaaattaatgatgtgcctcacccccatccttcctgcccttttaatgctatggcttttaatctcagcccttccaaactataaatcaatataatttatagttgcttttttgtgtccagtgtattagagggaaaaaaccccacataaccttggcttgatgctactacattttccagcctcactagatctttaaattatgatcagtagtctatcaatttattctttaggccactttccagcatcaattccagccttcaccacccttgtcaccagataaccagtatacctctacagagaacatggtcatgagctgtgaattctctccattcctggaccccttgttacagatgatttagttactccaacatccatccttaccacctgtctcaggaaggaggtgcccttcctcctgtgcccagcatctccctttcacacctacttggtctccttgctccaacaattaatagcctatctttctgtcccttctttttcttcaaatagcctgcagtctgaattcttgcttagaaacagttctccatgagatctccagtaacccaactgtcaaattaaacggacactttggttcacttaatctcatggcctacttctcaaaacttacttggtttcccatgtttacttcctgcctaaccaacttgttttttctttgttctttctgcctatgggcttctttcttcttttcctcatagaattgttgtcaggattaaatgagttaatatattaaggatttgtaactagtgtctggcacatagaaaacactcttattagacgtttactattatttcactaacataattgttagataatctcacccatgcctatggtttttactaccaaatctattgttaaagcctagacttttatgctgtcattttttttctctgttggaatgcttcatgaaattgcgtgtcatccttgtgcaggggctgtgttaatctgtgtatcgttccagtattaggatatgtgctgctgaagcaggcactactgtatcttaggtgggtttatctaattgccactggctgtttcttcctgagtatccatttgagctctcttccctccaaaatctgtttctcttagcccaataaataataccagcaacccattactcatactagaagcaacctgggggccatcctagatactttacctcctctaatcattaaccaaatttctactcatagtaccttctaaatactttcttttccatcctccctgtctttgtctcaccaagtctctctctaatccattctccaggctaccagttgagagctttctaaatgcagctttcatcactcatgaacctttgtgattgcttcagattcttcaatggcatctcttgctaaaaagatatgcctaagcatagcaattaaagtcctttgatctgggctcctcctgtctccccaagcctcattctcttgctactcctcttttagacttacttgggctatatttcattttttcccaaatattctaggcattcatacctcatgagtcatccattgatggcttctttctggacaactcgttcctccttcacctacattggagttcagttttatttactgagatatgaggtgacagacatcaaaataaaagtttctgaaataggtgtggaaaccattcaggttggggagtgatctgtgagttagctcagaacttaaagagtagaaagagtaaagtatataaagataggttgggggagaagaaaaagaatcagcaacggatgtcaaggactattcatagagaataaacaggacagataaggtaacatttcaggatatggtggcaacatcaagtggagaaaggcaaagcaaatcaggctaaagaaaaagccactgagcttaacactgacaatgagagggcagttccagtgaggtgtggtggtgaagccagaatgtaagggatggggcacttggtacattacttagtggcctgtctgacaccgcatacacgcaggagtgtacatttctgatcacattaacaagtcatgtgtaattactaagacaaactaaagaaaattttggccttggagttatttataaggtctcttatgatccttttgcttttaagtctcctatcctacttttatgagggtactacagagcactttatttttggcaggcaagagtaaccctttagttccacagctatcaaagcaactttcccttttattgtagcttttaaccattcaaagtactgcaagtcttcagtggttgtgattcatctagtcttcagcccctttgttacaatcactgtcccccataattaaaacatactctgtaggaactcagtacactgtgatgccagccctaatggtagaataagatactgctcaccctttacaagggcactgatttgcctcctatctgtgtcacacctccaaacctttgaaacactcacgtgcagcagggagacttatttgagcacccataactatctttctgaacactgcaactcagtagtaatgctttgggttcaagactaaaaaacaatacatcacagcttccaaagggaaaatataatacaagtaaaacattgcttggccatgcgtgtggctcatgcctgtaatcccagcactttggcaggccaaggcgggtggatcatgagttcaggagattgagaccatcctggctaacacagtgaaagcccatctctactaaaaatacaaaaaattagcagggtgtggtggcgcatgcctataatcccagctactcaggaggctgaggcaggagaattacttgaacctgagagacagaggttgcaatgagccgagatggcgtcactgcactccagcctgggcgacagagcgagactctgtctcaaaaaaaacccaaaaaaccataattgcttaatgcaaaatactgcatatcaaagacaaaacaaagctgtgaattataaataggctgtaaactaacagcagagttaactttctcccaagataattgttcacatccattgcactgtagaatctttattttttgagacagagtctctctctgtcacccaggctggagtgcactggcgccatcttggctcactgcaacctccgcctcctgggttcaaatgattctcctgcttcagcctcctgagtagctgggattacaggcatgcacaaccacgcctggctaattttttatattttcagtagagacggggtttcaccatgttggccaggctggtctcaaactcctgatctcaggtgatccacctgcctcagcttcccaaagtgctggcattataggcgtgagccatcacacccggcctgcactgtcttaactttgagaaacttgtctatttcaggtaagtgatactgtcactgcccaaaaaggaaaaatactaatctatataatctgtaaattatttctgaattgtaggacattaattcacttgaatcccgtggttactttgcctcacattagaaatagctgggaagcttttcataagcctgtgtcttagctcctactccataccaattaagtcagtgtttgggaaagggagccaggcatctttatttttaaaatatctctaggtgatttcattgtgcagcaacattttagaaccactgccttatagttacaataaagaaagcgttaacatttagggttctgtgttccaacccaagtgttccaaaaatggaaaaaggtagtttgagatatagtattacaaatagcttttttaaaacctacatactgtgtattttatcgattctaaagcctttttcttatatttaacatgtctttaattaggatgactttgtaagagtcttatgaaacagtacaccaagttaatgtgccttgtctcttcaaagaaattactctggaaagctatatgctaattctaataatgttaccattcaaaatacttttaaatggctttttagaggagaatctaaattttacatatatttaacagagacaaatttcctgttgaagattttagttttaaaaagagctgtgtcatttgaagttaatgtgatgtgaatcaagctaggtaatgtcgtacttggttcaaatggagatgtggctatgagattgacacaagttttcttaagagcttcatcaaacatatggaagcagttccaaaaagtttcccaaatatttttgggcagtggcagcagtaactcagagttttaaaattcaaatcagaattttaagaaaccttagagattattcctttattacaaatgaagaacctaaggttcaggaaaacttttgacgcatcagttggttcagatagtcagtggcagaactgcaaagaactcgccctctgactcccagttgagttttagcctgaacccccattcactcccatccaaaaacaagtgggggtgggggttgcagggagggaaacaagtttcccacaaactgaattttaaaatattgcagaattttgctgggtgttctctgcaggtttaccagtctgtggaaaccagaatcagatgtcagacatacatgttccttatgtgcagtcttccaccatcttccttttttttttttggagacagtctagctctgtcatccaggctggaatgtagtggcacgatctcagctcactgcaacctgtgcctcccaggttcaagcaataatactcccatctcatcccctggaatagctaggattaggcgcctgccaacatgcctggctaatttttgtgtttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtctctactaaaaacagcaaaaaaattagccaggcatggtggcgcatgcctgcaatcccagctactcgggaggctgaggcaggagaattgcttgaacctgggaggcggaggttgcggtgagccggaattgcgccattgcactccagcctcggcaacaaaagcaaaactccgtctcaaaaaaaaaaaaaaaaaaaaaaaaagccgggcgcggtagctcagctcaagcctgtaatcccagcactttgggaggccgaggcgggcagatcacgtggtcaggagatcaagaccatcctggctaacacggtgaaacccccgtctctactaaaaatacaaaaaaattagccgggcgtggtggctggcgcctgtagtcccagctactcgggaggctgaggcaggagaatggcgtgaacccgggaggaggagcttgcagtgagccaagatcgcgccactgcagtccagcccgggcgacagagcgagactccgtctcaaaaaaaaaaaaaaaaaaagaataaatggaagtcaacaaaaacaggtacaagaaatttcagtgaagaaaaaaggaattttaaataaattaacaaaagaaaactaatagaatatatgctgtaaagtgttacacagtcattaaaatgcagctatatactggctttgaatatattggcagccaataaagataaattaaccagttgagattcatacagtccaagtttaccagatgcttaggagacgcaaagctttgcctagcattctgtcaagaaaggttttgctgtctgtgtgactaatcttacatgaatgttttcccagaattgagttttccaaagaaatatgggaacaaggggctggagttgtgggtattctgttttgtcattcaaaggcagatctttctacattacaaatcaaagtacaactgacaacctctcgaaattgaagaacctaagcactagcccacaacctcacatctgcctagaggaacaactgggtagaaaagaccaaccaaccaatcttttgcccttcagtcagcccttctgcctattttgggcttaaatttctataaacacttagttctgccctttcaaattgaagggttattctctttggtgaaaaaattaggagtgggttgttacgacatgaaatacagagggcccttcccttttttgttttgaaacttagccattattattgtgtgacttacaatatgtattttaaaatttatattattttacagatctcacaaatctatgaggttgagagggcagatatactctatggatgagaaaacttaggctctactcgttcagggtcacactggtgacagctaagtcttttcagttacagcctgtgccctttgacatgttgcttttttcctctccccttattgtacatgccctagttccaggcctttgccattctggtgtttgaccatggctcacaaatctcttgctaatatctatccactccaggtaaaaagtctgcctgtcctatatttttatacatgtcattttaaagaaagagttgattagagctccttatgcatgcacattcatttcttggatgtctttccttttttaaaactgaaatcatgttttagttttctctctttttagaatttaattcttgggaatctttcaagtctaacacacatgataaataatgcatatatatgtaactatatgcaacattcccttcattataaatcttgactgttttaaaaaatggtttgaatacagaatatttgcatcagttttttcctttaatttgaaatactagagtagctgttcttattgcttcctttaaaaactacgattgaagtacacaaacagtatcaaatgttctactttgggcaaaactagactttactgtatcagaaaactggaaatccaggccgggtgtggtggctcacgcctgtaattccagctactagggaggctgaggcaggagaatcacttgaacctgggaggcggaggtcgcagtgagctgagatcgcacctctgcactccagcccaggcaacagagtgagactccatcttaaaaaaaaaaaaaaaaaaaaaaaacccactggaaatccattatattccagtattcagccaccatatcctgcttctagtctaacactgtatgtatgatagttcatgtgtatttgacttacatgtttgaccatttgaccatgtttaacaaatctcttgctacactgcaatgtctattctccccgtttgtgttcactcaaagccaaagaaatggtggtggggaagaagcaagcactttggaatccagacagacctgagtttgaatcctgactcagctactatttatttgctatcactttgctcaaattatttgaccttttgagcccccgtctatagtttagttttaagatcgtatgtaaagctcttggagtcaaaggaactcaaatgttaatttcatcatatgtatacaccataatgccttatttaaataaacaatccagtcagtcgttactaccaccatgtactacggtatctactgaaatgtggcatgaaggaaaccaaaactcatgccattcctactccctcttcaaatttgcaatttaccttctgagactctgacaaaacagtgtatgggaaaatagaaaaataaaaaccagaaacaatagtatatagggtataataggaaaagcagaatgaaaggtacatatggatggaataagggatctatgcaaggaacatgcaacttagggtggggcacagtggctcatggctgtaatcccagcactttgggaggtggaggtaggaggatcacttgaacccaggagtttgggaccagcctgggcaatgtgatgaaaccccatctctacaaaaaagtaaaaaattttagctgggcatggtttcacgtgcctgtggtcccagcagctcgggagactgaggtgggaggatcactggagcccgtggggtagactacagtgagccatgatcacaccactgcactgcagcctgggtgacagagcaataccgtatctcaaaagaaaagaaaaaagcaacctattaagatttatatactactaaaaaattattagaaggctcacatatgactttaaaaaaattttctttttcagttcctgataatgcatcagtgaaggatccaatctcctgcagtgataactagaaaggataactcgagagtttcactggattttttccagtccccttaactcatagtaacataccaatcatatgttggtgtttccaaaactgatttcgtctggtggcatgcccatgcacccatatgcccaccctcaactcataccctgttaattttgttggtagacaacacttgaaactcagacattattttggccttcattcttatccagatttatttatttaaggctgccatggtttctcttccggttgaagtattttggggtaggtaaacaatgtacctgcaataatgagtattctaatcagtattgttctcaacaacatatgactagcaattagtcatgctaaaatctgaaccaattctacatttggtagatgttcccgtgcttgtcattctttccagtagccccaaaattctgtgcatactatgttacttctgaaaacctcatttgttttaaaagtggttctattaaagaatgagtgatccatttcagtggacgttgttgcagctacagatctatgtacgttcacttttacagtgaaggctccatgtgtgaatggatatatgtgggtcattatgataaaacagtattaaaggagaaaatctactcccagattctttttggactacaaagacattaaaagcactaggtttaaaagaccatttattaatcttatgtatttacaactcacaaattaaaatatctattaccaataagttattttgtttggaagaggc

SEQ ID NO: 1145 - DNA, 2989 bp, Homo sapiens
gtgcgtgagtgtgtgtcggtcgcacggcgtgtgtctccggccgcgggttccgcctcctcccctgccgccgctgctcacggtgtaagtcaatgtgaagcagcagctccagccccgggataaacatggcgacgtctctgcatgagggacccacgaaccagctggatctgctcatccgggccgtggaagcatcagttcacagcagtaatgcacactgtacagataagacaattgaagctgctgaagccctgcttcatatggaatctcctacctgcttgagggattcaagaagtcctgtggaagtgtttgttcctccttgtgtatcaactccagaattcatccatgctgctatgaggccagatgtcattacagaaactgtagtggaggtgtcaactgaagagtctgaacccatggatacctctcctattccaacatcaccagatagccatgaaccaatgaaaaagaaaaaagttggccgtaaaccaaagacccagcaatcaccaatttccaatgggtctcctgagttaggtataaagaagaaaccaagagaaggaaaaggaaacacaacctatttgtgggagtttcttttagatctacttcaagataaaaatacttgtcccaggtatattaaatggactcagagagaaaaaggcatattcaagctggtggattcaaaggctgtctctaagctttggggaaagcataagaacaaaccagacatgaactatgaaaccatgggacgagctttgagatactactaccaaaggggaattcttgcaaaggttgaaggacagaggcttgtatatcagttcaaggatatgccgaaaaacatagtggtcatagatgatgacaaaagtgaaacctgtaatgaagatttagcaggaactactgatgaaaaatcattagaacgagtgtcactgtctgcagaaagtctcctgaaagcagcatcctctgttcgcagtggaaaaaattcatcccctataaactgctccagagcagagaagggtgtagctagagttgtgaatatcacttcccctgggcacgatgcttcatccaggtctcctactaccactgcatctgtgtcagcaacagcagctccaaggacagttcgtgtggcaatgcaggtacctgttgtaatgacatcattgggtcagaaaatttcaactgtggcagttcagtcagttaatgcaggtgcaccattaataaccagcactagtccaacaacagcgacctctccaaaggtagtcattcagacaatccctactgtgatgccagcttctactgaaaatggagacaaaatcaccatgcagcctgccaaaattattaccatcccagctacacagcttgcacagtgtcaactgcagacaaagtcaaatctgactggatcaggaagcattaacattgttggaaccccattggctgtgagagcacttacccctgtttcaatagcccatggtacacctgtaatgagactatcaatgcctactcagcaggcatctggccagactcctcctcgagttatcagtgcagtcataaaggggccagaggttaaatcggaagcagtggcaaaaaagcaagaacatgatgtgaaaactttgcagctagtagaagaaaaaccagcagatggaaataagacagtgacccacgtagtggttgtcagtgcgccttcagctattgcccttcctgtaactatgaaaacagaaggactagtgacatgtgagaaataaaatagcagctccaccatggacttcaggctgttagtggcagtactgacataaacatttgcaagggaagtcatcaagaaaagtcaaagaagactttaaaacatttttaatgcatatacaaaaacaatcagacttactggaaataaattacctatcccatgtttcagtgggaaatgaactacatattgagatgctgacagaaaactgcctcttacagtaggaaacaactgaacccatcaataagaaaaaggattgaaagggaccaagtagctcactacgatatcaagttacactaaggcttggaacactaacattctgtaagaggttatatagttttcagtgggaggggttgggatgggtaatctcattgttacatatagcaatttttgatgcattttatatgcataccagcaattattactgtgtttgcacagttctcacttaactggtgctatgtgaaaactctgctaatataggtattttagaatgtgaattgaagaatggatcccaaaaacttcagaaagaggatagcaaaaaaagatctagtgcgattttatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcacttggaagttcaggctcagcatgaatttttggcaggtagctctaatacctggagttttctttgtttttttttcttttttttagttgaagtttatgagggaaataccagtgttcagttttgaactataatagtttgtatattcaacatttgaagtatattctattttgttgtactcttgtttcaaagtgtattcaagtaggttttctgaaatatagaaatgaaatttatcttctgttttggtctctggtgatattttaaacaatatttaaaagtcagtatagaagtgttttagttaggaagtgataaaacatctctcttctccttcccaactactgcatgaagaaattctacttccattatattaatatttggc

SEQ ID NO: 1146 - protein, 533 aa, Homo sapiens
MATSLHEGPTNQLDLLIRAVEASVHSSNAHCTDKTIEAAEALLHMESPTCLRDSRSPVEVFVPPCVSTPEFIHAAMRPDVITETVVEVSTEESEPMDTSPIPTSPDSHEPMKKKKVGRKPKTQQSPISNGSPELGIKKKPREGKGNTTYLWEFLLDLLQDKNTCPRYIKWTQREKGIFKLVDSKAVSKLWGKHKNKPDMNYETMGRALRYYYQRGILAKVEGQRLVYQFKDMPKNIVVIDDDKSETCNEDLAGTTDEKSLERVSLSAESLLKAASSVRSGKNSSPINCSRAEKGVARVVNITSPGHDASSRSPTTTASVSATAAPRTVRVAMQVPVVMTSLGQKISTVAVQSVNAGAPLITSTSPTTATSPKVVIQTIPTVMPASTENGDKITMQPAKIITIPATQLAQCQLQTKSNLTGSGSINIVGTPLAVRALTPVSIAHGTPVMRLSMPTQQASGQTPPRVISAVIKGPEVKSEAVAKKQEHDVKTLQLVEEKPADGNKTVTHVVVVSAPSAIALPVTMKTEGLVTCEK

SEQ ID NO: 1147 - DNA, 73507 bp, Mus musculus
  misc_feature (1)...(73507): n = A,T,C or G
tgtacaggaaagtgcatggattgttaagtgtggacggcgtacgttttcacaaagtagggacctctgtgtctgcattctccacacgtcttagttaggttggtttctattactgagataaaactccatggccccagtcaacacagggagggaaacacttgtttgacttacaaatcctgagtcatattgcactgagggaagccagggtaggaactcaaggcaggaacagaagcaggggccacaaaagaaccgtccttactgacttgctcagccaactttcttagaccacctaggacctccttccgaggggcggtaccacccagtgaaccttctcacatcaatggttaatcaagaacacgtcctacagacctgcctacaggccagtctgatggaggcattttctcagttgaggttcctcttcccagatgacttagattgcatcatgttaaccaacaaaacaaaacaaaacaaaacaaaacaaaacaaaacaaaacaaaatctaactgagacagcagactatgaaacaaaactttactgacttacctctccgccctagcagggctggcccaggtggatttttctaatgttttgagtctttaggcctgggctggcctcagactcacagagatctgcctgtccttgcttgccaaatgcagggtctagaggtgtgagccacaccaggcctggtgtaacttcttgatgggaatggatgcctaggaggggcaggagcaaaaagaaaggagaccttgggatggtccccgtcttaatcaatgctaccttctccccagagccaaagcacaccagacaggaagttagcaagagacagtgggggaagatgttcatttgtttctaatatttactatggtggtttgctctcacgtggcaatagatagggagcctggctcaggctaaaatgtcaggctggatgtgccatgtcaggtcaagtagtcaaatccactgatggagtatctcacccactaccagtcaccattgtttatttctccattgttcaactcaaaatacacacaccccactcagtagatcccgtagaacctcagtgtaggtgagtgcctacagaccaagccaaaagcccaaggacagccagtcttgccatctgtgcttcagctgcaacaatgaagcaggccagctcctttatcccttagctccagtcttccagtagtgctgttgggagatgctaaagcaagaccgttcatagcgccaggcagacaaaaaaccaaccaaccaaccaaccaaccaacaagcatgagattccctgctcttgagttgggaatgaatgaagtctgaaaaggtcacagcaaggcccaacttctgctcatatgaaactcaccaccaagggcataaaaggaagcaaaaagcagactctagtcagtcaaaatagaatctgccgagtccacacatcaagttcctctacagaatcactggggcaggcacatcaggccttgctctgaacccacggagcccttctccacgcccacttcaaactcgtttgttttgaaggtttccaaaaggctggcaaagggccgggggttgcaagcatgagctaccatgcctggcttggtttggggtttctaggctgccagatcagaggaaaaagactaagatgaacataaggcaccaagggactgcagacttcccgcttttaactacaagttctggttgtcagaggaggtggagaagaagcagcgaaacagagcagacacaggttcccttcaaagccccgtagcccgagggtctctcatgtggggcaggcaatttctactggggggagagggggaggaaggtagggaaaaggagctagcgtgagagaannnnnnnnnnnnnnnnnnnntgactggttccacaagcagtcatgtctgtagctagaggtgggggatgggctcaaaagaaactcatggaattactgatctgccagagctgtttcagagtgggacctggttatgaaaggcaatgtgaagccatttatgtttttatgtatgtatgtgtgtgggtatgtatgtatgtatgtattggtagaggggtggggcttaaggaagacatcctccccctatcagaagtcttaatttctcatgttccttcagatttccctgagagcgattgtttggtaacatctagactggagttttagcagaggacaggagggagactatgtcaggaaataaagccaggagagggatatgggctcctcccagccttccagtcatagcatagcatcaggaacagtgcattccagctggcatgctgcttcacatgagacatcacagacatgcatgtgtgcgtgttccagtgtgggtacaattgtgtgtgcatgtgtgtgtacacgtgtgtgtgcatgtgtagagactagaagacatcactgaatcttagttttccagcagcaaattgtgttttagtgctgcttgtgagaggggttggggacactgagtgaggcactgcatgtggagtgtctaagacatggaagatgctcaggaaatacaatttctttttctgatgtgggtttcatgaaggtgtatcccttgctggcccaggataatgccaacgaagcctaggtgggatttctggagcaagtttcctgggaactactcttgtgagagcggcacacgaagagttggaacctcagatgggaactaatgcaggagagtgccagagagcaaggccttgtttaagatctacattcctacattcagctcacgagtctctctcttactagttacatgcccttgaaaaaaaatttcccaacctttgtgccttacttaccacatctagcaaacaggagcctgatgggatacagatcatagggttgatagaaggatcaagcgagttaatttaggcaaagtctccaaatagagtctggctcttccaaagcaggctttttgtgttcaatcgtacagcttctaacggactgggctgcccagccttgtgattaaatagcaggctctggggaaaccctgtgtgatacactctctgtattagttaattttggagtcactgtgaccagattacctcaactgaaacaattgaacgcagggaagatttattttggcctttggcttagtgagttctggtctggctgagcaggaagggcagctctgaccatggctgaggaggaacttcttaccgagaagtggcaaggatgctctgaagccagggtctgctctgcaacctttaaaagtctgtcccccaggacccaattctaccacctcctaaacattttgctgccctcaaaatagaaccactagctgagacccttgttaagacacatggcacttggaccataaccctctcccgctctgtgatatctccgtgcctcagtttcttcacctatagaggtgatcgttatggtgcatgcgcagagggttacaggctgaaataatgctgtttatgtggaactgaacagaggaagtttctagtaacggtgggacctcactatcccctggctggaaggagcaacaggacaccgatttgtttaaagagacacagacggtggaatattttctttttttctttcaggcctcagggcacttcttcctaaatcttagaaaataagactgaattcttgacctttcccttgaagaaaacatctctgtcccatttagtgtttgtcttcacatccttggttatgtccccgcaccccagggccacacttgccatagtgaaacaggaggcacaaggcgatatagggacaaccggagcacgtccatcagtttggataccagcttaaaggtgggttgtgggccttacactctagcttgctttggcattttgtaggggccatgtagaaagcagacctgtaaaaggaggcaagcagccaggcttggggcctcctttcctcccttcccctcgccctcattgcctcctctaactgacgctgcaaactgaacttggtgaagaacaggcgtctagtttctcattgtgaccgagttttgctactgcccaaggacaaaggctagattgacacaagaagaatgtcccagggggtgggcctctttttgtttccttttccaaaactgtttctctcctggaggggaaggaatgataattagagcacttgttctacaaatcccctatgtaaatatgttcttaggagcggagatccagcgcattagactagaaacttctcgtattacccttaactctcctatctggcagagataacaagagaaagacagtgggatgtgaatggggatagagaagcaagagaggagtggaagccattttggcctctggactctgttcggatgtccttgctgggtgggactcctgtcgcacctcagtttctcatttgtagaatggagatattaatagtgatgaatgtcttctcactgcctcactgtggggacatagctagactgtggagggctgtgtgactacgggctgcccaaggcaacccctggagatcattcatctctatgttatttatttattatttatttatttatagcccagcacaggatctggctgaatatctggtacatcctaaatgtttgctggatgactaagttattagttaccaatagctttaatgaagcataattccccacatatgatactgtggctatcaacttctctcttttctgtggtgctgggtctataacccaggactttgtgccttctaggcaagttctcaatgatcttcccaaactaccataactacccaggactcctgggcacatgactgccttctcaacacctaggaggaggggaagaatagacaactagctggaggtgagtttgggttacatagtgagttccaggccaaaccggctgcgtatcaaggtcctgtctcaaagagtaacaaatacataaatcaagtatgacacacaatactttccctcattccagttagcccctgtttattgctacacactttcaaatttctcttctcaaggaggaatggagagcttcggtctgaggcaaaggtcacaacagccacactccaggcgtggagtgtaaggaatgtgaaggaaccactgtgaagaggcctgcactggagctgatacagcaagccacagaacttttagaggactgggatctgagacaattaagcaaaggggagtaggaaattcttgaagaaatttcaaccaggcagggaggttggcctgggatgagaacagggaagggatggcggtgatgggaccaagccggtgagagaggatctggaaactagtgtgggccttgctgaattgaaagccttcaggacgtcagaaacaagctgggaacacgggtacaagaggacaaactctatagccaccaactagaataggagctaagggaagcactgtgctcaggcaggaaattaaatatcaaggaactgctcgttaaaagttcaaagcacctgcccacacttcaactggtgcccttcccagtctccggcaaaaccgataactcagcccactgaacctgggtgcaggtctcatcccagcattcaaactggtcaaggactgtaatcaacacaccaagtaccagctctgatccacaagcttaggggggaaaggccgcggactagaaatccacaccacgtgtttcactgtggggcactgggcacccttagggtaacaacttgggacccgctttgctgaggctcaactctccaaacgctgacaccttgctgcccggttagtagagaacagaactcgttcacaagcaccctagcgtccttgggaaaagaagagaacggccattgtcggtggcaggagcaggacgaggagttggaaggggcagaggattgttttatttgtttcctggaacaccctgttaagaatctcaacaactgcagtcaatgcccgatcctttggcaagcaacactgcttctcccggttcccagctgcacgggatctaattcgcaaacacaccatcttgcattcaacacttaaatggaaaacaagcagcccgggagagaagcaagcggtctaactgcacgcacgtttcaaagggatttgtgcttccaaggccctctaccggcccggtgcgatccacgaaccgggtttctggctgtagcctcttgcctgtagagctcagaggcaattattagcccgagaagacgcgatcgggtcgggccttaggctttggcaacatgggtacatcactaagatctggaaaagctcaggtttttaaaggaaggtaactacttttttttcccactggaaacctggtttaaaaaaaaaattaaggcttctcttcaaggtagctaagattagagggctcggtttccgttttttgtgtttctatgggccgaacgcccaggcagggtcagcgagtttctgtgtgtggaatgacgaattcctctcgcctgagttctaaaatgataacttagctcgctgctgcagctgcgaacgcctggcgccaagcggccccgcgcgggggtggcgggaggagcggtgcaggccgaggccagggggaacttcgcgagtggcccctttaagagcttcactgactcagctaagcttccccctcaggtcgcgttttttatgaatgaaaaacgtccttacattcattatataaacaagccggtgctgattggtcaatggcgcccagcgcataaattatgtaaaacagacctctgagggcgttgagggaggccgaccgttagccaatgggcgccgcagatgatggggcggcccagctggatttgcctgaagacagggtaaacaagaggtgatgggcagccgcggggatggccgccgaccaatggggacgtgtgtgctctgggctgcgggccaatggcggcgggcggagccggcgggggccgggccagtgctgcagcgggttgcagggcggcgcagagtccggaggccggcgcgcagagcggtcttcatccccgatcgctgcggcccagcccgccacggaggcgcgcaggcgggcgcgcggagtggccgctcaggtgcggactggttctgggtcctcagttgggcgtgcttggggtgactcccggagctagccgccccctccccccgaggcccggttcggttcggttcctgggaggcttcgggcgggggcggctagcggttccggagcgagcggagaacgggtttccgcacgccgcggaggaggcacccggggtgctggagcgggtgcagggagcggggtgcccggctcaggctacagaagcggggtgcaagaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgagggtattggggccgcctgagccccggcctgggggaagagagaaccggtttccgaggctgccgagagtgtgctggaacctcgtgaatgattcggggtctcccccgcaaagggggtactgattaagtagggggtgatgaggggaggcggcatgtgtgatcaggagcaaatgaggctgctggtatcggccagcgctgcacctcgttttctgaatgtgggtgactttatgaatgaagcaggtttctttcttgggctctgagctctgaggcttttttttttttctcccttttttttttttttttttgtgaatgaagcattgagctttcttcctaaaacgctggggtgaggggcctgcgtcggaggctaagcgtgcgttgggagtgggggcgggggcgcagctgaaggagttttcatgaatgggaaggctgggaattgggtggaagtgtgtcttgttttgtgaatggggccgggcgcgagggatccagttacagcctctacctgcggtggcggccgcggctccatctcccattcataaaaccaggctcgctgcgcgccacggggaggggcctcgatccggtcgctgcgcccagttaaagttttcctgggggcaccctggatttgggggctggggggggggagcgactacgacgacacaaaggaagtggtttaaactccaggatgaaccgaagccttccctgcaggcttttaaaagatactttgaacacgacgtttccagctcttgaactcgaagggctgcttagaagatccttgctgctgcttttggaatctcttagggaagtttctttttaccgatttttttcaaaggatatttttttgcgcatcatgagcttctaaaaatattttatcctctggttttcctacacgttgttctcttaacccacaacagacatttaagaatttctgaggccacaacttagtcaaaatttttaaaaatacagcacagaattctttcttctccacagtctactaaagattctcagatttgggtcctggttggtgacattcaagagaggcctcattctgaacgatgtttgcactgtgtggaaggaaggcaagctggcagaagtgtttttctaggaagttgcgaactctctttcctttgactttgaaaatatctgattacttgggccaagtgctggctgtgaagggttttcttgtatcctgctcacttatgaaaatttgatatggtgctcacagcgtgaaaaacaagtcagatggaaatggttactgtgaaaagtgttccctagtttgtgtacaacttaaaagaaaatgctagttaggcctgtctgttattcagacctgaggtgaataaatacttgttatgcccccattattttgacctgagtttttatttggaaaattaagtgtttaggaaggtaacacctaaacttgctagctaattcctcccacgctagaaaagtgtctcccctcttgatttagttccaagcccagctcttaccagtggttgactgattttgttgaagatttgaggtcattgtagaacagggagttttcttttcatggatatttttgcattgaaagatttcaatgacggtgttttgtttttctgtttcttttcctttttttttggccttttggtagaaatgtttaaatatgtgcagtggaactgaatttcctttatctctcatttttatagatgttttattttagaaattgagtagatggcagctaatctttgtaggttgccatggagatgctgtgtcatttcaggtatacacacctgtttggacagacggtttgggtttaaataaagaattgtgtgtgtgtgtgtgaagaaagtatacttttgatcagtttgttcctggaactgtacttagtatttttaccatatacctacaaaatgcatttgagacacaccatgcatttggaacatggaacacccaatttctctagttcctatcataaagtggcaaatcttaattaaaaacttatcttaaaaaataaaacaaagccgggcgtggtgctgcacgccttttatcccagcactcgggaggcagaggcaggcgatttctgagtttgaggccagcctggtctacagagtgagttccaggacagccagagctacacagagaaaccctgtctcaaacaaaagaaaacaaaaacaaaacaaaaactctgcaacaaatgtcctagaaggtcatttttcagtgcaagtaagggagggtttgattttttttttggttggttttggcttttgtggtagacaggcaggcaatactaaagtgtgtgtgtgtgtgtgtgtgtgtgtgtgtgtgtgtgtgtgtgtgtgtgtgagagagagagagagagagagagagagagagagagagagagggagggaggggggggtaaggtggctacacaggcaagagggaaagacttgtataaacttaagccaccccannnnnnnnnnnnnnnnnnnnttgtataaacttaaggccaccccacctccgccaggagtttaaatcttcccaatccatgttacaggagtatctctttaccacccccaagaaactactcaatgctgaagcccttcaaagtgatagcggagactttggaagcaccatggatgggttttgtgatcagcaagtcccttttatggtcccaggggtgagttggttctgttctgttttgtccttgacctctgtggtgtgtcttctccctggaggcgtgggtggactctctctgcacctctttcctgcatttgaatcttcctccttttttttttttttttttttttttttcttggcctctttcagaaatctcgatcagaggactgtcgagggcgacctttgattgacagaaagaggaagtttgtggacacagatctggctcacgattctgaaggtagtgcagctgtccctgtgtgctgtggcttcctcaggtcacacagacactggtgtgcagactcctggatgctccttagcacaagaaatagccccattttgagtcttttgtttgtttgtttgtttgtttccagagttgtttcaggatcttagccagctgcaggaggcttggttagctgaaggcaagtttcttgactgtcctgttttctgtgtaaaacatttcactgtgccttttagtaaaatgcaaagatctaaaacacaactctctttccagcacaagttcctgatgatgagcagtttgtcccagattttcagtctgataactgtaagtacctttgtgttggtgacacatttgttctgaaattgtttggccttggatgatttccatctagaatatgttcattctacagcgatagccagaacatttggacagtggtatacctgcattttaataattcagggttagtccagaagacttgtctcatttttttattgatataatttcttgctctcatgaatgcatgacttattcaatataatttcagtgaaatttctttttaccttaacagcttgacctccggaattttaaattaggatactagataagatttctgtgtcaaacatctgcttgtttttagatatgtctgagttgaggggacacacacacacacacacacacacacacaaaaccagtactggtgggggttcttgcagagctcagaagaggctgttcggtccccaggaacaactagagtgacaggagatgttgagcagccttttatgggtgctggaaactgaactcggatcctctagaaccagagcagcaagtattctcaactgctgagccatcttcagcccccagtgcttataaaccaacattttcttcaaatccttttctcgtttttgttttctaaatttaagtctttgggctgaggttatagctccgtggtatagaaccgcctagcatgccccgctagcactccaggcccagcccactagcactgcaaatggagagttagacattaggcagagccagtgatgaatctgtgtttttggtctcctttgaacggtacagcacgtacttcctggaggatttgtgttaattgtggttctacctaacgtgtcgtattgtgtcttctatgctaataacgggtgggcactgagtgccttgatttgctctcattttccatgtggttgttgggaccttcctgttgagtaaagcctttttattattcgcctttgggtgctcattccttaagacaggtaatgtgtgcatcgaggagtcccacgaatggcttgtgaggctggcagggcatagttagctctgctctgctctttctgggctctcctcaacacattcaggagctttatggtccaggcacagctaccaaggacaaagctggctgatgaaattggagcagcacagagctgctctagagagcattagtcactggcgaatgaacaggtttaagagcggcctggagaacgctgcctctcttgagagttgcatcatagagaaattcatgtctcttagtcatagtttataatagcaagcacctgagccaggctaagatttgatttctcattttgcaccaacagattcttgtcatctttgttttatctctggggtggatatgtgcatgtgtggagaggggagtatctgggtctgtttaaaagcagggtaatctaaatctattagctaaaagaacagaggtaccagcctagcgttctgtaatgacagccctcctgttcgagtaggaatgccatgaaacttgaaaaatggaatgagctgaaaccttggcttgctgtagagattgtctggacaaaaggaaattcttattgttgccctctgattgctttgaagggattggcttgccattgaaaggcaaaatagtgataaccccgcgtggccgaggccggtgagggtggccgagggtggccgggggtttggatgatgaccgaatctggactccagcttgtttttgtcttggcagttctgcctttctccagagcctcagtaagctgcagcctgctgggggaggtggcttttgtggcagaacttctttgaaaggcttttattgcactgtttgtttctctgtggcccgcaagggttaaaggggggaggtgagacagctgggctgagtattgattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttttctatctgcagagattcttatctgtgagaataggcgagagcgaagaaatcaataaatgtgtcttggtgctctagaaataattcctgctcagcgcatagaatgtgctaggctctttaattaaaatgctgtaccttaaacgcaggcgctctgggagcgttccctgcctaccaaacctggtggggttgcttggcttgttttgtttgttttgttgtttgttttatttgcttgccttttttttttttttttttttttggcgtaacagcttaaggttgagctgtctctatttaaaggataaagtgggtggttgagtagccttaaaatgcctcttagtaattccctcccctggctgttcttgaggtagaccttggggagggtggggtcacatagactggagatttgaggcaggaggcccccacccccctggatggccctggtggcctggagcccttcgttcaggctgctgagtttgattatagttgaggttcagactgatgcaggacccctggatgaactggtagagcccacaggtgtcaaactacataccttgcctccctgtgaacacactccatgttcctgttggggtaggctacatgtctaagaagtgatattaacgcttccagatttgggtcacatgcctgtagacttgtacctgtaaatgtgatttaaagaaataaatccgagcctggcggtggtggcgcacgactttaatcccagcactcgggaggcagaggcagccggatttctgagttcgaggccagcctggtctacagagtgagttctgggacagccaggactatactgagaaaccctgtctggaaaaaaaccaaaaaagaaaaagaaaaaagagaaatatatccattgtaagtttacagaaaagctcagcttacctctagctatgccgaatttacctctgtctcatgagtacacactcagtaaaggaagccttacctagaaaggcatcccaatattttatttattggtttgctgaatgtgtgagcatgtggcgtgttcacgtggtaagctttcttatggtggttagaggataatttgtagggcttggttctctctttccatcctctgtgttggggtgggggtatttggtcatcaggcttgatgcaagaacttttatcctctgagccatcttgccagctccttgttggaaaatttaaaaattaaatcaagaggacaaaaagcacattttgtagcagtttctccctcatgttatggtgaacatcccccccccccatcattttgttgctacttcgtaactgtaattttactactgtcttgaactgtgatgtaatatctgatatggaggctatgtggtatgtgacctccccctaaaaggggttgtgacccacaggttgagaacggctgctctagagcctgggagttctggcagtgcccaccaccccataataatccattgttcctaaggtgttacttgaagatccgagattgagctgaaaatcccttgaagggattatttgaaaataccaacatgtagtttgggtgaaaatggaagaattcggtgacgcaaacagtaaaggtttttataataataatctagtcttcaaggcaagctaggagtcgtgtttagtttcaggtctaggaggtgggtttccgggaagcactggggagaccactggccatcctgctctcactccagagaaaggctgttgcccagatgacagcggcttttttctattcagggcttggaagagatacaaaacagaaacattgttacaactgacacagttccttaaaggtgccttagtatatggaaaggtaggtgtgtgtgtgtgtgtgtgtgtgtgtgtgtgtgtgtgtgtgtgtgcgcgggcgcgcgcgcgcggctcgtgcagtatgtgacagaccacatgttacaccaccccatgagctctggagtctctgtagatctctccacccgttccctacatactttcacaggatccagtcaaagctgcagatagataggcttgacacccggagtcctttggttttctactgtggagatcaggaagctgataacggttacttctctgagctgacttcctgggtactaatgagtgcttttttttttttcaatgcaggtttcaagtctgatttttttttttctttaaaccatctcatttgtttcagtagcatttgtaataacaaccagcatcttgagtaactgaaatagtttatgctaaggagagggagtgttaaatctcattgtagagtcatagctctgtaccaaattcacaaactttgtattaaaattcagatgaccccattttccccttggattaaaaaaggggggcagggatatgacttcggaagtacaagtaatttcctaaggaccagctaattaactgttaaacatcagctttccagaagtacagtgctgtgggtggctggaaagtagagttaacccttatgctagccctagggcctcaacagcagatagggaagtcacactggagctcttaccacagtcatggcctgtggggatgggtgctggtggcagctcttgctgtgtggaataaggccgtttggagctaaaaggaatcttttttttttttttttttgttttgtttttttttgttttttgagacagggtttctctgtgtagccctggctgtctgggaactcactttgtagaccaggctggcctcgaactcagaaatccgcctgcctctgcctcccgagtgctgggattaaaggcatgcgccaccacgcccggcttaaaaggaatcttatatgtgttgttagaaggtttaagaaaggaaactgggtgccctaggcagaggccgcttggcagagtcaagactggtgtgtttttcaggaggcagtggtactgaagcgggtgggggtggggggtaggaggggtgggagggaaaagaggaactgatgggacaagaataagggaaagcataaaacatggaggagagatgactgacccccaggcttcgcacagaggcttcgccagctagaccttgctgccagcaggaccctaaaatgatgagtggtcattgctagtttcctagcctttagcattgggagaactgttaagtgacctaagaccaccgatctaaaggagggccagatggtatttaagaccatgctttttttcttactcttgtccagtagcacccggaagcctttgcaatcctttgtatctggtgaaaaagccctgagagggggggaaatgaatctgcccgacaggcagatcagccctgtaggtgccaggagtaacaaaatcctggcatccatcaagaaatggccatttagcccctgttctccagcatcctcccgctttacaagatgaagaggcagggactataaagccgagagagacctcatgctatctatctgctactgcttctggctcatactatcgttattatgatgttaccggccccagtaaagaatatccctcccggtgaggtaggtttgggtgtgtgagagattgttcctcatgcatttctcgagttttaatggtagtgaaggagcaagactgatatcccccctcttgggcatacgctgcccttgagcagcttgggccccatctgtgccctggcactcattgcttctccatttggaatccggggagctcagagtctcgtcatgttgcggctcccagctcttggatggacgccaggcctgctgatgccattaccggattaggttgctttttaaaaaattcattctgtgaacctcatcaagctcacttaacagaggctttggtcgtcagttcctatattgtcctttctccaggcttctttggaaagaatggcaaacactacacagcccttggtgtaggcacatcctaacttcaagtccatttcggggccaggcacctagggtggattgggggtcaggctttacccccccacacacaccccaaaggccctgcccaccaaataacgattgctctttctgcttaaaaggaggattgattgctacacagggaaaaggctctccagctaggctaagaacgagaccaggagttccagcctcctcccaaaacgggccaggggtggtttgtgaatttgatacccagaaagatctcaaaagaagttaggacagggagtgaaaagcagtaaacatgagatgtatacatttgctttgaagaaaaacagtctacaagctcaaaattatcttactcaaatttcctgaaatatacttttccttgaaatcaagtttggttgtcagacaggttccgttcactcaccctcagggtaattactgagtgtttggggggaaaaagccaaagacaccaaaccagtttttagccttgtaccctgtgaagtctggagagattttatcctctaggtcagagctgcacgttcttcccttgggctgcctgaatgtccaggagggtatgctaagcgcttcggggctgctcagaagtcaagaaattgttgacattcctagtgtctcctaagtccctctgccctgcggaagaaaccactgggctctcctcgtgttggttaccaggaataaatggcggggtagaagtcttggcagggccagctctcagacagagagagctgccccttaatccaaaccagtttaccagggcagcagaaataggagttatcccctggaagctaccgcgattcagctcagtagtccatttattcctttactcttttgcctgatggcacttccctgcgcctcttctctcacagattcgcccaaccttgcatgttgcagcaataatcctagctgtttgggttccaggaagggtgcagacccagccagcgccccctactgcgtctgaatttttttacataaatacaacatactgggcgagccagcttctccgtggccccagctgagccctgggcaccagtagtaggtctgtcccagttagctgggctgcagactgactccccctcttgcctgaatggtgcattccaaattggttgtgaatggagggcggggcccactggcagactttttcaatgaataaccagaccccattgtgcagcctgtggaaaaacaaccaactccaacaaggctgtgactgttagaaatctgcgtgtgattggcagcttggagagcctccagaattagtttcctttggcttcctaactgctccgtgctctccaagcctgagcctaatggggtatgagttttcttttaagggctggattttaactctctccctaccaggctgataacctgggctgagagtactgaggttacagtgggtcctctccctccttgctttgcctgccattttctggtttagctgtggtggtagagtcaagggcaggctagcatctccagagagactcgatttgaggatttcatctttttatttcctctggtgctgttactttagctgtgtagtcagtgtcgccatcccgtgcctcccccctatccaccctgcctccactccattccaaaatggctgccagctagttcttccagactcaattctttattccaggtgtgaagggtaggtgttggtgagccacaagcaggtatatcttgctaagtcttttcccaggagccaataaaaatgtacttctttctaccctttggcctctctcatccttgtctatgctttaaaatgttgtctcccacacttcagcaccctacaggctaccctcactgtggcctccccgcttcccaaacaccaccacagagaggaatggcttccccagatgagtacccaggaagtaccaggaagaactcagtcgtggaaaaactgaagccagaggagcctcctcgtgtaggaagtactcagggctttaggtcaatactgtgcacccttaaatatcgtccagcatcttggctaacagccggctcctaggacaccgccaaagcgtaagcttagcattgtagaacacacagttaaagggcaacacctcactagtgatgatcaaggtagtctcctcaggattttaaaatgctcagctaagcatttgactttttgtcctcaaaaccaaaataaagtcctttgtgttttgttagggctctttaccccaggtgtttccctggcagtggccctggagggtatctcctttctcccagaagaatacacttgggtagattgttgttgctagatggatagagttgaaacctttcagaaggtgactgactccctgcaggctgagcaggctgctgtggacatcaacaattcagctgcaggcctgggaatacatcctgatgatcccaaaggatggagatatatatatgtgtgtgtgtatgtatgtatatgtatgtgtatatgtgtgtatatatgtataaatgtatatatatccacaaacatatatacacatttatatattaattatatattatatataacagtgataaatataagtacacacatatagtcatatataagtacaaatatatactatatgcagtatatgtatgtgtgtgtgtgtatgtatataacacatatagcaaagagaggatgggtgtctctggtactaagtccccctgtattgaagaccagattctggagcctgcccagctttcctgatctgaatcttaatggaaggcagttgagtggcaataatgacccctgtgttacctggatatcctgacattttcccattgtcctcaggccctttgtcatccctttcctccctcaccagccgtagaattttaattttagttctttagagatgttgggaaaacagtgtgtgggtagggggttaacttgtcctttaattttatgaatattaatctcagtccctgcttcccattttccattcctgtttgaactggaattccctctagtcttcgtgcctcccacagcagagacgtactgtagtgtttcttgatttgttctgcggccacagactgcagacccgtactctgcatggtcagtggtacctggtcaagcacttggcactcaagcaagaatcttcactccattccctcctggcccctccttccagtgtggcctcctcacagaggaagtaactagacactcccaaaatctgcattccggggatgaccttaggaagataggaatgaagtctctttcttactttgtctcctcttttggattcaggccgtgagatgtagcttgaggggctgatttctgtgcctcgcagaaaatctgcatctgttggtgaggcaggtcttgcatggtgcctagatgccctccctgcctgggggagaaagtgccagttgacacaaaggagcggctctggggagagaccactttcctaatggtgaatttaaatacaaagtcaaagactttacacaggtcttagttaatgcatttcaaatacttttaggtttttttttttttttttgtttttttttggtttatcgagacaaggtttctccacatagcctaattttaatatttctgacacttcactttatgtcaatttaggtaagaactatataaattgagagaaaatgattgagacagttaagcttaagtttcaagctaaaggtcccctttgagcctccgactcgatgccttgaccctgctggggcgaaagtgaggcaggcttgctgtggtcagtgcagccacactctctgcacagactctgacgcagccacatcagggcctgaagaacaggctgctccttaggcctctttttctgtcgtctctcatactggtagaggttgagtatgaaaatgcagagcatagttgctgagggaaagtagtctgaaggccactcagctccaccttagatgatgaaacccaggtcacattgatgcactacgaatgctctaagtgggtgccagggccgtgccctagacccagtcgctttacgacaaaacctttgcttgcctttccttcactgtccgagtgctttggggttgtttgtttgtttgttttttggccaatacattctaatagataatatttagctgcacaaaatatttcctaaagtattttttagtttgtgtggggggtgtggttgtgcgcgtcctgacttaggtgaacagctaagctttcttaaccactgagccatctctccagcctacagagtaagaactgggtatctccctcatgtgtggtccctgcctcaatccaagtctctggcctgctcccttcccttccttcaagtgtggctttcagatttgaggtcctggggttcccacttttagaccacgagagctcgagttctacatcattggcgtcaacacatcctttgaagaagaggaacctcacaggtccatgctatcctgagagtgatgctgaaccctgctgatagaggacagaatccacaactagttcatctgggtccagctatccctggcttggacaattgtagccgttgtcattcagttccttccttatttgatcacaggttctcttggagttataaatgatgcaatttgataaccaagatccagaggcagccgtttggtgttgaccgctctggcctatgagtcaagaggttcgtgatttggtgcctgtacccaaggtgggctcctctcacttctgagaccaactgagaggaagagaagagaggaaacattaatacgatgggctttcttggaaaatctgtgttgttgttagctctgatcaagtcaaagagaggacagagccagtgttccctgatccacagcaactactagacggccaggttctctaccacggctgctgcactactgaaccagcatctcacacatgctaagtcctgtatccctgagctatagcttagtccctaattcaagacccccctcacccccatcagatggagtctccaggctgatctggagctagtaaactcatgcgatcctcctgtctcaatctcctttgttgtgggaccataggtgcatgccatcaaacccttccctttgaagacttttgctttgaacgaaggtctaagataggccagtctgtgcttccctataacatggcacatttactccaattcttctctgagccatcctcaccccttggagggatcgtctcatgcagtagatgaggcagatagctctgaggaccattgtcatcattcctaactgcccttttccttgtgtgttcttcagaacatgggagttgctgtccttggccacatttccttttttaaaaaaaatatttttatttaatgtatgagagctctgctgcatagacattagcctgcctgaagaggacatcagttccgccagtgctcttaactgctgagccatctctccagcctggccacgtttctcctcatgcacgctccctccccctccttccctcccctcccccccacctctctctctctctgaataaaggggttggggaaagcctggagccaccacgttttccctggtcagcctgcacactactgtcccttctaatgggttacacatcattacagtggcctcccaagtttactttcatggacagcattttgtttctaccttctgagttgatttagttacagtaagttaagtgccaccatggctggagatgagggagaggtgggagaatttcctgctagatattaaattgttgagctgagcctaccagaaacaaacctctaagctgttcctccccccccccatttatatgtagtcatgagctaaaattaaaggtcctggaaggtaccagtacccatctaatgcccttgtctgccagtgactgaaaagcccccatttgtatctctcctgccttcatcatagccagaaagttgttctgggagccagatgccagccccaactcagagcaccttggcttccgtgcgcttctgcatcttcacactggacatctctgttgagtctgtctgtgcctgtgtaattgtccatacttcaggaggcagtaagaccacagaatagtatataacatgaggtccttaaaaaccaaaattagaaaagctgtcccagggctggagagatggtgtctcatgactgatctgatgccctcttcttgtgtgtctgaggagaacaatggtgtactcatagacataaaataaatctttttttaaaaaagaaagagagaaagaaagaaaagcgaagctatccctggcccatgcacatgctacagccttttgtcactgaagtttaactccatacccatccagtgcgtccccagagaaagcatgtccggtgagcctaacacatcaatgcatgttacagcttaggaccactgggctgtttcctggagtccatggcctaaatcaaaggttgtcagagataagcagacaatgagaggaaggtttatgcagcctaatgtcttgctcttaacctacctatggtattggttgacttatcagccagggggaggaaggtctattagctgtcaattcctgtatcttggaagagagcccccaggcagcttcatgggactgtttgagactcttctgctgactcaatggggctggctcagctcttttatcagctcagtttttttcttcatcagagttcaaactcatgtatcaggagacatcaggtgtccatttcagaatgctaaagcagtctcgcactgtccaaacacttggtgtgtttctggcatcccacttataatcagagtaacttctctatgccactcccacatctccccagaatctttgaaggtgcccagtaattttaggtagtgcaccaagattcctagggttttatccccaaaatgctgccccaaaaggccctggttcttaaatttccaaaaatgtggtctagccccacatgctcttatggacagagactgtgttctcattccattcctcctgtagcaggatctggctctagaggctctgggtatttccctctggctgacctcctcagtcttagctgggtcctgttcctgtaccatgcatgtagcctaggctctatttgttgcctttttatgcttttacattcaaagcctttctttagctgatttttattacctggtttccaggtctgaatcctgacatttttttggtcttccactgttttatcttgttccaggatagggtttctctgtgtagccctggctgtcctggaacttgctctgtagaccaggctacccttgaactcagagatctgcctgcctctgcccccaaccccatcctcagtgctgggataaagacacgtgccaccaaccaccccgcagcatcatttgttttctctccgtacactaattcctgaagctgcttctgctgacttcagtgtgttctctgcagcagagaaatctgacttgcaaagtccatcaaacgctccaggttcttgatttggctattaggttatttattggacagagggtccatattacaggctcttctgcagctattcattgatgaactgtgcttccttgtgattaatcctatatcatgagatcctgaaccatagcaggaggtggtagtgagtcctgtggtccttgctgaaatgacagacaggacaaataacccattagtaatgctcttgactagagcctcctccctgctcttctcctggtcctggccctgtttagcctttatgagcagaaagggccaaaccagctatttggaaagcgttgaggagaacttcaaggaagagagtctgagtttttgaagtctttttaattatcacaggctggctggtggtggctgctttgcgctctcttggactgtgggcatgaaatctaatgagctgtccagctggtctggcggtggtgggaatctgttgtctgtatatcttcacaaggagaggcggggatgcttgtgaatgcttgtgcttctgagttggacatatgctttagttcttgctctctgtggttccatatgtgtatgaaattaccgataggtttatttcagtcattctatactttgcaccagggcagcagagagtagtggtgacagtggcagttttcatcttgtcctccctaggatatcttactctttttctaagtaggtcgaagccgacaaaataattgagaaccacagtcttaagcattagacaacgatcaacatttgttcttgtatgatttttagattcctaaggtttaccctatgcttctaatttggtaacacaccaaggttcgtcttcttcacgtgtaaatgcgtgggcttcaaggtttttgtttgtttgtttgtttcctctctgtgtggacgtggttgtggatctgtgttgtgcatgcagatgtggacgtccaaacataacatcagtggaaaaacagacttccgcacgggctgggctgtcatgctctattgcttggcaccgtatatatttatttttcttgagacaggctctctgtctgacgaagctggacctcaccggttggctagagccgggactgcaggtgcgtactgccacgcctggcttttgacgtgggtgctggggaatctcaactcaggtcctcacagtggcacagcaagcatctttacctagtgagtttctccctggctccagctttgaagttcttaactcttagccggttagtcaaccgcagataaggttggctctgtccctttctttgggggaaaagaaagataacttgttttcttggtttatttttaaaggcagatcactccatttttacagttgtctaattgcatgcgtttgctctctccctttctctcccccctcattttgaattgtttagaagcagtttgtaaaaactgacatttcccctccaactactttagtcatttccaaaagttagggaaattcttccctataatccaaggaaagcaatgacctgttccaaactccccagttgtccccaaggttgacactgcttctgatgtaggattcggagattaagccccacccaccgtggtttaagttgcgttagaattgctgacccggttacgggtatatttaaaaagagtgtatagaactgaaagcagcctgtggaaatgctcatcttgggtccggaaatctcctatgctgttgatccgttccctcgcactctggttaccgtggtgaacttcgaagaatagcattagatgttggtagtcccatgagaaagagcttgtgcatgcttgaggagagggcttttgggaaactcatgacagatttcagcacaagactgaggacattgcccagcttgctgtgggaggagcatgaggacctgaagtcaaatctccagctcccatgtaaaaagccaggtgtgaccacgcgtgcctgtaaccccagcgttgagaacgaggacggctgggcttgttggctgggttccagacagtgagagtctgtctcaaaggaataaggtgaagagtaacagagcaggacccctgtgtccatctctagcttccctgttactgattctgtatattcacgtgcatagatatcacacataaataagaaatcaacaaaatcaggactggagagatggctcagtggttaagagcactgactgctcttacagaggtcctgaattcaaatcccagcaaccacttggtggttcacaaccattcgtaatgagatctgatgccctgttctgggatgtctgaagacagctacagtatacttacatataataaataaataaatctttaaaaagaaaaagcaaaagcaatttttaaaagtttaagtttagcatagctcacccagtaactgacttcactatgttaaagttgagggtttgtgcttacagaacttagctagattagatatggaaatgatatactcccctatatgtcctccagttctactcttgggactttgtgctccctaactgtaattgataatgcccctggcttttatttttttcagacagttgccagataaaatgggtatcagccactctgctcatctgaaaatcccttttactggatttgagactcttaggtgcctccttttccaaatatcctcttcaagtaacagaacctgtctccttagctcatcttccaatgcaaggtgtggtccactgtctctaccacccactggtgctgctgtagccaacacaaagtgtgtaaaagtgatgctagtgtgtgttacggatagccattgtactctggacctcacaacagctttgggatgtgtacctaagccaggcagtaagtagttctggcctggataagggagggagaggctcatgaggcctctgctacccggggatctttggcagggggagagatttcccttggaggtggagctgctgatagggtacagaccctcccacaggaagcagtaacaggatttcatgggtcattagaaagcaaaacatgaagatgtgagaggcatacgttgagagggggctgggatggtggcaggggagttagaggtgtgcttacaatgcctgtaaacatggaggctacatgggttagcattgtcttctaacattatttgtatgtagattgacagtgtgtctgcctttatgccagggttattttgttagcgtatttgcgagattcatctctgtcaataaatgtaattgttatttattcattctaatctctgtacatagctaaggttttgcctagggttacattgaatgcatagataaatttgagaattgatgtctttataatattaagcttttcagtccatgatacatcctttcatttattctttaatttttgctagcggcttatgaaaatctttcattagactgtatttaagtaattgatatttctgttgctattgaaattttcactgcatcttaattgtctgtggggagggcacatgtgctataacacacatgtgacaatttggggagtcaggtctctcctatcatatggcttttagggatcaaatttcagactagttggctggcaactttgcccagtgagctttttctttttctttcttttttttttttattatatgtaagtacactgtagctgtcttcagacactccagaagagggagtcagatcttgttatggatggttgtgagccaccatgtggttgctgggatttgaactctggacctttggaagagcagtcgggtgctcttacccactgagccatctcaccagcgcccccccccctttttttttttttttttttttggttttttgagacagggtttctctgtatagccctagctgtcctggaactcactctatagaccaggctggtctcgaactcagaaatccacctgcctctgccttccaagtgctgggattaaaggtgtgcgccaccactgtccggcccagtgagctttttcattggcccaaaatatattttctttactttttaaattaattttattcctttttgtgtacattttacttgcctgtatatatgcataccacatgtgtgcttggtgccctcgaagggcagaagagggtctgagatccagtgaagctgaagttacagaggattgtgaaccaccatgtgggtgctgggaatcaaacccaggtcctctgcaggaggaagggacaagtgttcctaacagcagagctgtctctccccagccccctaagtatattttcttatttcatattccatattacttttggatgctggatgcagaaacggttctttctgtatattcagctcgtaacaaatgaccctgcctggtgagcccctcacactttgttctttgtgtgtttatattgtctgtgtgctcatctacttatctgtgaagtatgacagtttaattcttctctgatccctctgcgtgtgtggcttttgttttcctttcctctgttgttggggaccagctggtttgtgaaccctgtgtcccttgcaaggaatttccgagtctggtaggacaaaaagctatgaggttaagttggttgataggtaaacgcggtatttaaatttaaaatggggtctgatgggctcgaggatgctgagctgtaatgtatgcccaggtgtgggcttaattaaatgtcaccatctcatttttatctgtgcttgggtatagtgagttcatatagtgaagcagaaagctggagcctggactctgttctcgcctcagaggtggctttaagagaggggtgttgagatacacatcttccagtgtgttggcaggtatctaaatgagcagaaggctttggccaactggactgtaggagggagaatgagaccctgtaggaggaacactagaacagaaggcatggattgcaaagaacgaagaccgtgggagtgaggaagcttagctgccaataggcgcgaaggaggatcctggacgttttgtgtggcagtggcagaggaaggtgtctgtcccctagtgggttgggtgtcaggtgtgccctacctggaaactgcacggtaaacatgaggctgcagccttgagatttggcaaataacttttttcatgttttctggtgtggcttccttttccatctctacttccatctgcctcttgggaaattgcatcttgcttttcagcccatgatgaccttgaaccctatccggctgacctgagtgctgtgatgacaggcacatcaccaccatggctgactacatgatggactttcatcactagcaattgtctctgtctctcttcatacagcccaagctggtctcaaacttgctatgtgcctggggctggccttgaactcttgaagtcttcctgcttctatctcacaactgttggtattacacatgggagccactatgcccagctccagagtctgttttctctctgatcacctctgagactctaataggatgcttaagaactgcttggttagaagtcctggaaacttactagctgagagactgtagcaggctccacgagcttttttcctatctaaatggaacgagtgcaaataacattttccattggaaagactgaaggaaatgaaatgagtgcaggcatctatttaccacagaggaggacgaagagcctgcctggttgtctctttcttgatctgtctcctttattcttttccagaattactgtttcctcctgtctcttttcctttgttcaagagtacatttgagggagggggagatgactcagcactttctgagcaagcatgaggacccaaatgcaaacttccagcacccaagaaaaagccgattgtgactgtgtgcctgcaaccccaggggtgactgagcaggaagcctaatgtcctttcccctgctctccacgtgtgcccacacactcacgagcacacggaacacatgcgtgagcgcgcacacaagtcctttcagccaggtataatgtgatatttttattgtttttaggttgaaaaaaaaagtatgccctctatttctaatgggcaaagtagatacttgggatgtctcccagttctgaccctgtggtaggagcccaacagtgacttggagagactccaagtctctccctttcccagagactcttaagactccgagcccaactccttagggtctcagggttctatgcatagagcattgaacaaagtgggccaaggccccaacaccaacctctctactgcttctctgagaaaaacatgatgaaagtcaaatctaactactgtgatcttcctgtcagcctaacttgttagcgctgagagaatatggtctcacaaggtccaagcagggaaggcaggaatgaggtattggtgatggtgaaggcgggagttgttgtcaaggtgactgactttgtgagcccctctttatcctctgaacacaagagttttctaagggtaggtgcttatcagctcaaataggcagccctttgaccatttcagacttctggagttgagagccttcctgagtcaaatccacttctaacctttacagccagccacatacgtctgccattgtttatttacgtagtccactgtgggaagtcaagcattctgttaaaattatgcagcgtcttccttccctccatgggggttctgctcttggggcagctcagtgtgcttcattttacatatgaggaaacacaaaagcaaggtgcattccttggcttgattgatacccagcagaactgggcaatgggctgcttctcctggctctcaggcctcaccgctcttctgtcagcccagatctgtgatctctccagatgcctgatgggggatgggcatttacagctaaactgtacctagaattaaagagtgaatgtggaccatgcctttgtgttaaaagctggtttgtaatataatcaatttatactttattatagtgggggtggtatggtttttgatttggggtggggggggtgtttttggttttgagaggttttgtcatgtagcccaatctgggcacaaacttctgatcctcctacctgaacctgagtgtgccactgtgcctagcgccaccatgcctggctattcgtcaagtttcttgaaatttctagataaagtttgattccattacaagacagccaggtgtagaagccactgactgaggtagagacagcaagtggcatagattagttcgccttgtcaggaaaactgataattttaataataagattgtaaagagggagaaacctgaagtgagaaattgaatatcacccttatcgtttgcttttccaaatttaggtaaagcaatgattataaatgacaacttttagacaaagaaaagctaggctttaaaggctatacataatttttatttaaagtggagtttggatattgttctgatttggtagaaagttttgacagcaggaaagtaataaaaggagaggtcgtgaccaaggggccatcctggaatttctcactaacaaaatgcaaatgcagaggcttagcttctttttgtatctgaaaacatttgataacaattgactcccggctgccatgatgtcaccatcaaaaactcatgacagagactctaatattagacttctaaatataatctgctagttctcaacttatttcatggattcaggaaaacacagttggtgttatgtaagaaaggaattatgaaaaccagtcttctccagtctgttggcaagacagccttttctttatatatatggggtggaggtagactgcacacatgtgtggggtgcatacaaatggtgggggcttggggtacacacacagggtgtgaatacatgtgtgtgcctgtgtataatggcatttgtgtgtgtgttgggggcgggggagctttcagaagtcagttctcatttaccatgggatttgggggtcagattcagttcatcagatttgaagctataagagaaaccagttgtctggaagattgttcagtcttcctagatagaaaaggatgcctatggaaataagtctgactagtaaaatcagatctaagccagaatcttacaagtgagtagtaggaataaacattaaatcagagaagatctgagggggtttagcagaacactgtctcctctgcttatgccctgagtcttgtgataagggggttaagtagtgctcagagaagttaccctacaccctgcaggtagataggcagaaagtagccattttaatattcttgccagaagggacagccctcgtgctacagtgtctgtgttagggtttgttctactttggggaaagggcctctttgaagcaatttagtatccaggtaagggcaaacttagctttctgtattctggagtgtggacgcacggtaaatccttcattttgagaagtcttgtttttctgccctctcaggctaatcctatgcagaatctgtagtgggtgtctaagcacatggcccagccacgtggacttacctcatgaattcaggagaagccattagcattgtcttagtccattttctgttgctgtaacaggataacccagcctgggtaatttatgaagagtacataaatatacgtgtgtgactataagtctgtccatgtgtagtttgtaaagtttattttggttctggttctggacaccgaggagcatctgctgaagtctttatgcaaagcagagggaacggggagtgcatgggaagagacgagacagtgaagcacactcatggaagtgaagaacgggctggagagatagcttagcggttaagagcactggctgctcctctagaggtcccaagttcaattcccagcacccaggtggcagcttaagatgtctgcaattccagtttcatgggggtctgacaccctcatacagacaatcggtcagaacaccagtgaacatgaaattaaaaaacaaaagtggagaccctgcttcgtctcttcatgacccagacacctcccttcagtgtggttacattgggaaacagtttcaaggggaacaaaccatcactgggtaccacgacttcttatggaagcctgcccttcctgataggctgctgggaatggctgggagcagatactgtggacacaaagttccccacagacttcctaggtggtcagccttggcccagagggccaccaagttggttttgtctttcgctctcaagtgttttgtaattcccctaagcctgcgtggtccttactcagaactactatttagtgacacttgagaaaagactttgaaaatcatatttaacttggaaagatgcttctgtataaggcacatattgcagctaggtggtgtggtatggtgctggcgcacgtcttagtacagcacttgggaggcagaggcaggcggatctctgagtgtgaggccagcctggtctacaaagtgagttccaggacagccagggctatacagagaaaccctgtctcgaaaaaccaaaaccaaccaaccaaaacaaaacaaaaatcccaaaggtgttgatgaaataaaagacaacagagccctaagaagtgtgaacacccagaatcctgtctccaaaaggagaaaacaacccaaactgtggtggcaggcttcaaatggctgtggcaacacttttctctttgccccacacccaacccaaagacagggtttctcctcatagccctggctgttctagaactcactctataaaccaggctagtctcacactcagagaaatccacctgcctctgcctcccaagtgctgggattaaaggcacgtgccaccactgcccagcacctttggggtttttcaagtcttcagaaactgggaaacaagactcatgattaaagaaattgggctgggagggccctcatttaaaatgtcctggggtgatttttaaggagttcactatgtatctcaggctagccacaagctcaccctaagcgcttaggttgcaagcattccgctgagggaccttaatcggtttttaacaaaaggttgcatatttaggtggggcgggttttcttgaccttgagctgtaagagctacctgctggggaagtttgtgggaagaagagtgatttagtgaataaatgctgtcccccccccccttctgatttcagtggtgcttcatgctccacctcccaccaagatcaaacgggagctgcacagcccctcctccgagttgtcgtcctgtagccacgagcaggctcttggtgctaagtatggagaaaagtgcctctacaactattggtaaggattggagtggagacctagggtggcgggggtgggtggatggcatggagagccttgcagaaaaaggctctgggcacagcatcagaagtatctatcaggccctagggcagagcgtcgccgccctgtggtgtaagcttctaggtctagctcattccactgagcccattttatgctatgcatgaaaggcaaaactttcattaaaatgccatggctccacagggagccatagacatccccgctaaggcaagagcctggaacgctgggccatcagatctgtggctttgaggcaggtgatatacagtcttcccgtctatcatatatgttaatgtgaacttttaggcggcaaggaaataatcttaaaatcagaataaacaaaaaaggcccccatgcttgtgccctttacttaagaatatccaggcctcaggaatgaggcttgaattttaatcattctttgcacttaaaggtaaacgcagatcttcctggaaccagtgaaggcttgtttaatttaagcactgttaccttccacaaagatttttgaccaatttataggaaccctggaatattttggagaggggaccagagaaggcccataaattcccagcctcacccatacacccctgcacacacacacacacacacacacacacacagatcttttagaaggagggaaaaaggaaaccggaagcagaagctaaaattatcttggagaaaaatcacaagaagtgttaaacaagtcctttgacgccccgcgtttgtcacattaccgaggtacaaatattcccctgggctgtagcgatttcaccgtgttaatgacgtcatttcctggcaacaatgggctgcaaactggttttctgctgggcctggttactatgcaaatgcctccctggagtttaatggatccttctgtctgtctctttacagtgcctacgataggaagcctccctctgggttcaagccattaaccccgcccgccactcctctgtcacccacccatcagaattccctatttcccccacctcaggcaactctgcccacctcaggtctcacccctggagctggcccagttcaaggggtgggtcctgccccgactcctcactcacttccagaacctggatcacagcaacaaacatttgcggtcccccggccaccacatcagcccctgcaaatgccaaagatgatgcctgaaagccagtatccatcagaacagaggtgggtaccactctgaactaacttactctctcatgtccttttctcatcgggagagagaagcagttagtcatgttggccaggtacctagaaagttcctactccactaacgccactgacacatcagtgaagtgagactgcagatgtactgtgggtatgggctagttatatagcaccctgttcaggaggttctcagaatggtttctaggattgtaacctccttaggaagcctgggtggagggatggcttgcccagatgcacagtcaacccaccaatttctgggctcctcatgagatacagcctgtaaaactgagctttagtttacgctgctcctaatcatggtattattattattattctacttgcattctgggaagagtctgagttatgggagccattattattcacattttagcatagtgaactaagaatgttagtaataacatctgcttttttgaggtagaaacttcccggtttccctgtaggttggtttatatttctaacagttgaaacatcatggttatctggagtcctccttcatcaaaagtaaaggtagagagggattcggttttctatgttcattgtgatagtctggaaatgcggccaggtgtggacttactcattgcgtgtcagctgttcctcatctgtgttgatagtgagatatggtgactgatcatggtgttagtaggatgggaaccacctctctgtaggtgagagtgggggcctggagaagagaagggccagatggttctacccagggtctgtctggaggttattttgcttggttatggtcctgtccccactttgtctaacctgcatgatatagctggctcatggtcttttccacggtcaagccaagaaccacagaacagcaattgtgctatatagggccccagaggtgatcaccattttggggggtatctgagatttgtaacgtggcagggacattggttcatgagtttctcttgccaccgagggcgcatctaaaaaaaacaaaaaaacaaaaaaaaatcaaacagctgccactaggctttggcagtatcatatatattcataaccttgttctttttcaagagaattgatatttttatggaaaaaaaaaactaccaagattttgggttcaaaagttggtgggcttttgccattttccttttactagtttattttaaagggcgtcactgatttcctgtaggggttcttgatggggggtgggaggatgctgtagcgaattttcagttcaggtatttgaaatgcctggcaaatgtaggcatagggaagttgctttgttaaatctgtttgattagcacttctttcctcccagcccttggttcttatcctgagcagtgtggcagcttatatgaattggtcgggggttgagggagaactaactatcttgctggcctccttgtcttgcaacactgtaacgctggcagatagaggagaccggctatcagttgtagaacagacaagcctcctggctgcctaccctggagaaaggagattcaggtccccaggagttatgactgtctgccctcaggtccagagggaaagcacatcggtatcttttccagatgagtcttttgtgaagtggcctatccgtcttcaacttcctgtttcttttcccttggcctgtagtatgatggttcaagaccttttgaggtgacagaaactctagaaacctggggtgaaaggtgaggtagcgtgtgggcttctaaaatgacagactaggagcagaaatggggtacttggggctcccctagagcactgtgcacgtgcacacacacacaaacacacacacatcgcaggacgtggaggtagaaacgcagactccagtggggagggattgctccgtctgaagtacctgctgtgaaagttggattctcagatccccctgtgaaaaggctagggatggagcttcctgcctttcttcatcatgctgaggaggcagtgaccagcagatccctggtgtttgctcggcaggcagcctagcctgcttcatgaggtccaggtccagtctcaaaaaccaaagtggacagagcctgaaggacgacacctgaagttgaccttctgtgtccgctcacacggtgtccgagtgcatgcgtgtgtgtgtgtgtgtgtgcgtgtgtgtgtgtgcgcgtgtgcgtgtgcgcgcgtgcaagcgcacgtgttcgtaggcccttagttccactggagtctgcgttggtggagcttgggtgggactatcatttgtcacttagatacactgtgaggaaggctctttacctcaccttgttaatgcccttgttaatgtaggttattttgtaggataaagggaatacctgctctccagccaaagcagaagtttgttgtccttgtattttaattttacagtgagagagcaaagcctgaaataccttttgattgtctctgaattgcaaatgtccacgaggatccttgaaaagctgagtgcccttggtccttgaactttgctcccctctgaaatggcaatgtctgtggagctcagcattatttcctctaagcccatgggacaagaggtcttttgttttgttcagggtaggcctgacctgttcagagtcttcatctttttccttagacgggattaatcgccttcactgtgtttgttgatagtggtggccatttgctgtggccctgctttaaacagctaaaataaccatagtcagagtatattcttggtgttccatgtaatctgcctatataactcttaacaactcagtttatttttggaagataaatactgcatttgaaagcagtgatttatattggtggttcctcccacgtggtgtgggaggggatcatgtatttggcgtgctacagcgtgttccatttatactccatgagagctctgtttttcctttggccagaccaatcttgatggttatacgtgttttgtttttgtttttgtccctatagtagaaaaccaaaacaaaactgcttttgggtagtacgcaagagcatccatattatgatgttcagtcactggtggaacgaaatacccaggcataggtcaaccacatgatgaactgccagcatggccatgttagtcaggacttgaggaaaggaccaactaactcactgagagctgtctcctgccgtgtggtctgggcctctaaagcctggtttgagctgttttctggaacttcgatagcacagaaactatgatatttgataggttacaagaccgacttcctcttggagtccatcccggacaaactgtcatatattcaccattgccctccaggtcttgtgttgttacaggaaagggttgactgagtcacagtctaactcagcttggaagacagactgtgtgcatcctcatcgtgggtctggctaataacgtgctttgtgtgggttcattttggggtctaaagccaaatttgcttggattcttaatgaaactttctttgacagactgggtaactttctcctgatagttgactctgaaagctagtttctagcatttcactgtctgtctatctgcctgtctgtctgtatttcctctgtcaaactaatggagatctcctctgcccttcatgaaaagttatcagtgttgaaaattatcagacaatgcttttacctattgaaaagaaatgatcaaattatttttcctttaataatgtgtattacgctaatttaaacgatattgtccatgtattcttctgacattgtttgttgcttagtatcttattttttgtttatttttaatgtatggggttttgtgcttgtgtgacacagaatgtatatggaggtcagaggccaacttgaaaaagtcagtgggctccttccaccctgggggggaggggttgattcaaattgtcaggcttggtgggtgctctttgccccctgcgccctgccctggctctatggccggtcatcggcattgttgaacttactttctctgacttacttaggacctctgcatcaaatttgcaattgagaatgaggtggttttccttgggtccgcactgaggttgtgttcatcagatgagtagaggatgtctttatactgggactgtttagcacactgaagccttggcagacactgcggaagccctagcaagtaacgtctactctccagaaccagctctgtcttagcttcgctccttctcgcctgcatggttctgttttctgtaaatgtccacccatttagacagccagccacctcagtcccaattacttacacaaccctcctggagatgtcttgcctgagttatggtttgtgacgtttttgttattttaagtgtttgctatcagagctttcaagctttttttttttttaacaattttttcttagtttctaaaaccaggatttttttggtacgtggactaactagtataatttgtacttaggtgtcatcagtagagtcttgaaaggtgctggttgtaggaacggtttagggaggcaggagaaatggctttgtggttgctgttctccagaggaccagagttctcatcccaggactcaagacaggcagctcataattgctccaggggcatctggtgccctcttgcagcctacagtggcacctacacacaagtaaaaatactaactatgtatgtatgtgtgtatatatattaaactctaggcttgtgactcatatacagactgaagaagccctgaagttgaaccccaattctgctatttaggggtgaggagtgctagacaccaggtgggtacttcccgtgtgtcacagttccacaggccgcatcaccatgcctagctgtattttacttagcatttctttccttcacactttaaattttattttggggagtttgggggtggggtgcctctgtatgtcagacgccaacagagttaggcatctcctaccgggtgggttctggagaacaaattctgctggtcacactcagatgcctgtgtgcactgctggaccatttcactgactgcagtttaactttgaaatatcaagtgtgttctagctacccaagcctcagaacctgagcttctgtccttggaagccatgagaaaggctgaagtaggtcctaaaatttgtcctctgagctctgctcctgcgatcccaccccattgtaatatacccacataataaagagtgattttttaaaaacacaacttagaaacttcagttgtgggctggagagccatgaaattccagttgcttcatttttacagggtttacagtaaaggccttcctgtccctttactgttggtctgacttaggcttgtttgtgaatgctgtccttgcctcctgctgagggctgcagcaccttccaggcaggcatggctgagtcactcaagaataaaacccaacaatctgtctcttggctcagggatcttactttgattagtgcatatggtaatctcctgacccagggggtctttaccattgtgcagcttgggactttggctgggagactgaaagtccttgtgtattgagaacttgacttgctgtaacagacctttggggcaggtgtcctggtcttccgcattctgccaaggaggaaaatggaggctccgagccattatgtaaaagtcacgcgggaagtcagtagttaagaaggccagcttttggcttggcttgttctgatctcagagccaggctctggatttgcctctgctgtttctctggtttgcttcaggttctctcaacagtgagatttaagtgtgtggtgtggttctcgttgaatctgagggatcgtctcgaaggcctcctctgaactatcactgtttgacctgccaggcatacacaccgcatgccctgccttgaatctctcccttcccccccttttatttctgttaccattgtgtttacgctgtgtgttggcagctgaggccagaaaggaaatgcagaaaaagaatcttaacagttttcataacgtaaaccaaatgttggtggcgtgggtgtgctcttgagaggaaaggcgctagctatataaatctgacagataaataaataatttttcctttaaataagctggctcttggaagccttgctccgtcgtctgtctccccttgctcgccaaatgtgagttcgttactaatgagctgcactggggttgcgggtggggtggaggaagagagactggtcaacttaagctgctgctcttttgggaatggtcccagcagcatcttggtgatggttgtttatctggacaacacattcgttgatacttcgaaaagattgctgagaggggaacgggggttcagtagaaggcctatgagtaaagttcacaggatgtattttgaggacaagggctgaattacttcattaatctctgcaaatagcaagcaaaaaaaaatagcgggctctgagccattctttttcccaggtaggttggtcttgtgacctgcccgggatctcctttgccactctccagtgcagtgcagagcaatgccagttaaagattctgtcctggtctttgagacgcatccaggctttggcttcatgaatcctggggctcactgtgcagtagagaggacactggggagttgggggcaaagggggtgagatggggaggttctttgctggctagggctcctgtagaagtatcctttcctaaagaggccatcccaggccgacattctggaagatgagacggcaaacacgaaccagaagcaggagaccattggtcgatccagttgccaaggctcttgttacagtactgagtggtacgggtcacctttgaaggtgctaacatgatggcacaggggtatgggcagctgataagaataaagcctctgcggtatctttgtgcttttctggaaggttctctttcaggttgtgagcctgtggctgatgcctgtattcagaatgtcaagcccaagcctaagttgcaaatgtatacttgtcgagagacccttgaaagttggtcacttgaaatggcagcgactttaaactcaggtctctgctgaagtgagaggtctgcactagctaagacattcactgtggtggaatgtgttcagaatgttgggctggcaagtggaatgcttttgtatcttggacaaaaggacacccatgtataaaattgctcggggatcatgttgtgtttttgatttttatgatcatgttttgttttgatttttttttttaaagatttatttatttattatatgtaagtacactgtagctgtcttcagacactccagaagagggagtcagatcttgttacggatggttgtgagccaccatgtggttgctgggatttgaactctggaccttcggaagagcagtcgggtgctctaacccactgagccatctcaccagcccttgttttgatttttatggtgtatcttgcaggaggatagtaaaacttacccaggagcagttcatgctccatgctgatctcgggcagttttatctgtgcccagatctctggcttaagtcttgatgttctagaaatctgttagcacctgatgacacagattgattcaaatctaagtccaactacttggttaaatctattaaaaagaagcgtgtcttttgtttttttaatcttagcaattctgatgggtgaggtagaatcttacagtaatgtagtttgcctttgtagctaaggagaggacgctttgaagcgctcttggctgcatgtagttcttctagtccacatttaatgggatcatttgttttcttggtgtttcgtttagtttttgctcttagtatattgtatatactaatcctctggcaggtaccacctaacaggtggccttttcagtcaacaatagcttcctgcagggcagaaacttgaatttcctggagtcccactttcattgatggcctgatttcctggatcattcagagtcctattcagaaaatccttacctaagcctgaatccagacctgtactccctactttttcttctagagtttggggtctgacattgagatctcggatccatttgatttgggtacagggtgagagggaagggaaacgttctatatggagctgtctggtttgaccagcgctgtttatttcttaaagatgttgtcttttcttctctgtgtgtgtgtgttttgtttttgttttttctttcgagacagggtttctcggtatagccctggctgtcctggaactaactttgtagaccaggctggcctcacactcagagatccgcctgcctctgcctcctgagtgctgggatcaaaggagtgagccaccacgcctgactttttttttttttttttttttaatatttgtcaaatttcaggtattataggaacagggacttaatctagggtcctccattctattccattgataaatgtgtctgtttttattctgttaacatgctggtttttagttcttacagctatgtctaacttgaaagcaaacattttacgtttactagtgcatatgttagtatttcttcactcattttcctgtttgtcttagtcattgttctatatgtgaagagataccataaccaaggaaactcttacgaagcaaagcatttaattggagcttgcttttcgtttcagaggtccattgtccttgtggcagggagcgtggtggcaagcacgcagtgctggagaagtagctgagagctacatcctgacccataggcctggagagcctgggtttagcctgggcttgtgaaacctcagagcccacctccccaatgacatacttcctccaacaaggcttttgcttttctttgtttgcttgtttgtctgtttttgtttttccagacagggtttctctgtcctagaactcactctgtagaccaggctggccttatagaggccacctgtttctggctccccagtgctgggattaaaggcatccaccacccagacccagctgaggccacacctcttaatccttttaatcttccaaacagagccattgccactccctggtgactaagcattcaaatctgggattctgtgagggccattcttattcaaactgccacactaaaatgctgaccttcagttactctttaaaggcttagatatactcaccttcaatgctagcacttaaaaggaggatctgctgtcatcctgagcctcactcaagtaaaaataaaaggcaggtcagtggctgccgcatcttcatttttgctggattctgcttccggcattttctggttattacagattctggtttccctccactttgcttctgccctcgtatatcttgatggtttctactcttagtaaggtaatttataaacggcttctcccacccctgaaattgtacatatgttctcatatacatttgcttcataatgtgaagtctttcatccataacatttatgttagaatgcagtgtaaaatggaacctagccttccctacacatttgaaatgatttaacaggtaataaaaggattaagggttcttgattaattcagtttctttgatctaccaatcaacttttcatttcttataattacggtcattttatgataatgtatcaataccaagtaagtccttggttcttctcaaaagtagtttgtgggccagtgagatggaagtgaatccacagcgttattctcagactgtcacacgtgagccatggcgcacacacattgataataaacatggcgcacacacattgatagtaaacaacattttacattagtgagaacttttttcatttagaaattaatttatcttttaaaaaccagatgtggtggctaatcccaaatgttgaatcatagtgagtgttcatatggtattaaacaatatgctttttttccttccagatttcagcgacagctgtctgagcccagccatcccttccctcctcagtcaggagttcctggagatagtcgccccagctaccaccggcagatgtcagagcccattgtccccgcagctccgccaccccttcagggattcaagcaggaataccatgacccactgtatgaacatggggtccctgggatgcctggtcctccagcacatgggttccagtcacccatggggatcaagcaggagccccgagattactgtgctgactcaggttagcgcaaactcactgcatcggcgtctatgttctcacctggctgtctgatgagcattgggctgctctcttcgagggtctaagaattgcctttcgggactgaagattgtagcaacgcaatatcctggggttcatgcccagcacttctaaaaccaaatcaacaaccctcaaagagcttaatgaattagttcattgtattcagaagtgtgtaaaatacacctaaggcgaatttgaagcctgctgagcccacatttgggtggtgccctacccttaagggtaccgggcataaggaacacaatttgggtgttttagctttgaggctttgttttcaatacagcagacacagtataatcataagaaaagaggtcgcctctcagacacagttctgtgattgaaataaaccttccaagaagcacctgctgctgtcccgcagatgtgctgagtgctcccagattctctgaggcgctgttttccattgctatgtcctgcagaggctactggtctgcacaggaagatgtgtaacctgtgatggtccctgctgtttgcctaggagcttcagcatgttaagttgaggctgtttgacctctgtgtcttgtgaaccagactctggaggaaagccgaccagggagagtaagcattcccactctttccttacagtcaggactgaaatgacctgggagtagttggtgggttttctgccgttcgctgtgggcttttctcgctgtgggcttttcttaagcccctttggaaggttggagcagtcagctgaatggctcttgtgggtgaagtgggatatagagtctgctcttggtctctgagataacaccatgatttagatagaaactagtttggggcaatctgagaacgtaggccagtggagactgctgataggttatacaaataaattgtcactgaattctttttgaagactttgaaacatatttcttggaagtcatgatatgatggccatattttttctttaggactggaattgactctagtatgtataatatatattatatactattagcttagttatgtgtgtgtgtcagtgtatgtatatgtgagtgccccagtccccgtcgttgtcgtcccccaaccccccaactggagctacagatggttgtgagctgttgttgtgggtgttaggaattgaagcttaggtcctcttgaagagcagtatgttcgttcttttaaccactgagccctctccagcctgctggcattgacattttaatttggccagccatttttaatctcctcccattcacttgaggaaaagcattccgtggaggttcacctcagaagcattcccagtgtgcacccagatcactctctcctctcatgggacctgaagaagagaccgcttgagtgttagtttcagcatcacagatccagtggggtgaaaacatgctcaccaaactacagtacccaccctgccagttgtcatcctggctgcagagctttagtgccactaatccctctggccttaaataccctcactccaggcaacagaattggatgtggccttcagtgaccagaggagcagattgagaaagagctaaggctcttcccctccccatctggaagccccttggacaggcagtttcttgtgttcctgtcagcttgcccaccaagtgcagtgataacgggttctaagatgagacagagctttatctctttgtcctgtgcctcttgatgagaagggtcttggtggtttgtagtgtttaccatattgtttattagcttggtccatttccacagaccaaggccttaaattaaacacttgacctttctcttaggttgattcttagttgctgtaataaaacactcatcaaaagcaacttggtgatgtagggagtgggactggagtatttggcgtagggatgacgcaccatcatcatcgagggatgccaaggcaagagctgttgcagagaccacggaggagtgccacgtactggcttttcctctggcttacccagcctacggtcacacacactccaggaccacctgcattaggcagacacttcccacagtaggccaggacccagcccttacagtgattagtcagtaaaatgccccacacatgtgccaccagcctgtcttgcttggtggaaggtccctctcttcccaagtaactcagacttctgtcaggttgacgagaacttagtgcgcatccttagctgtgaggtttcgggccttggctgccagcgtgcgtgctctctgctgtttccagcatcgtctctgctgttatgtagggattgttgctaagagtgctgtgtttcctttcagaagtgcctaactgccagtcatcctacatgagaggcgggtatttctccagcagccatgaaggtaaggagcttgctttgtcctttaaaaatgaatttatctggggagcagggccgaaatgaaagtgcagcacacatgtggaaggacttcctccttcctctttttattttcatttttttttgataatacacacgtttaattgaggattaccatttctaagctgagctgtaaggtcagtggttagactttccatagtgcatgctatgagagctaagagagttactttgtatgtgggctttgagtcaagacttttaagcactgagaaatccactcatcattttcaatggcagtgaccctgacttagcagagttcacaggacaacgtgaagaaaaggggaacttgctgttacacttcctgctacgtcagcctaaactggtccttagggcttacgtcaggaaactttacgtgggtccagggacattttaggaaagaaattatggccgaggattgtttttttgttttgttttgtttttttaagatttatttatttatttattataaatatgcaagtgcactgtagccgtcttcagacacaccagaagagggcatcagatcctgtgacagatggttgtgagccacatgtggttgctgggatttgaacttgggacctctggaagagcagtcggtgctcttaactgctgagccagttctctagccatatggccgagtgtttgaatttcacttaatctgggcgggtaccgcttcattgtaatgattatgtaatgggtggttgtcaggttaaagcgagaggaaaggctctctggagttcttccttggccttgagagtgctagaagaggggggcggctagtgaaaggctggtaggcctaggaaggtcggtaaagcaatgcagaggtgagccgctcacaaaacagtacagggtgtgacagtgacagacagcgttttctaatcggagaaactaagaacagctatgaggaaaaatacaaggtgatctgcccacgagcattaattaatgtcttgatgtttaatgaatgtatacaaaaggcagaggttcttaatatgtgggtcgtgaccccaaagggtgccccatagcagatatcctgcacggcggatatatttacaccaggacttgtaacggtagcaagattgcagttatgaagtagcagtgaaataatgttatggttagggttcaatacgacatgagggtcatagcattagaaaggctgggaaccacaaaaaaagctttagggatagacgagaaggctcagtattataaagtgttataattttttatattaaagtatttatatatcagtattatactgatgggcttctgacttcagattcctacactaaggggaaaagttagtcatggccgcgcttgcctgtaatcacagcactggaagaaaggcaggaagatcctaacactaacctaattggactaagagtaatttaaaacagccacagtgctgggctaggggtggaacttgcctgccaatcaggaaaccctgggatagcgtctcagtacagcacataaccaggcactgaggccaagtgcctataaccttagcgctcaggaggtggagtccgggtgagcaggaagtcaaggccatcttttgctacattgtgactttaaaccttgcctgggatacttcacaccctatcaaaaacagagtaacagttcgcaggatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttgcagaacacatagcatagcccctacgtgaatggatggtattggcgaagcagtcagtctatttgatgggcaggagccgtttgggatctcagaagatgtttgtgatctgaaaagccttgagaggtaggctctctgccaggtagtgtagtagggtcaggatggcctttcccgacactgagactgggaagtgtgcctttccttagagtggatcccagaaataggttttgctttctgaacctatctgtccacatcagtgtcttaccatcagtccgactcccccaaaccagtggcacagacttctgggaacttggatcaacagattctcaagagctactgaattagctccaacgtggagtccagaggtctcagttttcaagtttgaaaatcaccctcaatctcaggtgtacttcctagactccctgagggagctttctaaagtgatgctgctgagacttcaccctaagaccgaggttcccaaccttcctaatgctttcaatacacttcctcatgttacggtgacccacccccaccccccataaaattatttttgttacttctttgtaacagtgattttgctactgttacgatttgtaatgtaaagatctttttcctgatgagctcaggtgacccctgtgaacaaccccggaaaggtcaggcctcacgggatgagagccactgacagaagtggctagagtcccaaattcctgtgtacctggggctgaaagcacctgactgcagtgttttaggcattagtgctcaagcatcgggtgttccttatgagtgacgagttgtccagagggctttcttgagtaggcagctgcccccagatgcatgaaaccagggctgcttaccccgccaccatgtgccctgtgatattctcagagtgtccagacgtgagcaggcgggctgtctactggactgctggctgtgtagacacagctgtgcagggctgcgtccagattccacgctgtctctggaaaggcagttgatggtgtctgtgtgcagcaggcacatgaggagggagcagagcagagagggaggcaaacattccgtataattacaacatttagcaaagagcatgctcttaagggaaatatttttagtaagattttgggttgcttactacacagagaccatcttgtgaagccacctccgccctccaacctattcctttgcccagttgaccgcacacactgaaaaagtaaatttcaaagaagccagcgttttaaaaactgctctaaattatcttggcctggtttttctctccttcctttacagtcttgaaccacagatgcctaggaaacagttatcaaaacaagtgtttctgattggcatctctgattgctcagatagccgtcctgcctcgggtcctcacctggaatccttgtgtgatattttgagtctttgcgtttcacttcgcccttccttcctacacctttatttgagcaatcagatggtgtgtggccacaacagaaataactgttgatgccaactcatctgactgattaccagaagcgtctgccaggtgttgtagagggcgacaacaactagaaaccacaaaatgtccccaaatgttccttatgatcctttgaaaaccaaagcaagaatttaatctagtcttgtatggttgtggatgaattatctttaccttagtggggctaggaggggggcgatgaaagttaacacgacacagttgacaggtgtgtaaactttaaatcgtggccgatgttcacttacaatgactttataacaagaccgtttaaaacagtactggaatatcaaaacccatatggaaggtgggaaatagatcacctcctggcagctaaggctacagagcgtgacgcagagggaattatgtcttgctgataatgtgaagtgcaccaggttgtcataaaagtcagtttgccaggtgtcgtgcacacacctatatggtcctaacacttgggaggcgggggggtgggggtgggggggggcaggaaggtggggagtttaaaggtcctccttaagtatatggggagttcaggatagcctatgctacatgacaccctgtcttaaagggggaaaaaatgtcaacattctttgcctcagttgtcaggtgctaattgaatgcttattgtatgtaaggtgttgagagaacactaagatgcttagggtgtgacccttcttgtccttgagaagtcctgctctgtggcaggcacgtgtcaagattacagttctcagactcattgggcttggttggttggttttgaggcgtggtctcactattactgctcctgtgtggacgaggccgcctgggagctcagctctgtctgcctctgcctgcggaagtgctggccgggactggtctgcctctgcctgcctgcggagtgctggccgggactggtctgcctctgcctgcggagtgctgggctggatgggtggctcattcagctgctttaacactgcttgctctcaatctgtgattgtttgtttttttctctaagtgttacttattacacacttgttccaaaagccattcttacactctgtcgtgaagagggagctgcggatcaatagagcagactgcacagtaactcattaaatccttacaacagtatcaatgaggagagccgaacactgggtttcagttgttccaaatcacgcaactaattggggtcaacctgcctggctctagagcccacactccttaattccagtgctaaactgtcattagtttttattattaattattatctgcttccttctttaagttgagatgtactcataaaaacaaggtcctatctacacacactggcacaaaatatttactggactcgataagaaaaaaagtgtcaattaaatagacttatcaaattgtgtgtatgtgtgtctgggtgctttgcctgtatacatggctgtgtgcacacaatgcacgcagaagccagaagaggactgtggattccccaggaattagagttccagacagttgctgagccaccatgtgggggctgggaattacacccgggtcctctggtacagtagccagtgctcttcacaattgagccatttctccagtctatatatgatgtagttaatttaaccaggaaaaccatgcgtgggactagagacagacagacgaatgccatcaaaagaatctacctcccccattgcaccaagttttccaggccccaacatattcagaaggtggcaggcctgcagagtcgattttgaagaatagcaagagagggatcacatctgggcatgttgactcgtgaggttttcatgtcactgagagtcccctatcccctctgcatatccagccaggtgactcaaccagggactaagccagagaagagagcccagggatgaaggactgtataccaagtgtgatagctctgaggcagggaattcccatcagggagctgttggctgccttgggcgtgaaccactaatctgttgagtagtggatggctaaccagctgatagcccacagtcacagctgctggcagctcatatgtggcgggtgtgtggccatcttttctcctggcctgttaaccttgttctttagccatttagttttatgtgtcttggaccatttggttcccacttttttttctctttccctctctcactcactctggttttataagacagtgtttctctgtgtattcctggctgtcctcaaactcagagatccacctgcctggttccccagtactgggagtaaaggcgtacacaccactgcccagcctcagttcccactttttgaccccttcactgtcccatgagtaaggctttgattctttccgctgtgtttggggacagtgctccaacttgtttggtgtgtgctgctcttaatcttctgtggacctgtgcctttgcccgttttcttctccttctgtgcttctgctgtagcccgtggagtgtgtagagagctgaacactggggcaagtctgtgaggaaggttgggttaatattagcgaagagaaaaaggccagcactctacacgaatggaacaaagctagcaagctaggctgaccagagcagacactggcccctgcaaactgtgtaagatgtgagggggcctacagtgattccgtggttccttctgccagagcccttttagtaggaactgattctgccctcgcagaggacaaggtagtgacattagagtgacattagaactcaaatacgtgagtcctttggaagcctctgaaaattcagcctggcgtaggtacaacagtaagactatggaatcaaaaattaaacagtctgggccagtgagagaggttcacaggaaaagcaccttacatcctgagttctctgagcccctgtgaaagggaaaagagaaatgaccccgagagctatcctctgacctccacatatatgtgcccttgaacatgtcgtgcacacaggataaaaataaaacattgttgattttctttaagtaaaagaatgctcctacagtccttagtttttcgtacaagcacagcctctgttgagcagtatggcctttgtctttaaactctttcaggattcccgtatgagaaggaccccaggctgtactttgatgatacttgcgtggtacccgagagactggaaggtaagacgcccccgcccatctgagggtccatgctaagtgagagggttggcgatgtcagagcgcctcagtcccgatgagttcgatgactcagtcaccagtagccactgcttccctgcaaatcctcagccgaaatgattgcatgcacacccctgtcccacacaggcaaagtcaagcaggagcccaccatgtatcgagaggggcctccttatcagagacgaggctctctgcagctgtggcagttccttgtcaccctcctggatgacccagccaatgcccacttcatcgcctggactggccgaggcatggaatttaagctcatagaaccggaagaggtgagtccgggcgtctccgttactttcctgttgatgctgtattatggcttacagtttcagttttagattttaaagtatttattttgtgtgtgctgatgtgcgtatacctggccgtatgtaggtgtgtcgtgtgtgtacagtgcccatggaagccgggaagcggcattgggtcccctggagtttggtggtggctctactctgtgggtgctgggaacctaacatgggtcctgtgcaagagcagagagcttttatttaactgctgagccatctttctagccatctctccagaatagagatgctttttcaaaaactcttgttttgtacgatgctggttgttggagtgagggttgctattctgcgctgctgtggtaaagcaccatgatgagaggatagtggggctgtttgtttctggtttggttttggtttatacttcacatcattgttcatcaaccaagctcagggcaggagcctggaagcaggagctgacacagaagccacgaagaagtgttgcttactggcctgctccccctaacttgctcagcctacttataaaagccaagggggtccccacccaccactgaatgggttctcccacgccaattaagaaaatgctatacagcagtggtcctcaaccttctaaatgctgcaacctccccccccccccaatgcaatatacctcctgttgtggtgaccccggccataaaattattttttgttgttacttcataactataattttgctactcttatgaatcgtaatgtcactatccaatatgtcgatggtcttagggggccccaatgaaagggtcgtccacaaggttgagagtcactgttcagcaagcttgcctgcagcctggctttgatggaggcattttctccatctctcctcctccatgactaactggtgtaaagttgacataaaacgagacagcaacaccagtagttacttccattattatttaacggaaaaagaaactttgttgtcatcttttttgcccagcgctattaacagaaagccctaagacagaactaccttcttgtcagtgaagaaggtgctactgtaggccctcttcctgaacacattcagcgtagagcatttaagcaggttgttagtgtaacccatttcaaagggagcagttttcgtttctatttggcttagagtttaaaaagttaaagatggagaagatgcacacacatccccactctcactggcagacctatccttttaatagtgtgtggtcagacaaccgctgtcccagagttcggtattgtagaaatgggaactgcactcctgggaagtactccattaaggtctgcagagttaacagcaggaggtgacaccccgacactctgttcagaaggacatggtctgaaagctgatcgggagaaagagaaaaaagtggattagaaacgaggtgggggtggggaggatgaccttgcactggctcaaaatggccggcctcatttaaagtggtacaaaacatacagagagtggggactgggggaaagctcagtaaaaatgccagccacaacaagagtgaaggctgcagcgtgtatctccaacacccatatccgtgatgccaacagtcagggattcagaacaggcagatccctggagctcattggttgtccagcctaatcaaatggatgaggtccaggtctagagagaggactgatctcaaaggataaagtaggggacagctgaggaagatacccagtttgtctctctggcctccgaatgaacataacagcgcatacatacttgtgtgcacatataaacatgatattccctgtggcctgtttacttacaaaaatgctgtcagcgtggaatgctgcagacagcctctgattgtgctcagttgtgtggagatagagaggctcagcctcctgtcatggggaaggctcccacgtaggcccattcctccctcactggcttcctagtaacatggcttggtttaccacgtgaggctcagcgatagaatagtaccttgcttgactcatcgaggccttttgaaaggaaagtaagcctgttttgtgggcagcccttattgattgatctcattccacaaacaggagcttttatgactttattgccaccgcctggggcctgagcgcaggctgtccagctgcaggtaaacctggttatgagcctctgtaaggctgttactgaatcttccactctcctgccagcggtaagggaaagggtgaacatatggcagagggctcctgctttcttacttaatgaaggagctactattaacgcagaatgctcctaaataccaagtggcttcaagtcacatgtgaagcctatgatggccctgagcctctctctctgttgattgagtagcgttattatggctgttatcatcatcgtcatcatcactattgcattttcattgtggggatggctcagtaagtctgcatgtgttgcagcccacaggagtgaattctccccatcaagatccaggagatgcctcctggtgcctctgcccactgaaccatcctccctcccaccagccttgtttctttagcggctgctctccccccccccccttttggacactgagattcatttttgagcttcatacggggcactttacagtctttggagcccttagccttggcctgtacgatgtgtgcattttctcctgctgctctttgtatagtggtgaggaccctgtccttgttcatgtcagaaagataccaccaactcctggggaaaagctgttaagaagttgtcgtgggggaacttaaagggtgaagcagaggaggaagctgttggggatgtaattgtaggcagctgtgtggctgagtagtgcactctgggtaattatccataatatccattacactgtgcatggaaattgtggttttagaactgcgttttggcaggccccctaatcaaatgtcttttgatagtcatccagcttcgcaccctctcaattatgactgactcggctttaatctggagccattttaactgtgaatcaatgtgaatattggggggagagggggacagggttgtatgttgaacgtgtggcagatcagtgatgccatgggaggttttaaaagctggtgttgctagaaagagcctctccttgttctgtgactgcgtgcttgctctttgaagaggaataggtgagtcccctgttgtccctccctcatcccctccccctctagcctcagctcccaaaatgtacattctctaacttaggaagcggaaaggagtgagctggcagtgtgctctctcgcctgctcctcctaccaccaaatagggactgcctgagtctccagctcatcacacgttgctatagagggagcgcaatggtgaggccactgaatcatagggcaccggcctggtggatgagtcagtaaccatagctaccagagcagctttgagatctgcacatacacaaaacctctccagtaagcgctgacagcggagaggtcaccactcaagccgaagactaggcaaaattgttttctaccacagagtggagtaaagagactggcagctgccgtgatgttcctgtcactccgggggcagactagttggcagtgagtttcagattgtggttgctgtccaccctgtctgcaggtttttcttattagcaatatatttccattgatttaaaatatttacctttggggctggagagatgtcttagtggttaagagcactgactgctcttgcagaggtcctgagttcaaatcccagcaaccacatggtggctcacaacctccctcttttggtgtgtctgaagacagctacagtagtgtacttagataaaataataagtaaatctattttaaaaagaaaaagaaaacatcaaaaagatcacccactactatgaagaaccattccagaaatggttcaacacaaataaatcaataaatataacttatcacatgaatagactcaaagacagaaaccacatgatcatttaattagctataggaagggcctgtgacaaaatctaatatccctttatgataaaggtcctcttttaaaaaaaaaatttaccttcaaggggcacgttggcacacacctttaatcccagcaccccagaggctaagactgggctacctgaaaccagcctgggctacataggacattccaggccagctaccaatacaactacacaataagaccctgtttcaaataaaaatgacctctaaccaggatttcggttttgctaggttttgccttttgggcttttcttgaagatagacttgaatgatgaaggatggaactctgggagaccaagatttgtggttacccgagacacactttaaaaaaaaaaagtggaaattaaagttgcataagatttctcggagggcagagtagtagaagcctggctagtgggttgctctggtataatgaggccagatgagttcttccatctcaggtcgtctctggtatttggaagaggtccttcaagagtcctgaaatcaggaggcatttctgtcactgcatcgaaatagttgatgtggactgctgttgtctttccacatacctccacgtttaacctttggcttttgtctttggcagtgtgcatgtgtgtgcatgtgtgtgcatgcgtgcgtctcaaaagagcgagttgggcttgatggtgcatatgatcaaacacctggaagcagaggagggaagattgcgagtatgaagcaagcctgggctagagagatcctgtctctaaataacacaaaatgtagacgaacagcaaaaggatgtggttaggttggctgttttgaagtgtggtgggtttttgttactggtgttttgtttgggcggggttgtttgtttgttttggtttggtttttgagacagggtttactctgtgtagtcatggctgttcatagatgaagaccaggctggccttagactcaggaggtccatctgcctctgcctcttgagtgcttgaattaaaggtgtgtgtgactgtgtccagccaaagtttctaaagttgactagaatgaagacctcagacagcttacatttccacagtggatccaccctgacagtcactcgctctcaagcaggaacacgaatgtttacctgctgggaacagaacttgatcggctgtcctgataatctgactctctagtaggagatctcccaactacaatgcctttttgcccaaagctccaattacatctcctcatccctgcccctcaagtggaccaggttactataatgcactttagaactgtgggaggagccctgttaatttttcattaaatggataatggtgctgtgtgctttactgtccattctgtgggtctgctgggagccaagagctgatggcagtagctataatgatatgaacccccctcagtccgagagctgcaataagtaaacatctcccagcccctctccaatcttattagaattgaacttctgctctgaaggcccattagcagctcactagcatgttcctaatgtttcaggaatgaccattctaattattccttattgactgctacagaaaccatagcacttaatggcaatatgttaatggtccgtgagtattggtcaataattcataaatggagaaaccgtagagagcttgttcctctgggatgccaacaagtccgctagtcttacagtgttacacggctaccccaggtctcacctcctaggcactgtagcccaatcatcacctttatttaatatttggtcttgagagagttaaacgctttcctttccaagttagagagactgattgttagccagagccattgagtgccagaatatcctagggacgtgtttagatctgggctgtcttgtccttccaggttgctcgccgttggggtatccagaagaatcggccagccatgaactatgacaagctgagccgctctctccgctattactatgaaaagggcatcatgcagaaggtaagcacctacagatgctcagaacgctctgctgccttcaaggagcgagtccctaacctcagtgataaggtcatttacaatcgctaggagaagacttgagcctcatcagtgagtctgcggtaccgggaaccataacaatgagaagcattaggagatagtggcacacctgtagcgctagccctggcaaggtagaaaccgagggctgggaagccaaggcctgtttcacctgtatatcacagtctaggtcagtcatgctacataagctcctgtctcctaaaacttgaagtaaaaaggaggcacatggatatttaaagtacctttaggactgaagaagtggctggctcaacgtttgagagcactggcctctctcccaagacctgacttcaggtctcaacacccacgtcaggcagctcacagccttctgtaacttcagctcctgaggtctgatgctatccttgcctccacagacacagtacacacatgatacacaaaactacactcgggctcatacatgtacatattacaaaaaaggcttttttttaaaaaaagtgcttttaatgttgtacatgcggacagaagttgctgtggaaaacaagaagaaactggcttctgcttttcgaaagctgcctccagtgacaaaaagacccaaaggctttaggttcgcttctattgtgtaaagcaagacatgaagaaatcgacatacaattttccattccatacagcttgaaacctttagttgtgaaaacatttagggcacagcatctgctcttgtcattcagtggggtaccatctcaacgagttagaagaataaggaaaacctgtttctcttttaaacctatacagcctagaacttaagagaccctcagtttaacaaatagtagccatctcattcagttaagaggctattctctttgcagaatagaagataaaatattttttaaaaagccactatagagtccttattagagtaaggtgttaagggacttcaaccttaaaaatcccattgatacgtggaagatgggactgaacgcagctttcttaaatatcacatatgttatgcatctccccagactctaacatttacacagtgggggagcctacgtgcacaggttgtatttccctagagtgcttgggacaagaagcatttaatattttgaaaattatctcattttttggaggatttacatagactttagttaattttatggtattttgccaactaccaccacttctccccgcaaaaataaaacaaaaccaaaaacaaaacccaacctatatccattagcattcattcccattttccctctaacccacttgatagcctcagaccaaatctccaacgcaggaagaagtgttttgtcatttgcgattctgttcactgattaaagcaccatgaccaaagcagcgcatagagtgaaaggttcatgtgggtgggtaggcctacgttctggggggttaagtgttctggcaggaagtggcaggcatggcagcaggaatggatgctgagaactcacatcccgaaccatactcaggaaactgagacatttaaactggggctggcatgcgcccgctgcgggccccccccccccccgcccccaacaaggccacacccctaagcctccacaaacattgccactaactgcagacttaagtgttcaaatgccctgagattattggggcgtttctcatccaaacctctataagtgtcatcgtccctgtgttactcccagacccaggtcaaacgtgaaagaatgcagttcaaggcacagaggctcgggactaaggagaaaggggtgtccttcttactgactcaattgctgagcatagactgagaactgtgactggagtgggttcagatcttaacattctcatttggtagcctgctggtcagtcatgtgacctcttctatcccttacagagcaaatgcagtcctctgttgtagtctcggcgatacatctgaaaatgtccaagtaatactaatgtggtacccgttgctttattgtgaccgtggctgaaagagatggttgtaagggaagatagcttgtcatgtcaaaagtggttcatgccctgagtccctaaatggaacagagacctagtgatgatgtcaatactggaagccatgctgcccttggattggtgccaagccaaagccactaaatgcttccctccactaaatgccttcacacaggaggctttgacttgcacaattctttgggaagaaacctcacacccataggacagtccataggctgggttgggcggttcagaccattgaggcttgtggattttaagttcagggctaacctgagctacatagtgagttccaattcaacagacccatgcactaaagtgacaggtgtggccaaggtggagtctggggcctgcaacagactgaagttccacagaagctggctgatcatattcttaattggcgagcttgggagattgctcagtagttaaagctccttccatgcaagagggctggagttcagatccccagaacccaggtaattctagcctgggaagtcaggtgattcaatccctagaactatttcagccaattctaggcttgacagaagggttcctgcctcaaaggtgaaagaaacagtgatggaagattcttgacttgagtcatgtgccttcgaagaaaacagggctctgagcccttcgaaatagcacgtccatcctgggaaaaccataagctctggaggtcactggaaatgtggtctggcatctgcattgtgacttaagtaccacaccagcccctgtcagtacaggtagaatacggcttccttactgctcaaggagcctgcccctgcatgcatttgaaatccaaaaatttaaatgctgtcttttaaaatactgagctgaggtgtcaacaaaacccttggtggggaataggtccctaagatgcgattggaataatcagctgctacttagcccctttggcgcttgactccctgagaggttggcatcttagaagttctcattttcttcactggagtcccctcacccccgagtgtcgtgctccagctgagtctcgtgtgatctgtcttctcacgcaggtggctggggaacgctacgtctacaaatttgtgtgtgacccggatgcactcttctctatggccttcccggacaatcagcgcccgttcctgaaggcagaatccgaatgccccctcaatgaggaggacacgctgcctctgactcactttgaagacaaccctgcttacctcctggacatggatcgctgcagcagcctcccctacaccgaaggcttcgcttactaagtttctgaatggccgagtagccacaccctagagctagcagtcctcatccaggcaaccgagggcagtggttttgtttgtgttcttggctgttcctaaagcttgccctttgagtattatcaggagaacccaagctgtctctggattcgacaccctttaagacaaataccttggctcgggaggagtgggaacagggagagacaaaaaccaccacttcctggggagacgtggataccgtcctccttgccaccatggccagtatgtgcagagcagtactgcagtgtgttcagggttagcgcccatgaaaggggaccgagtgtatgacaatctgcgttgatcatggactactaaaatgccttcacacaggaggctttgacttgcacaattctttgggaagaaactgcacacccataggacagtcgataaggctgagtcggggaggctcagaccattgaggcttgaaattgcaaaactcttgtagctcattctgaaatctttcccctgtagtccagaactggggaggccaggagagccgttactcactccatggctctcagaccgcgttcctctttggccttccttccagccgagccgtcaccataagtaaatcaagtcccttcctcccagtcacacggctgagcgcagacggcttgttttaaaaagatgatgaacatgacagtattttgttttgctttgatttgggggggaagggttcatcttgcttttggaggttgttttggggaaaaaacagtttatataaactgatttttgtagttttggtatttaaagcaaaaacaaacaaaaaacaaacccctttttggtacctgcactgcatccctcgggtggggcagtgcctactttggaagatgctgcagcctgcgaggggatctgctggggcttccccttcgccacacagaagcctgcttagtgctttctgcaccagacaacctgttgaggcgtataacctgatctgtacatttttttaagtgtgcagggcagcctggacacagcttagcgttctacgtgtatagttctccatgctcactaactctccttctctgggaagcagatgtacatactacatacatgtcacatactacatacatgtcatgtactacacacatgtcatatagtacatacatgtcatgtccatttaacgactggtcacctgctggggacccaggcatctgccttgttttcctttttctttcagttttggactttggaccctgcacagccgttccccagggtctgaaacttacctgtcacgcacaggtagagcagtgctagctagcattactggcttcctgctactttttcgtttttttaaattttttattctgattgctgtattatattggggatgttctaaacaaccaaactaaagctgtgtacagattgggtttggagcggtggggacgtcagcaggaaacgccagtgctttgctgcctgattgacaggaatttgctgtccttgacactccacacattgtgttcctcacgtgtgggacaggacacagagctgactgagcgtgggacactccacagccttctcatgacttgtgaaggaggttcacaggaacgaggggtatgttttagagctatgagaacctagtcagcccacagaggcgtcaaacctgaagcttgggccttaattagcattgtactctgatgaaaggactctttcataagcatatttatagctttctaatctatacacagtctatccatagatgcatattttaccccaactggctagagatttatttgttgtaaatgctgtatagattttgggttttttttttttgttcttcctctcttcacttatactggtgtggggtttgttttagttttctttagtgaatttatgctgttttggggggcggattgagaagaatcttccgtagcctgagctgtccctcctgttttgacggcacatgtgccagtcaagggacatgggacagtcgcgccactttgcattcccacgggactcatgtacctcccgcagagccgtccccgtcaaggtgtggggctcctttcatgcatttgcttcttttccagagtgtggatttgaactacttccccctgcaaagggccgcgtgcaccctgccgagctgcgtatattctgtactgtgtacaataaagaagattgctttccttacgcattcctgcaacctgcctctttcttgcactcggtgttttcattttcaagtaagcaagaagcaactgggctttcccccaactcctgcccccaccttcagctattgaactttattggatgacggagttaagttagggctgaacatctgacccactgctagccactccaccccaagcccaccctgcctcccttaaggcatgattttgtttgaaccttggattctgtgaaaagattaactaggcaagaccttttttttgattccttttcttctaactcagcccctttggttgataattttaaaactgctaaacacaaagatcatttccgagtttttctcctaataggttttgttttggacaagtgaaaatatttttttgatggttcctcaaaagaagagcaagtttctcttttttttctctctctttctttctttctgtctgtctgtctctctctgtctctctctctctctctgtctctctctctctctctctctctcttttcctttcttctccttttgtgagacagggtttctctgtgtagccttagctgtcctggaactcactctagaccaggctgacctcgaactcagaaatctgcctgcctctggctcccaaatgctgggattaaaggtgtgtgccactactgcctggctctctttttctttctttgtttctttcttttttttttttttaattattcctgtgcctgtagcagtagataatcttccctccatgtccaccgctcttgggggaaatatatcccatgtaacacatacatggatacatggaagtcattggcagagttgcacagcatcctgtgtgctgggctcctgtttcatccttgttatacagtttttaacttggggctttcgagactcctattgcagaagagaaacaaagtggagccttgtagggcctggaacagaaggctttctgtaaggtatctgctctctctcactgttctacaagtcccgaagtgtagaaacatccaagactgaattggtacacagccgctcgaatggagacatgtgggagatgaatgaatgccacataaaactccattagctttgacagatgaagaaaagctgctcagggaaaggaggcagggtgtgtgggacaaaggggctctcctcgggtgcctgactacgataaaactattctcctcgggctcattatctagcctaggctcagacccagatcattagcctcgtgccagaggtcccctgatagtgtggcctggctagtgctggatgctggggtaaggaagccagagaatgtcaagtgtcttcatggtgtcctctttcacgagccaggttaggggaacaatgtccattcagctgttagatgacaaagaaaatgtatgaggacaaaagacggggtttgaaagccagagctcacagtctaaattgtaatgcatctgggacttggatagtgtggaagaaaaacactcaagacagtcgagctttggcaaaggtagtttgccaagcagtcaggtaggtagagcacaatgtgtctcaaaaaatgcaagccaaatcgggggggggggggggcgagagtcctgaaaatccaatatagtgctaaaaatcaacactggttctctctggtaaatatattgtgcttcatatagagggatccatggtgggacttggacaagcagctgtgtcctggttctgacaaccacatagaccctatttagagagggatccttgagtgtctagccttccggtagtccttccagttgaagagctggctctgacagccagccttcagtctgttgaccttggcagtggtcctcagctaaccatttgatagcactttacagtttgcagagcacagctttctgaaatgggaacacttggtcgaaatcaaatacgaaaataggactctcagcctccaaaattactcttcagaatgttcatagtggccaccatacaaaatcaagctggactctgggaggttggccgtgtgggttgtgaccccagctatgggatcttgaagagcatcctaggtcaatgaggtaaggtgccacttcctagaaggcctagaaggcaggggatagttcccaggggatggaaggtgtgtgcgctgctctctgacaagttcactggccccaaggacagaggccagggaagttgccatggagagagaaaggggaagagaaaaagcttgtgcaaagaaagaaggagagagagggcacgcacctaggcttaaccttgaaattatatatgttgattattaaatatactatatttttaatttttcttttagcatgaatgcatggaggtgtggttttgatacctcattaaataaatctagtggttagaaagcccaaaggtaaattctgagtctaggcagctggtggcaggagaacaaaacagcatttttatttctcacgcacttaagatagaaacaagcatggagtgaccactaaacattcataatttgaaacagacagacaaaatttagaaggataaagttgaagttgtgttgaaggtacaactttcccgtaacaaagatggctgccagtcatgtggcaccaagagtttcaagtctttgcttaactggctcaactgtgagaccttctttaacctcaagatttaaagctgcacccctaaccacccccttcttccacagtagctagcatcttctgacaaatgtcacccttttgttctcttggtcccttctgccacataaggtccacagcataaagatttgtatttgctttctttccctcagccacacatcccaggagcagcacctgccatggtaatgccgtttcttgccagatggcgacagttagtgtgttatgtgtctagtctagagaaatgttttgtcagtagcctgagagctgcctagggactgggtgggttccatagtgattctccccacagccaaattgtctttcgaataagtgacaactgacacctgactgaatgatggaaccgagatgtatcccccttcagaatggaatcagaactacccagaagaggtctgctcagtgttagtggccaacacagaagacgccatgccnnnnnnnnnnnnnnnnnnnntctccccctccccctcccaactttccttggcctttggaccagtgaaattctcagagagcagcttcccgataaacctacacgcacatgcacacacacacaaacctgacttgaattggcttatttcactagtggagaaataacttatcagaaactagagtctgaaaccggcttaactgaagctggctgggcatctgtggaagggctaggacaacagagagatcaaggacaatgccaccttaggcagaacaggctctcaggacaccagggtctgctttgttctggttttctgagctgagaggtgacctcatctgacgtgcactgcaaacagtgttcttttgacttctaaaattgaaaggaacaggagagggtaaggaaggaagcaagaaaaccaaacctaggctgctgcaaaagcccaggcggcagggctaagtcagacctaataaactttgggcagttgttggggcaaagagggtttaattacagctgcaaggtttggggccaaggaaagttgacattgctgtgaattgaaacaaagaaacatgaagagaaatgatttgtgatgggaaaaccaggccttcacccaaggcatattttacttatgcaaccgttagaaatcaggtggggaactgcagagttggctccttggtgaagagcacttgttgctcctgcagagcacctgagttcaattcccagcactcgcctggtgcctagcaactgtctccacctccagttgcaaggggctggcaccaggcatgcacatagtttacacacacacatacacacacacagagagagagagagagagagaagcaaaatagtcatacacataaaataattaaattagaaaaaaatatcagctgggatgctgggtctggagtttaggggaactccaagctggggatagaaatttgaagtctaagccagacgtggtggtacacagctttaatcccagcactagggaggcagaggcaggtctctgtgagttcaaagccagcctggtctacagaatgagttccaggacagccagggctagctacacagagaaactgtcttgaaaaaccagaagaagaagaagaggggaagagaagagggggggggggaggaagtgtgtgtgtgtgtatgggagtgttaatcgctgagactggcatgtactgaggctggagaccatatgaatgtctgtgatccatgcttttcccagaaaccatgtagaagtccatgatctatgctttcactgcctgtagaagccaagaaagaaaaagagctgaggcggaataaaatcacaggggaaggagcatgggcagagatctggacctttaactgctccatgactccaagacactggagaaacaagaatccgaaaaggagactggagaagtgtgggaggcggaggaaggtggaggaaggcggggtctgttctccacaggcttctggtgtgaccctggactggagtatcaagaatagtctgggttaacttgcatgggatggcagacctaaccgctcaggactgctgggattcgaagttggacttaagaccagaggaagccccatggatttcaaaatcttggcttgaaaggaactcagcctcttgcaaaccctgcccttcaggcataacatatgaatgagcggtcagattctcacaaattcagagtaaaaaaactgccaaggaagaaggggcgggtgctgtcactagccccttcccactgctttggggttctgtttattcttgttttattttcttaaggtgcattcttattttgggaactgtctcagttagggttttactgctgtgaacagacaccatgaccaaggcaagtcttataaaaacaacatttacttagggctggcttacaggctcagtcagaagttccgtccattattatcaaggtgagagcatggcagtatcccggcaggcatggtgcaggcaaagctgagagttctacatctccctccaaaggctgctagtggaagactgacttccaggcaactagggtgaggatcttatgcccacacccacagtgacacacccattccagccaggtcacacatattccaacaaggccacacctccagatgatgccactccctggtccaaggatataccaaccatcacaggaacattaaatgttttttaattaccttcgtattttagaattatcgtatgtcctttgtggaaattttgaaaaatctagaactgaaattgaaaactactttgaatatttaaattagaggttgcatttaacaccagtgtgcttctttactaggtgtcatttttaaaatacacaaatttgggctggcaagatggctcaggggaggaaaggtgcttgctgccaaacctgatgacctgagttaattcccaaaacccacctggattagaagctctcactgtctcctccactgtgcgctgagggatgtgatcacccccacattggcacattggttaactgactggttaacttcttaaaacataaaaattggccattactacattgtacatagtttcgtagctcattcatttcttttttttcttttttttttttttttttcgagacagggtttctctgtgtagctctggctgtcctggaactcactttgtagaccaggctggccttgaactcagaaatccacctgcctctgcctcccgagtgctaggattaaaggcgtgcgccaccacgcccggctagctcattcatttcttaaataaaatattttaaaatccttctatatcaaaaatatagatggggcgacggctcagtgggtaaatctgtcatacaatcttgagacctgagttcaaattcccagaaatcatgaaaagttgggtatggaatcacgtgcttctgtaatctcagcagagacgaggaaatttctggaagctcatggcccagcaaagctgacataaaagccaggggacagggtgggcaggataagatagtcacagcaaggtagaggtttgaaccaacactcaaggttatcctttgatttccacagatgtgcttcaacacatgtgccctcgtgcacacacctatagatacatatatacatacatgtaaagacttaaagtatggagctggagcgatggttcagtggttaagagcactggctgttcttccagtggtccttagttcaattcctagcaaccataagctcacaaccatgttatctgatgccctcttctggcatgcagatgtacatgcagatagagcactcatatacatagagtaaataaataaatttttaaaaattagatttaaagtatattgctatacaataccatttttaatgactgcatgctattccacagaacatgtttaaggggttgccacacttcctggggaataaatgtaccacaaaatgaagccaggtaagacatctgccaagacaaagcaataggaaccaacatctgttaattttacctcctgagaatctctcagatctgtctccatagtcagtctggttattcagccccctggactattagggccatcacttaggtctcatctcctcctctcttgccccaccccaacctcctttccaaaatgtactaagtgatttttttttttcaagctcatggcatccccatggacagagaagttgtggttgcccagccaaatgatgctcagtctacagagtgtgggtagagaccacactgaggtcaatcttaaacatagagttgaggtaaaaacatatatggcaacaatattgtgtaattctatttatgtgaaatctcaaatagatgcaactaaggcataatgatagaaatcagaaagacacaatggtgctgtaggataatggtccatattctaatttgggtaattgttacacgctcactgaactaagccccaaagtctgtcttaactgtcctgccccagcttggacactccctggcccttcagtgttatgatacctccatccctgaccctcaactgtcataacctccatgtgaccacacctcacccacagaaggtactccaggactctttcgaacactcattaatcaaccccatgtttgccgctttccatagttgctgctttttaaagtagagggcctcactgtttaattattcacccatttgcaagattagctgattgtttttcccaacagagaataaactccaagaaagcagaacttatctgtctggctaactgtgttatctctaaaagagaaattcctaactgaggggctgaagagatgacttcacaggtaagagcacttgctgctcttccagagggcttggttgggttcaactcccagcacccacaactgtctgcagctccagtcccaggggtttgaccctctattctgcacatacatcacacacttatacacacacacacacacacacacacagatgcaggcaaattccccatatactcattaaataaataaaacgttcaaagatatttttcaaaatatctgacttggtgaacctggaaaatgtgtatcattgctcacagagatgttgaggagttcaggggcttggcctcttctggtttcaccgagcacctgaacacatgtcccatatatacacttacacacacgaataacagtttttaaagtaaatctttttaaaattaaatatatttatttggtagcaaggctttatattttaaaaatcctgttgtattgagtgattgtgaccatatatttatacttaccaaaaaacaaacaaacccaaataaataaccaactctgacaatttcataaatgaatctttcagtgagattaatttgagagttaattcttcattcgtctgttgcaagggtgaagctgggctcagtgtcagctctactcctattaggaattttgagtgagtcatgaaaatatccaaagggagatagcctctaccatgattaattttcttatgttcttgtagtagtaggactgtggccagatacatggctgcagtatacttcccagcatcctttacaatgcagctgtgcctattagtaatatatgacttctcaactcaaattcaccatcttttttttttcttttttctttccatctctgaaactgttctgagtcctccaaacattttcctttagtgactggctctgtcagcataagatgccagagtgatattagagaaaagggatttacttccggtgtgcatgagcctgcagtaagtagcccagcttctccaaggcctggcggctgcagagcccagaaggcaacagattttgagcagcgtagtacttctgactcctgcagagctcacagcctctcaagtgcctgcctcctgccatgcgcag

SEQ ID NO: 1148 - DNA, 1996 bp, Mus musculus
ggaagcaccatggatgggttttgtgatcagcaagtcccttttatggtcccagggaaatctcgatcagaggactgtcgagggcgacctttgattgacagaaagaggaagtttgtggacacagatctggctcacgattctgaagagttgtttcaggatcttagccagctgcaggaggcttggttagctgaaggcaattcctgatgatgagcagtttgtcccagattttcagtctgataacttggtgcttcatgctccacctcccaccaagatcaaacgggagctgcacagcccctcctccgagttgtcgtcctgtagccacgagcaggctcttggtgctaagtatggagaaaagtgcctctacaactattgtgcctacgataggaagcctccctctgggttcaagccattaaccccgcccgccactcctctgtcacccacccatcagaattccctatttcccccacctcaggcaactctgcccacctcaggtctcacccctggagctggcccagttcaaggggtgggtcctgccccgactcctcactcacttccagaacctggatcacagcaacaaacatttgcggtcccccggccaccacatcagcccctgcaaatgccaaagatgatgcctgaaagccagtatccatcagaacagagatttcagcgacagctgtctgagcccagccatcccttccctcctcagtcaggagttcctggagatagtcgccccagctaccaccggcagatgtcagagcccattgtccccgcagctccgccaccccttcagggattcaagcaggaataccatgacccactgtatgaacatggggtccctgggatgcctggtcctccagcacatgggttccagtcacccatggggatcaagcaggagccccgagattactgtgctgactcagaagtgcctaactgccagtcatcctacatgagaggcgggtatttctccagcagccatgaaggattcccgtatgagaaggaccccaggctgtactttgatgatacttgcgtggtacccgagagactggaaggcaaagtcaagcaggagcccaccatgtatcgagaggggcctccttatcagagacgaggctctctgcagctgtggcagttccttgtcaccctcctggatgacccagccaatgcccacttcatcgcctggactggccgaggcatggaatttaagctcatagaaccggaagaggttgctcgccgttggggtatccagaagaatcggccagccatgaactatgacaagctgagccgctctctccgctattactatgaaaagggcatcatgcagaaggtggctggggaacgctacgtctacaaatttgtgtgtgacccggatgcactcttctctatggccttcccggacaatcagcgcccgttcctgaaggcagaatccgaatgccccctcaatgaggaggacacgctgcctctgactcactttgaagacaaccctgcttacctcctggacatggatcgctgcagcagcctcccctacaccgaaggcttcgcttactaagtttctgaatggccgagtagccacaccctagagctagcagtcctcatccaggcaaccgagggcagtggttttgtttgtgttcttggctgttcctaaagcttgccctttgagtattatcaggagaacccaagctgtctctggattcgacaccctttaagacaaataccttggctcgggaggagtgggaacagggagagacaaaaaccaccacttcctggggagacgtggataccgtcctccttgccaccatggccagtatgtgcagagcagtactgcagtgtgttcagggttagcgcccatgaaaggggaccgagtgtatgacaatctgcgttgatcatggactactaaaatgccttcacacaggaggctttgacttgcacaattctttgggaagaaactgcacacccataggacagtcgataaggctgagtcggggaggctcagaccattgaggct

SEQ ID NO: 1149 - protein, 451 aa, Mus musculus
LKAIPDDEQFVPDFQSDNLVLHAPPPTKIKRELHSPSSELSSCSHEQALGAKYGEKCLYNYCAYDRKPPSGFKPLTPPATPLSPTHQNSLFPPPQATLPTSGLTPGAGPVQGVGPAPTPHSLPEPGSQQQTFAVPRPPHQPLQMPKMMPESQYPSEQRFQRQLSEPSHPFPPQSGVPGDSRPSYHRQMSEPIVPAAPPPLQGFKQEYHDPLYEHGVPGMPGPPAHGFQSPMGIKQEPRDYCADSEVPNCQSSYMRGGYFSSSHEGFPYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECPLNEEDTLPLTHFEDNPAYLLDMDRCSSLPYTEGFAY

SEQ ID NO: 1150 - DNA, 81199 bp, Homo sapiens
  misc_feature (1)...(81199): n = A,T,C or G
taagatgaggccctagggtcccactgagcttcatgccattcctaatctgaccaaaatgaaattcggtgtcccagggtccaggtactgctgctaaggaaatgcggtgcttccctccacacacactgagctattgcagaggccaggttaccagttcctcattcttctcccaccatgtgagcaaggcagaagctgcgcacctgtaaaacttaagtccacaaagagaaggtaacccagccgcccctttctcaggcacagtgttttgctgtgcggtagaaatcacatgttcattcacattttcagtcatcctttagtgaccacctcctaagtgccaggtgctgtggttggggctgaaggattcagacaagagtctgagaggttccctgtaagaggaatttgtgtcacaggaaatacagatgcataaataatgtgatctgtgctttaattgaagacatcacaaacgctgtgacgtttgaagaggtttttatcttttggttgattgagtttttgtttgtttggttggttgggtatttgtttgtttgttttttgagtcagggtcttgctctgtcgtccagggtggagtgcagtggtgcacaatctcagctcactgcagccaccacttccttagatcaagtgatcctcccacctcagccccgctaagtagctgggactacaggcacgcaccaccatacctagctaatttttgcattctttttttgtagagatgaggtgtcgccatgttgctcaggctggtcttgaactcctgggctcaaggtcttccagagtgctgggattacaggtgtgagccaccacgctcagcctggttgattgtttttaagtacctaagagatgtattcaatgattccaaaatgtgaagtgtcacccctctaatgattttctaagacccttgatgtcctgtccctaaaatacccattctagccctttcccagtcatatctcccccagacctaacattctacagtttagacacacatgaggaatcaacagtccctagatgtgccagctattgccaagcccccatatgtttgtgtgtgctgttccctctgcctggaaagctacttgctctgcaaagcaaagttgagtaattaatcattcaagggctgtcccaaatgtcaaccctctctaaagccttccttgaccctcacaggaagtactcactgctccttcatttgtactctcagaacccatttacagggctctattaagacacctgtaaatattgtacaatagctatttgttcctgtgcccttcttccacctcccactagactgtgaccttttctcagacaagtcctaagctgaggacaccagcaactcaacaaatgcttctagaagtgaaaatgaaatttactgctgtgcaaactcctatgtgtcttaccttaagaacccattaaaggtgattgcccaggccaggcacggtggctcatgcctgtaatcctagcactttgggaggccaaggcaggtggatcaccttaggtcaggagttcaagaccagcctggccaacattgtgaaaccctgtctccactaaagatacaaaaacgagcacggtgtggtggcgggcacctgtaatcccagctacttgggaggctgaggcaggagaattgcttgaatcccggagacagaggttgcagtgagccatgatcgcaccattgcaccccagcccagatgacaatgtgagactccatctcaaaaaaaaaaaaaagtgattgcccagccttatctgatagaaggaaggaccagtcactttccatggtcagatacgctcacccacttattgctgggactctatagtgttacgggctggggtggaggggacctaaggttagaaatacagtataataaaatttatatttttaaaaggctgtaacacatagatatagttgtttgggcaatagaaaacagaatgatacgcaagaaactgttaatcatgcatgaaaatggatacaggctaggaggttatatacaggctttgatttttcattctacacctttctgtgctgttgaaatttttgtcatagatctctgtcacttttcgaagaaataagagattaaaacaattcctatgactgcatcttaagtgaaccaactaaaattaggttgatgtttaccaaaagatgtgctagagtctcactacaatgttcatagcagcatcattaaaaatagctaaaactggaaactgcccaaatgttcactaacagtaacatgggtaaatgagttgtaatatactcatacagtggaatactatacagcaatgagaatgaatgaaatataactacatactacaaaatgaatgaatatcccaaacaaatgttgaagaaaagaagccagataccacattatacatggtatgattccatgtatataaagtacaaaaacaggcaaaactgaacagtgatgtcagaagccaagatggtggctaccctcgtggggaaggggatttaacaactggtaagggctatgaaggcggcttttggtgggatgaggaagggagccgggagtgttctgtttcttaatattggtattgaatgcacagaggtgcttactttgtgaaaactcatagagttatatatttgtgatttgtgtattttcttgtatgtatgttatacttcaattaaaaagtaaacaaacatgcaaaacaggcccaaattgaggcgcctgaacattcccttacatcaagctgataatccctcttgagagttggatgccgaacttccagcctcctagaaataaatacaggtcaacgtggagatgggagtgaaactgtgccccctgatcatttcatgagcgctagtgtcttgtacccaagtagagccttatggcaggaaggaacagacagagaacctggatgccttcagggctctcctgggatgggatgctgttctcatattttaaatctttaggcatatagcttggcctcttgataggagagaaggcagagaagggagaggagcggggatgagaagaggttttcagatgggtctggtttaaattgaggctgcctcctgccccagagccaacaggcaggcaagatagactattagcaagaaacatgatggggagaggagggaagaggatgtgtacttctttttaaacactcactgtggttatttggtttgacatggccatgagtgggaagatgcctcaggctaaaagggcagactggaccccgcatttgaagccaagcgatcaaatccactgacaggacatttgttctgggggctcaattgtcagttggccatggttgatcttccctttgtccaactcaaaataaatacagcccactccacaggcccagcagagcctcagcggaggtgggcgtctacagaccaagccaagagctgaaagaaccgcccgccttaccacccgctctccagctgccacattgaagcaggcctatgaagaagccccgctccagccctgccagccccttagtctcttccagtggagctgcgggagaggctgaagcaaggcctttcgtagctcgagacgggcaagttctgagtcagcctgctcctgctgtaggagctgaagtccaaggagggcacagaaggggttaacccctggtcacataaaactcaccaccatgggcataaaaggaagcaaaaagaggactctgagcggtcaaaatagattttgccaagtctacacatccaagtttgtccacttcctcattggaggggatgcttttgctgctactcagaacctctgggctctttctctatgcccattgcaaacacacttggtttgctggtttccacgcctatggcagatcagagtcagaaaattacaacagatgtgaggggctagagaagcatgtgctgaatgcatcgtgatgttctgattaacaacctgacattgaaaagggggcaggaaaactcggaagatccaacacaggatccaccaaaagtccagtagcccgaggctctttcatgggagacaggcagtcccccagatttctcaggggtagggaaggatgcaggcgtgtgtctggctctaggagctcttccctgcatggtgagatgaaaggactcaggaggcttgggagagattgcagggtcgcatggctgctgtgcagattctgctgcagagctggactcagttttgaagtcaaggagaagccatgggaagtttcctaagatttccatcttctttctttttttttttttttttgagatggagtctcgatctgtctcccaggctggagtgcagtggtgtgatctcggctcactgcaacctccgcctcccaggttcaagtgattctcctgcctcagcctcctgagtagctgggattacaggcacacgccatcatgtctggccaatttttgtatttttagtagagatggggtttcaccatgttggccaggctggtctcaaactcctgacctcaagtgatcggcctgcctcagccttccaaagtgctgggattacaggcgtgagccaacacgccgggctagttgtttctttttaaagttgtgggcttaagaaataaacctgtcagccatcagaaatctaaataggacatgctcttccaggttttcttgatagtggctgtttcataagaattgaaagtcagcaggagacaggagaaaggatgtcttcgagctcagtcaagaaccaggagaggaataaggtcccccagactggctggatcagaggctcaagaacatgcattctgtgttctgtcagagatctgacttgctcctttctaactgaggaaactcagacatggttttaaacctctcactttgaaactcagttttcatatcagcaaattgggtattattaccacttctaagagagattgggcgtattaaatgaaacactgtagtatgtaaagtgtctagcacagagcctggcatattggagatgctcagtaaacatcatttcccttctttttctaaagtggctttcatgaagacaaatccttgccagcccaggacaataattcagaagtctggctggagttgctgaagcaggttcctaaggaagcacagcagctctcactggcatggcaagcaagcagccaaagccctgagaacaaggtgaggggcaagatgacaaagtgagagactgcaggaactaagacgacagagcagagtgaataagagcaaggactctgttcaagatctacattaggtgcctgactccaactcttactagctgtgtgaccttgggcaagttacctaacctctctgtctcactttcctcatctataaaacggggagaataatgatatctgtatcacagggttattaggatgatcaagtgggttaatataagcaaagcccctaaacagagtctagcacagggaagtgttcttgcagtgctggccgctgtcattaagcacacacagcttccacagggcagcagagtggctcctgggcagatcctaggggagcaggctctgttgcttgggcacactcccttttttactatgtgctagctatgtggcctggagcaatagattgaacctttctgtacctaagctttctcatctatgaaaagtggagataatgataatagtacctccctcagagggctgttgttgggactaactgtgccaagtcatgtggagtgtttagcaaagtgtctggctcatattaagtactcagtaaatgtcagcttttactattccccggctggaaggaaccctaaaaacaatatgccccctattttttaaagagacattgaagctaacagatgttcttttctcccttaagtttttagggcctttatttctgaattttagaaaggaagataggattctttatctctcccttaaataaaaacacatttcagtaccttttttttttttttttgaaacgaaatctcactctgtctcccaggctggagtgcagtggcatgacctcagctcactgcgacctccatctcccaagttcaagcgattcttctgcctcagtcttccaagtagctgggattacagatatgcaccaccacgcccagccaatttttgtatttttagtagagacgggggtttcaccatgttggccaggctggtcttgaaatcctgacctcaggtgatccacctacttgggcctcccaaagtgctgggattacaggtgtgagtcaccacgcgtggccaacatttcagtaccttttttaccctttcctcaaatcccttccttccccccatacaagaataggaaaggactccaggagcactgtagcccacatcccaaaccctaggcaggtctacactcaccccggcatttctaacagagaaagaggagggattttcccagtatgagaaaccaggatcatgatgcttccatatttcccacgatcattttggtgatcagctcaagacagggttgcctgccttatatggtaacttgcttttggcattttaggggaaaattctaaaagcagttctctaaagggtaacagttctcaggcttggggcaaggtactttcttttctattcttctacactgttcccctctagacacactgcaaattgagtttaaagaacaagggtctagttatcgtgctgtgattgagttttgctactgccagaggacaaaggctagattgacattagatgaatgtgccagaggactggtctctctttttgttttcttttccaatcctgtttctctcctggaggagagggaatgataattagaacacatgcttgttcgacaaaacctcccatgtaagtaatgttcctaggagggaagcctcaacgtaatagacaaagaacttctaaatactacctttaactcttataaaggcaaagataacaaaagaagaggagccggggaggtaaatcataaagagaagaaggaagaagagtggagagaagatatcagtaaatatttaaaaatgaggagcccaccctgggcccaggagctggctcaggtcatcgcaggctgtactctgacttttaatgctgcagccaagatggctgtgccaagagctgtaccccttgtccagcacaaacctccatattcccagaatcagagactctgagagatggaacaatcctcagagttcttctatcctggaaaatgcattagtccctctaccctatccctaaatctttctgcataaatgcctcctgtgatggaagactcagggccagatacaatcttcctttgctggaccactccaaacatcccagagtccttcctaaccctatttggagctaaaatctgcctcctttgactttggccagctctgtcctttaccactctgggttgaaatgatgtttcccggtagtcgctgaacaagagaggcagatgctaggtctcccatatatgggctctgggatgtgaccaccttggctcctatccaagttcagcaactgactttcaagctctgtgaccattggcaaactacttaatctctgtgtctcagtttctcaactatatattatagaatggagacattaatagcctgaccactttggtactattattatgaggattaaatgagataatctgtgaagaattatatatggcatgaacaagtcatatataaagtgctgagtaaacttcagatactgaagttacacagcagactgtgggctcctccaacgcaaagactgggtcttattcatctctgcaacttttttgcctagcacgaagtctggctgaatatttggtacaaaatacatgtttactggataactaaataatcgcaataattaattggcaattattctggtgtaatcccctgcacatgatcgcgtgttcaagacaagcatttttgaaaaaaaatctatcgcccaatcctcccctgcccccacctgagccactatttgttactactcaacccagaactatcctacttctcttttcaaagtggaatggagagacttggcttgaggcaaaggtcacaagagccaaactccaggcatcaggtccaaccctgtgaggaagttgctgtgaagcgtgcggcactgttttcctgtagccaaagttataaagtgtgattgatgtgttacggtttagatggtgaggatatgtggctctgtgggctgtaagccttccggagggctggggcctgagagacttaagggaagaggagtaagaaagctcctttggaaaaatgagtttagagagcaggatgtcatgggatgggatggggaggagcgggagtgggggtagacaaaattggggaggaggaggatctgggagcttacctgggcccttcatctagctagggagatagagctctcaggaatgtcagcaataagctcagagcacaactgtactagtgtaagatctccagccaccaaacagaaacggtaccacctggagaaagaaaaagggcactaagggaaaactggagtcggaagcaaaatgttctaccaggaaactagatctcaaggaactgcttgttacatgttcagagtactttccatccatcaactcatgcccatttcagtcttccaaagtcaacagctccagcgtgcctggtcagtgctgagcccaggactcaacacgggtgctgcaggttgcttaggggcacgccaacatttcaagggctataaacgacagaccaagtgtccgctctgtttaagagacacaagtggagataggaaagaacctttgacttaagtgtgggggtggcaggggcaggaactgccccagagttggccaccgtgggacccccattgctaggggctctctcctgtcacttagcatctttcctccccaccgctggcacgcggcgtgaatggcagggcactccagcaggacgagaacagagctccgtcacaggcccccagcatccccggagagaagatagagccgccccacggccttcacaggagggggtaagggggcggagaggggagaggattgtttgtttatttgtttcctggaacaccctgttaagaatctcagcaattgcagttagtgccctatcgtttggcaagcagagccgcttctcgtcgttcccagctgcacgggatctaattcgcaaatacaccatcttgcattcaatacttaaatggaaaacaagcagcccggggagggaggcaaaaagtctgagtctgcatgcccgtttcggagggatttaggtttccaggtcggtggactggctgctgctgtccccggagaggatttctttgagcccgaaccctgtctcacctcgactacagaacccactctggcggaggttacgagccgcagttaaagagaaaacgggatttggttgggtcttaggccttgccagtacaaaatagtaacaaaaatctgtttgagagctgagattttaaaaggagatgctgcttattcttcccactggaaacctggttaaaagaaattaaggcctctcttaaaggtaactaagattagagggctcggtttccgttttctgtgtttctgtgggctaaacgcccaggtcggtcagcgagtttgtgtggaatgacgaattcctctcccctgaattctaaaatgataactttgcttggtgctgcagctgcgaacgtctggcgccaagagacccaattctggtcggggctttgctggatggagaagtgggggtgagtgggtaagggggaagagtcgtgcctcggtgaaaagtcgggagagcggcgagaagggaagtaacggcggctcctcctggcctcggcccctttaagtgcttcactgactcagctaagcttccccctcaggtcgcgttttttatgaatgaaaaacgtccttacattcattatataaacaagcctgtgctgattggccaatggcccccggtgcataaattatgtaaaacagacccctgagggggtggagagagatgcaccgctggccaatgggggccggagttgatggggcggcttggttggatttgcccgcagacagggtaaacaagaggtgatggacagccgcgggaacggcctctggccaatgggaacaaggctgggctagggccgcgggccaatggcggcgggcggagcagcgagccgcggggggccgggccagcgctccagcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggtgagggggctttgcgggggcaggggggagatcggaaggggcgtccggccactggtccgacaggcccagccggctagagttcacgggctgattcagaatcttcaaagtcggggtgcagtagctggggtgaccccccccgggttgaccgccccctccccccgcggcccggtccggtttggttcttgggaggcgtcgggcgggtgcggctaacggttccggagcgcggggagagcggctttccacacgtcgtgggggaggcgccccggagcgcgagtgcgggggctcccgagtggatgggggatcgcggagttgcgaggctttcacagtctctggagattcgagagccccgaggggacttggaggctcgcgagaagagacgcttggcggagctccgcagttgggaggagggggcgggaagcagtttgaggggaatgtctgagaggcgctgccccccagagcaccgggagggggtaaatgacacaggcaagtgcagcctgcgggggcgggggtcgaccaggaacttacgcaggccttgcaagtttcaggtggtggaaagtggacatccagtcgccctgctcccacccagcaggctgagggcgtccggctgtgcggcgactcgagaaaatcggggcgcaccggaacagcggcctggggatggtggggataacacgggtgtggaggggacagcaccgaaagatgccgcagcctcgcagcggattagggttccggccgcattttcagagggtggagaaaactcgggggggaaccgaactcctggtcgacgagggggtgccagggagagatgttgggggtggggggattggaagcggttggtagcgccgggcgccgcacctcgtttttatgaatgtgggtgactttatgaatgaagcgggtttctttcgttggctcgctgctccctgcggcttttttttttttcttccctttttgtgaatgaagcattgagctttcttcctaaaacgctggggtgaggggcctgcgtcggaggctgggcgtgcgttggaaatgggggcgggggcgcagctgaaggagttttcatgaatggggaaggctgagaattgggtggaagtgtgtcttgttttgtgaatggggcccagcgctagagatccagttacagcctctacctgatgtggcggccgcggctcgctctcccattcataaaaccgggcccgctgcgcgccacaggggaggggcctggatcgcgccgctgcgctgtgctaaagttttcctgggggcgcccggggcgcgggtggtgggggggcaaaggaagtggtttaaactcctggatgaactcgagcctttccttcaggcttttaaaaaaattatacttggaatacaatttttctaaccctggaatgcctcttttccgttcgtttatggcagtttatttcttttaattttttagaattttttttgctcttccgggtgaagtatttcatcatgagactgaaaaatatctccccctcccgtcttctactggttgtccccttcctcctaacacattcacaaaatgtcttaggccatgatttaatctgacagattttcctaagcgacagagcactctctctttcatgcccctcaactcactgctgaggtttctcagattttgtatacggtttggtggcatttgagagaggcgttattctgaacatttcttgtggtgtttggacggggcacgcaggcaggctggcgcgagtgtttttctaggaagttatgaactgtgtgctattttgctcctctctttcctttgactttgaaaatatctgattccttgggccaaagtgctgcggaggatgctggctgtgaaaggtgtccttgtatcctgcccacttatgaaaaatttgatatgctacacacagtgtgaaaaacaaattggatggaattgctcaccgggggaaaagtttcctgtttaaaattgtgtatatgtcaaacaaaagaagttgacctttaagcattttgaattgcttagagctggagtgagtgaaattaatgtttttccaccttttgttgacttaacggtgtttttatttgaagaataaaagtgtttaggaagatggtacctccctaaaattgttactttattccactcacgttaggagaagttttctcccttctaaccccaccctttttccccagactcacacacttacccgtcctgaaatgagtttcatttgggggtgggggggtatgtctagaaaaaaatgattccgctatatgaaacagcctaagttttaaaagacctttggtagagatgcattgtaccacatgcaatggaattagtttttttaatccattacttttcatagacattttactcttttagaagttggagatgtcacaaatatctctgtaagtaaccagggagatatttgtgacattacagatgctatatctgtttagtcctcttttaaataaagagttgtgtgtgaagataagcatacctctgatcaatttattccaggaactatatatagtgttttaacagtgacctacaaaatgcttttggaaacaccatgtatgtcagatctttaattgccaataatttggaatacttaaacccagtttctctgcttcctgacactgtactgtcaaaaattaaattatctcttttttaaaaaccctactacaaatgccctggagtatatgagagaatcttgaaatcacccttttattttattttatttatttatttttgttttggtagaggacagacagtagcaaatctgtaattttaatgatttaaataagaaagaaaaaatgatgactgggtaaatggatttggcacggagtacatcctgtacctctgataccattaatcaagcccggcattggtgtgtaaagcttgcaccttgagtaggttttaagtacttcacagaagggtaataattttgcacaggccctaaaaaaaaggcagtctaaaattgtttcatttctttttttcccccctcttagttaaaatctcccaaattcatattacaggaggatcccttttcccccagaaattactcaatgctgaaacctctcaaagtggtattagagacgctgaaagcaccatggacgggttttatgatcagcaagtcccttttatggtcccaggggtaagtttatgtggcttttggtttgttttgtcctccctctccaatatgagtcttccccctgtggacctctttactacacttgagccttcactttctgttggcctctttcagaaatctcgatctgaggaatgcagagggcggcctgtgattgacagaaagaggaagtttttggacacagatctggctcacgattctgaaggtagtaaagctttccctgattatgttgtggcttccctgctcccagtgacagtagcgtgtagattcttccctgtcttctccctagcgaaagaaatatcctcattctggggtcttctttttcaatttcagagctatttcaggatctcagtcaacttcaagaggcttggttagctgaaggcaagtttcatggatgtcctattttccatataaaacattttactgtgctttttaataaaacttaaaggtctaaaataaaaatctattttccagcacaagttcctgatgatgaacagtttgtcccagattttcagtctgataaccgtaagtacctttctggtgatggcacatttgttctgaaattgtttggtcttagatcatccatgtctagaatatgcttttttcagctatggccagatttagacagtagtatgcatttagtttcttctaataattcagaattaaccctgaaaacttttatttcataataaaattatttctaaagtatttctactgtattgcaggtaagatttactgaacataattttatcctaaatttctttttaccttaagaatattgtaaagctgactgggcacagtggctcacacctataatcccagggctttgggaggctgaggcaggcggatcacttgaggtcaggcattcaagaccagcctggccaatatggtgaaaccccgtctctactaaaaatacaaaaattagccaggtgtggtggtgggcgcctgtaatccaagctactcaggaggctgaggcaggagaatcacttaaatccagaaggcggaggttgcagtgagctgagatcgcatcactgcactccagcctgggcaacagagcaagactccatctcaaaaaaaaaaaaaaaaagaatattgcaaagctttaagctcaaaattataaattaactgacaaaatatatttggtgttaggccaagcatctattaatcacacattgttttatggcttttttggggtttgttttataaattaagtccttgatgtgaatcatgaacctgatatttctctttttcttaaaggtgcagaaaatagttaatggaaaactccagttaactttggcttcatccaacatgttgtcaattttgtctctacccctaagctgacaaggggtggtcacagagtggcctgatttactcttacttttcgtgtagttgctgtggcttttctcttcagagaagagaaactttttcttaaaatggccactaagtgctcattactagagagaaaatgcagtgggaagctcaaaagatggctttcaacactggcaggggcatggttactttgcactgatcttttggggctgtcctcaacaggtttgggagcttttatggtctaggcagagttatgaaggacaaagccggctgatgaaatttgagcagcacagggctgctctagagagcattagtcactggcgaatgagcaggtttaagagaggcctggagaaaatgctgcctctcttgagagttgcatcatagagaaattcatgtctcttagtcatagtttataatagcaagcacctgagccatgcaaggactcaatttctcattttggaccaacagattcttcccagctttgttttatctctgggtaggtgggtgtatgtgtgtaaaaatgccactggagagagagtatcttaggtctctctctaagtaaaaagttgggtattccaaatcttttaaatgtaagagcagaggtaacagctaaacattccttaatgataggcctcatgtccaaggcacaatgccatgaaactgtaaaagggaataaactggaacacacacatgcatggttaccttagctttgtcacagcttgctgtggatgtgttctatgggagagtaaatgcatgttaattattgccctttgattgctttcgagtgattgggaagcttgccactgaaagactaaataaagataatccaagtgtgtgtgtgtgtgtgtgtgtgtgtgtgtgtgtgtgtttgcaagatgaaagacagggtttgtaatccaactttgttctgtgttgacaatttggcccagcctttccagttcttgctcagagcagcataaactgcagtctgtttgggaggtggctttcttggcagaggttctttgaaatgcttttatgacacttttgtttgtttctctgtaacccaaaagagttaaaagggagatgagatggctgcattcaaattgattgcatgtgctgaagcaagggtatgttctttgtcagcaagcaggatttatatttggagagatatttatctgtgggaataggctaaagtgaagaaatcaataaatgtgttttggctctttagaaataatttctgctcagcaaatagaatgtgctaagttctttaattaaaattccatacctcaagtggaggtaatttgggagatgtttctgcttaccaagtatgatgttttttttactttgcttactttttgttttaactgcctaaggttgagcctttctgtcttttaaggataaaagagatggttgactagcctagaaaaggtcttctaatgattctttccctctgactttatttcttgaggtagagcttcaagaagggatagattcaaatagaataacttgcttaagaagcaaggcaagaacacaaatgtgggtggtgcatctttgagccattcattcttgcaaaagcaagtttgtttgcctgcagttcagaccaacagccagaagcatgaggaggagctggcagagcccacagccggctgcatgcacttacttttccatgagcgctttccacagcctcgagttcaggaccagcttcactccagtcattttctggaagagctcgtgatttttttcaggggagggaagaaaactcattcaaatttaatgaaaccttatgagttggtttgactcacttaaccaatgaatataagccaaacttagatttgccaggggaaagcaaaccttttttttttttttttttttggagagagagttttgctcgtcacccaggccagagtgcaatggcgcaatctcggcccacttactgggatgtccacgtcccaggttcgagcaattctcctgcctaagcctcccgagtagctgggattacaggcacctgccaccacgcctggctaatttttgtatttttagtagagacggggcttcaccatgtttgccaggctggtcttgaactcctgacctcaggtgatccgcccaccttagcctcccagagtgctggaattacaggcgtgagccactgtgcccggcctgtaacaaatattcttaccagtggccactggtaatacactttcctattaataatgatttgataattttccattgtatatgtgtaaatttattgtatacatgaaagaaagagaaatactaagaaatgtaggtaatatttttattttggaatgtcagttttaaagattatggcttttttttttctctaaacactaaaagttcaacttctaaagagattatattttgtaagtttcttagaattgggtttcctgcccatagggatacatccttaagtctgatttgagtgaatgaaaccattgcttttatatcttatagaaatgcccagcttacttctagctgtacagatttcacctctacctcacacatatagatatcagtaaagcatggagactctgaaaggtcaaattcaagggaatagaaatctatagatcatagggattctaccagtggacctcattgtcccttggtcctaagaagtaactctgaagatctcagattgcttgagttggatgtcctttgtagagacaagcttgcccagccccctcctttcacagctattcccaaatagctgaagagactgaccagtagtgggggcagatgggaaggtttaggtgaagtaagaggaagatgtataaaataatattcttaaagaagctctcacaaagctgcagagccagggagtagtggcatattcaagtgtattcagggtctccattatttcagatacctggagatggtgttcaggaaagcatctgggaggcctctggctgtccaattcagcactcacttctcttccttctatgatcctgagaaagttactcaataccttcatgctttgagtttttccatctaggatttggaagacagagagtaattataaaagaaaaaaaattataaaaaactgacatatttaggctcacacctgtaacctcagtgctttaggaggccaagtcgggaggatctcttgagcctaggagttcgaggttacagttgaagcgagtagtgatcacaccactgtaccccagcctaggtaccagagcaagaccctatctctaaaaaacgaaaacaaaagaaaactgccatgtttcctagaagacacctttcgtgtgtatacagataaaactgtgtacatatttcctatatatgaaaaagtgtttgtgcatgtgtatatatctatgtaactgtgtatgtagctaaatgtgtaccttaacacatagagcggctaaaccagggaatctgggtcagtgcatagatgtatgtacatatttactacacattttcatagaactaactatgccatggataagattggaactcaagagtgtttcaaagtcggggtaaggtgatgtgttccattcatttttctgaactgactgggtacttaaagagtgtgttactagattttagcatatataaatagcagttttttaaatatacattttgggtctgatttttaatctcacttattaatttcagttatgatattataaatatatacctgttagcatcttgaataactaagatattttatgctgagtagagagcatgataaaaatcttatttcaaagtcatggcctccataccaaatacagcctagagaattgttttaagatccaaatgaccccattttccccttgaagtgttctttttagatctgtgtttcaaagagaatggaacaactggaggaagtacaagtaatttcctaaggaccagctaattaactgataaaatcgacttttcataaatacattgcaatagacggctggggaaataggattaactgttatgacagcccttgagcctaaaacacattgatcttaatcctgtttcacgatgagattattcagctggatttctttattaatgtgtgagtttagtacagtagaggcagtgcctttcctttggagagggtacatcattttggtctttggtcctaggtgtggtgtagcaaaacaccacgttttcttgcttgggccacctctattcaaaaggatcatcctaaagtctttttgtttggcaaggtaagaaagaaaacagtgggcactttaaaaataagaggtttgagggaaaacaaggccattggtttatacttttcaggaatcagtagttctgaaggtagaaaagaatgctgatgaaagcgtgaggaaaacatggaggagagattctttgactccaggttttacagtgttactttcaaagtgtttgttagttagcccagtaccttactgctgggagggtgctaaatgatttgaaatccttcctgttttgatagcctcaaagattcttagactcagtattctgaaggacccaagacctacagtacgcatttacttaaaggagccatctgttttacaaaatctgctttcgtctacctttaattcagttaggcttatttaaaactgaatttttctcttacccttctgtgtctctgcgctgttagtcatctaacaaaacccagtaggcttaccagtcctttgtatttggtgagaaagatttgggacggggagttacatctgtgtcaagatcacttgtgtaggtgccagaagtaacaaaatcctggcatccatgaagaaattaccatttatcccctcctctttcagcattcttcagttttacaggagtaaggcatgggtagcataatgaagccgaaaatgtgtactgtctcccatttctaccatctagtagtatcattgttttaatttcagccctagaaaaaaatgtttcttggtggtggggtggggtgtgtgattctctgccgagaaactgttccctccacacatttcttgggttttagtggtggtaaagtacatccagcctcagaggctgacagccccctctcgggcatacggctgcccttgaggcagcttgggccccatctgtgccctggcacacagtgcttctccacttggaatccaaggagctcagaggcttgtcatgttgcagctcccagctcttggacaagtgccaggcatgctgatgccattaccggattaggttgcttttttaaaaattcattttgtgaactcatcaagctcatttaacagaggctttggtcgtcagtttctatcattgtcctatccctctaggcttggcttaaaggagtggcaagataccaggcccctagtatgtgccggcactagttagagtgtgtatgtataaattataaccataatgtaagtacacctttgggcctggcaggcaaatgacagtgggttagcaactcagatgttaaagggaaaagaattccccgtaagaggactctgcatagaaaataaagggggctcccttgtttaaaaagaaagaagcatctaggggaaaattgaagcagagagtgcaagattccagggagcaggataagatctagttattaaaaggccaggagtttgaggctgatctgaacagccgaggcatggaatggggattctgtggtcagaaggacttcagagaaatgcttccagtggcactgagttcgctggaggggacatgagggcaggcagtgagaagaagcatacataagacatttgaaaatagccaaatatgtgatgaaaaaaaggaaacaaccatgagctaaaatttatctcctggatttgcttttcataaagaagtatgcttttccttgaaataaagtctggttgtcagacgggctccatccgctttccctcagggtgattattgaaggtttggaaaaaatatctaagaagcaaagccagttttttttgccttgtactttgcaaagtctcggcgtagatttcaccctccaaccttagatctccacattcttcccttttgatgtctcatgagcattcaggagggtattctgaactcttcaggctggatccaaagccaaaaaaggaactgtgaaattgtcttaataggtagcttgtcccctcctctgcagccagaaaatctggtagtgtctccagagccctcctcccctggggaggaagccaggtggctcccgatgtagctaccagcagtgaatgggaaggaaggtctggagaggcaggcttccagagagagttgtgccctaatgcaaaccagctcaccctggggcaggagaaataccactgaagtctgtttctctccgctggtagctacagccagattctgaaccgaggggcacatgatagtttttcttttgcctttcccgttttgccagagggcactttctgaccttacttctagcggacttttgcacagccttgcagatttccacaagggtcttggccatttgaatcctaggaagggtgcacagcaggcaagatcccctgccgtgtctgaatttcttacgtaaacacagcgtactgagcgagcaagcgtccctgcggcgacagctgggcgctgagcactattaggtctgccccagctagcagagctgcagattccccctcttgcctgaatggagcattccaaattggttgtgaatggagggcggggctcacttgcagactttttcaatgaataaccagaccccattgtgcagcccgtggaaaaacaaccaactcaaacaacactgggactgttagaaatatgcttgtgattggcagcttggagagcctccaaaattagtttcctttggcttccctgctgctccctgttctccaagcctgggcttaatggggtttgagttttcttttaagtgctcactttaacccttaaactgccgggctgatggcctgggattctggggaagagctgccgctgacccacaaagccagtgaagcccattcccctttctttgtctctcattttagactgtagctgtctaaagggcgtgataataagaggagagggtggtttagcttcccctggagagggaggtgttgagacttgatctgaggctgttaaacccttttatctccttcccgtggggttgtggctttagctccccattgaggattcctgcctgctcttctctgacctcccctctactccaggcctgaatagcccaggtgtttacctgccacgacacagacacttcttgcttaggcttacaattttaacacagggggagacaaagttgtagtttttctactcctttgccttcactcctgtttaattttccactgtggtcagataagtattttttaaacgaccgtactcaaacttctggtactgagcaatgggggaacctcactatggctgtaaacccttccactggacactaatcaaatgcattgcctcccaaaatgaacatccttggaagtaccagaaaaacccagcctctgagcaacccccaaaccaaagtagcctcatcatgccaaaactaggccaggttttaagggtgcacgtgcctcaaaatagcatccagccttgattgattgattgattaattggccaagcgggtgtgctgggggtggtcttgctgtgttgcccaggctggtctgaaactcatggcctcaagcagtcctcccacatagctggcattacaggttcgagccaccacacctagctgcttccacacttaaacatcctccaacatcttacctggtagctcaccggcagctcacagacacacgtccagtgttctctgtgggatagcccagggatgtatgatgagcataaaaaggacaatcagttaaaaggcaaaacaaaacttaatagtaatgatccagagcaacttcctcaggattttaaagagctcttcttagttcctactcttcatcctcacaaacttaataaggcagtttgcacttgtgttttgcctcaaggatttttttttcccttgctgtaagttggccttgcaagcatgccttcccttccctattaaaaaaagaacaggcctgggcagattgtccttttgtgagagagtttgaaacctctcaggaggtaaccctagatatcagctgtgtaggaggttgctgatatctgtgtttctccagaggggctgaaaaggacttcgcttacataaacactttcagctgagtgcctggaaatgctttgtaatggcctgcaagagcacttaatgagggtcttttatacttttcccatagaaaaggtagaatagaagagggggggatgtctctttcacatggtcacccacagtaaaggccggatcctggagcctacccctagtttcctcatctgaattttaatagagaataattgaggggggataactttgctgtgctgagggatatctcgactcagaaaatttctgcttctcctcaactccctcttcattttttttcttccccagcagccatggaattttatttcttgcggaagaaggtggaaacagcatagggttttgggaggtatttagtattttgacaactaataatcatagtccctgcttccccatttttatgcctattgaaacaggaaacaaatcacatttcttaggctccaagtgtctgcagaagcagaggagccctgtcacgtgtttatgtcccgcctcggccacagcgcctgctctgcgcactgtggacacctggtgcatacagcccgcacaccaccgcattccctaccacatgcccttcccatcccagctgccccagcctccagctggtggggaagtaacactgtaaagggtctcaaacccagagttctgagtccttgggatgaccttctagataaagagaacaaaagctagttagggctatttctcattttctgtttcctcttttaaacacatacactagccaagtgttgctaggctgcatttagactttgagcagctaatgctatgtttcccagtaagactgcatgtgctagagagcaagtcacagtttaggcacccttgacgtacttgctgagtttctgcttttaggagaagtggggctatagatagaagggaatggttctgggggaagaaactcatttccctagggtttggattttctcctgtcagattttaaggatgaattttcaatctgaaattaaagataagattttccacagtgcttaaatcctatttcaagtactgttaacatttcactttagtgccagtgtggatgagaattatgtaagttgggagtaaattatagaagggttgttaaagcttaaggtttagttttgcaattttttttcctttcaggaaaaatgtcctgtttccccttatcctgattgcgtgatccagtgtgagcagcccttcatgataaaatccactgtggttgatgtaaggtcacagtagaggaagccgccctgtcatctctaatgagttgggagaacaagggtttccttagacctctttctcaatcttgaaaataaaaccaatagttgtctatcatatttctacaggttgagtattaaaattctttgaagagctaagctgcccaaggaaagtagtaaaacactgattcaaataatgctcagaatcctcctttggtgtaatcctgccagtccctcacatttgtatgctgctggtctcttaagcatgaaagtaaccaacatgccagctctgtggctgtaggtctaaaagaagcctatggtagtcgaaagggggcggtgcattagaagtcagaagaacctcttgtttttatcttgactctcctggagtcagttccgtactcacaagcatgttacttgactgttaaatgctttggtttctccacatcccacaagttctgagatgcgacactcttatgcaattagaaatattcatcctgtataaaatatttttaatggaagagccccgtatgtgctaatacttgagccctacttcaatcgaagttggtctaattcttttctcgtctcctgacctttaatttctaacgctgaaattcaaggcatctaggtttccatttttggcgttctaaagtaacaatcctaaattgttaggctaaatgagtcctttgaagaaagggaactgtacaaatccaagctgtttcaagaaaaatgctgaagtgtagaaagaatatgaacttaaaggaagtaaatctgaaactagttcatctgggtcaaaaaaaatcactctactaccattggcattcagttttcttccttatttgataacagaggttttctgtttggaaattactgtctgcaagaggcaattttgtcccgagaataagatgcagctattcagtgatagataatcgttcttacccacaggtcaccatctatgaatcaggacattgctgatttagtactttacacccgtggacggaaggctctcctcccatccgtgaccacttcttttgggaggaggagcagtgacgaagcattaatacaaagaatttctttccttgtattttagccagagttagaatagaaatctttacaaatcacccatatcattcgctgatagaagtgaagaaaggacaagaccagtatcccaaaagccagccctcctagttgatgaccaaaggcatgccttgccaacttctctacccttgcaaacttgctagtgccccataggtcacctttgatgactcttttactccaaaggcccgcaacaggtccattgccttgagctcttccctgggccttctcagcctttggagagtgggagcagctttcagcctcatgcagcagaaaaggtagacagtgttcaggaccacatttgctcttcctagccaaagctattgccccaccccatctttccccctgtctgtccttgaggacctgggtatcatcttagacttgatcacatttcttctctctggaaggagtaaagaggtagggcaagtcttgagctccccccggagtttggagtgccccccacacttgggccggtcaacctgagttgtactgtccaacctgtgggttacaattacatgttagacagtaacctcccaagccgacttccatgggcagaatttagtttttgtcttctaaccaattgtatttcatctgggtatttgattgccagataccctgtgctggttctgctctctggctgctaccattgctgtaagcggccatgtgaaatgggggatgggaaggaggcaattgtttgctgaatgttgcaatccttgagccatgcttagcagaaggaaacctttaaaccacctccccttccccaggttatatgaagccactagataatataaaccttatagttcaaataatgagatttttaacagtgtgagaatgctcccaactaaggcccttttctgtaaagtgtaacctccttgtctagtcattcccccttcccacaaagaaattaaaattcctttgtaagtataaaatcaccattttcatctttccctgcttttacccctagccagacgggctttgttctggggtctgctagaagctacaacctgggggtcccctaagctggaattgctgatatgctggatttctccattgttgaatctatcctgtatctcatatagcccacattccagggagcagtaagggcataaaatatcataacactggtcttatacaaacacttgactctccagaactctgcaaggtcttgtcttcaaagcaccagttctatatacagccagcatttcccccagagaaagcaatgttctacaagcccagtacatgatatgtgtcacaacctagacccatgttgctatcgtcagctcgagtgcatagcagagacttagggttatctgaggtaaacaagcaatggaggagagacttacagagaatggcctcatggtcttaactgcttctcggtaccagttccgtcatctattttaaaacccaggtttgaggctgggtgcagcggctcaagcctgtaatcccaacactttggggggctgagactagaggatcatatgatgccaggagattgagaccagcctgggcaacatagtgagaccccgtctctttaaaaaaaaaaaaaatgtagctgcgtgtggtggcaggcaccggtggtcccacctactctggaggctgaggcaagaagctcgcttgagtccagaagttgagactacagtgagctatgattgcgccattgctctctagcctgggtcacagagcaagaccctatctctaaaaaaacaaacaaaaagaggtaaaatgaaacccaggtggggaaaattttatcaataactcttaattcctgtattctgggagaaattccactgtctttgcaggcaacctcttagagatgtttcagataccattgtctactaatgctatttatacattttcaaagttggttcagttcttttctaagctccttttcttccctttagtttctaacttttatattcaaggcctttggatttccattttcagaattctagagtaatcttccagtgtccttaataattgtgtttctgccaccacacttaggaactgagagtgggctttctggagatagtctctatgctgcctttcaagcaaggtgcctagcattttttaacatggcactcaccaacaaaattcctcagcttgcatttcaaaaatcttccccaaaaggtcttggctcttgaatttccagacacttgatacaacctcatctactctcatgagcaagaaaggtgtctccttccctcacttcctttcccactgtggcaagacttggctctaatttcattggctgctattacatcctggtatttctagccattttcatgcaaggccatcaaaacttcaaaaacttgaatctggatcttaggttggtcttattcctataccaatgtaaccctaaccctattttttggatatgtctttcccatagtccatgtcatgataatacattcaaagccttttattttgagctgattgtattaccccaagtttctaggtctaaatcagcaagaattgagtgttttgtttgtttgttttgtccacacaccagttcctgaagcctctcttctgctgactgtagttttttttcccactgcatgggagaaatctgattcctgaagccaagtgttccaggaactagctttaccactccctaatttggctcttgcgttatttattgtacagaagatgataattggccttataggaagggattctattctgtaactgttcactgatgaattctgctatctcatggttgatctgagaccctggagccctgaaatataccaccaaggtgacagtcagtcctttggttcttgccgagacatatgacaaatagcaaaaataccccagagtcatcaacatcataactcccttccaccaccatgattaattgctaatctaaagtcctgaatactatacagctgtgccagttctgaagcttctttccctgtacctgctaatagcaaaccctatcccaaagcacaagcacaaagcacaagccttactttcttcatgtgggactttgcccaggacaaatgcagctgttcttgcagaatgagcctgccctgaaatctcagcccctgcatgtggtatggccagccagttgttggcttaccaggtgtttgtcatgtcccctatgagtcgtatggagggccttgattccacactaaggtccagctgccattcttggttcctaagacataaaggcacaggggattttccaagccagtgtacttacttcaacacagtttaggtcttcagccccgtgttcctttttattagcctggtaaactaggctgaacagttggagcccccaggctcagagcagcgaaagcataggccacctatttccagcttcctctcgtcctgatcccagccctgctcagcatttaggggtaaaaagggctaacccaagctgcttatgagggaagaaaatgaaggagaaccataagaaagagaacttcaattctgccaaccttcccaggttggtgatagctgccttgcactctctggaggaccctggggatgaaatcgaatgagttgtccagctgttctggacaacctatttgtcctaaacgtgttttacatataaattcacaaggagtggaaattctccattttttctcaagaatcgtttgtggttgacttgggcatatattttagttcctgttatagatgcattaatatgaatatagttactgataggtgttatttttgttgatcattttgcatttgtgtaactgctatctttttacccaggcaggttgatggaagtattagcaggcagtagtcacagtgacagcagtggctgtttttattttgccatctctggagtgttcccttgtcctttctaagtgggccaaagccaacaaaatgtgtttgagaaccactggcgtagacattaggtatgaccagcatatatccttgtgtaaggctagattcccagggctgtattatccttccaattcagtaacaggccaagggtggctttcttcatttgtcgacgtatggttttgaggttctaagcatttctacttttgacatgttagtcaactataagataaaggattttttttcctccaaatatctcagaggaaatgggacataatagctgttttattgatttatttttaaaacgtattgctacatttgcttcatctctgtgtatatatggttttttcttaaccatttgaaagcaagtttcaggcattataacatttcaccccaaataccctggtgtgcgtctccacagattgacattctcctacatagcctgagaaaattaacttttattcagtaatgtttggaattccccagttgtctccagatatctctttagcaatgttgataatggttttgatctaggattcaatttaaaatcacacattgcatttatgtttatgcttcatttgtcttctttaatatgcaacagtctccctagcttttttattttccctgtaacagtgacttttttgaagtcttggccagtcgctgacttttttagggtccatttttaaagaatatatagaaatgcaaacagcatccagaaatgctgcccttaggcttagaaatctctaatattgttgattctctcacttctcacatttatgtatttgtgttgaccttaaaacagtggtgaaagaacagagtgacacagatggagataattgggtcagagatcatttgtgcatgtttgaggagagggcttttggggggctcattaaacggtttttagcacagcttgctcaatagttgattttaccatttgtggatgatttttcacctattaaatttgagaatttatccttacacaggttagctgtgtgagatattaaagaaaaacggcacattcttccatacctacaccaattctgcttttagaacttgtgtcccctaactaaatttgataacattgtcaatttttgtttttggaaactgttgccaggcaggatcaatgttaaacaagtttgagcatgcctcttatttggtttggaaatccagacatctccttttccagatattcttttttaagtgccagaacctgtccacttaaccttatctccttgtgaaccttcttgtttcccagaacagagtattatctactattagagtcattcactagtgctgttagagcagttacaaagaatattgaggtataatagattttatgtgtaaaatgagtttttaatctgctcagtcctaaaataaatatttctgaccctctctggtaatactgtagaacttaaaaaataagtcttaccctatctacatcttttttcctgctaactaggtatttgagctttgtctcaaaattcgtcaaaaaaggcaagagctaagagtaggcagcactatgttggaagcacaaggtacactccctcctgtgacttaaagccctctggtctttgccagtggagtactcagacaagttaagggcaaatcagggaaaaagaggtcatacctgctcttccctggtggatttttcggttctgttttgccagtgtccttgttatttttccatgtccctcttcttgatcatcttttcctctaccttctttccctgtgttctactcactcccacaaccacagaatattaatagtatgggcaggtgtctcggacttctctcccctcccacccccattcttggactatgcagtatgtaattcttcctctagagggaaaggaagtgagatggcagtggtcacagagaggagcagtgacccaaagctggtggccaggagacttaggagaaggccttcatttcaggatgatggctctggaaccctgagcagtgtatggccattactatttgtgtacattccacatcatatttgttcaagtgtaatgggaggctctggagacctaggccagccccctgagctgcagcctcatggacacgccattcagaagcacgtgtcagtgctctggtcagcttctgtcatgagacacaactttccatgtgaactaagaggataatgacagttgagtgtgacctggaggtcaggcctgcacagctgatttgggaaagatgagtctgggccagatgaaggtaaatgaaactgaagaagggacaaggaaaaccccaaaacagaacgtgaaggatggcaactgctggaaggcggtcaaagcctgtgtgtgaagtaggagaaatctggatgggcttagtccttcttcccttcagaccgcagggtaactaattggcaatttctttaacactcagcagctacataaatgttttatgtattcacaacaaagtctgtggcaaattgaaactttgatgattatgaaacaccaaagaaagccttattagacaagatgggtttcgtctttcttaaaaaaaaaaaaaatgcttttgaatggaactgttgctcatcataacattcaacaaaagtgttttcctacgtcttgatccttggggctgtaatagtgaagtttaccattagcacgggcatggggtggccgccttgaacagtccacaggcctgtacttgtgggcagtaaacagcttttgtcagcagagggaattattatttctcttgaatggaccagtttattttttctattttaaaacaactgagttgtttctttggaagactgtttctagaccatcacagaagaaagattttctaaaatttgatatattttagtattaactctgtggtgctatttgatgaggaccaggctgcttttttaaaaagtagaaatttaattgaagtaacatacagaaatcacaagagtacagctgcatgatgaattcttacaaacggtataagcatttagatcagaaaacggaacttatcagactataagaagactcctgtgcccccttaacaggcaccaccccgtcgagagtaacctccctcctgactttcaaacaccatagattagttttgtctttttttgaactttatataaatggacttacatggcatgtacccttttgtgtctggcttcttttagctcagcatatttgtgagattcatccatgttgttaagcataattgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgtggccaagtgactttgagccttgttttcgtgttcgtaaaatgaagacaatggaagcattaatagctttctcattgaattgggaagattgagtgaaatgatgtatgtaagagcaactgggcataaaggaaatggtaaggggtctggctggctgcctctttcttggtctgccttctttgttcttttccagaggtattagttcttctcatccatttttcctttgttctagagcatattctgttaaacaggtgtaagtggtatttttgtttagttgaaaaaaaggtttatgccttctatttttaatgtacaaagtgagcgagtagagtatctcccatttctgtcagtgtggtagaagatgactaaaatgacagtgcggaggcccttgcctcttctcccctcgaatagcagcacccctaagccctttagttccattgggcctcaggatccttatctataaatgtgagggcttgaattcagcatactgaggccctaatctatctctgattgcatcgttgagaagatgctaaaagtcagatgcctcactaagttatgcgggccagccatgtctgttttgcttagcatcataggcccccgacatccagaatacctggcccatcgaagatactctgtgaatgaatgaatgaatgaatgaatgaatgaatgaagacagaaagaaagatcttcatgacaaagaaggtagtccacattcagcaggaattattttcagggcaccactgactttgtgggcccctcttctacaattctgagtttaaactcaaagtttctaattgcagaagatgtttattagctcaaatgtcaactttttttttttttttttttttttagcatttcttttcaaacttcctcaagagttcatgatcccttttcaattccaatttgttgccatcctttatagtcctgggtctctgtcatcatttagcaagtcagctgtgcaaaggtaaatactatttttgaaagcacagggtataattacacaacatcatagcaccatctgcaaggtgctgtgcccttttctttatttctcaaggctgcatcacatacctcattttacaaatgaagaaacagactgaaagcaaggagcattccttggcttctgagttcctgctttaaatacaccactatctctgactaacacatgccagaattaggctccttcacacatcctctagtcccacagacctttgaggagctgagccttgttcctcaccactcacagggcccctcatggctttcctgtcagtgtagatctgtgaaactttccattctcgttcctgccatgttttgtcctgcggggaaagtatatgtaactaacattgtacccagccttgtagggtagatgtggtccctgccttcacggttaagaacaaattggaaatataatccatttgttcacaaaaatactttttgaactccccctttgtataaagaatatactattccacatataagacgttttggggtagaaggtactatataatttagagccaaaatgatgtggtacacactaagtactgtctggatttgaagaaatcaagacatcagaattcgctggcagcttagatccttttagatacgtgcagttcctgaaacaaatacaaagtgtttctgggcaactttggcataccctctggtgttagacttgtcagcaaaattggtaactgttataataatattgtgacaatgtcaagacacttctaaaacctgaaatcagaccattcaataataccctaattgttttctttccaaacttaggtaaagtggtgattgcaaatgattatctttagataaagcaagaaaagtagacgtttcaaggacatgtagcttttgtttaaattgggtcatcattacctttcctcattattttgccaaaacttttatagcagaagactggtgagaggaagggcagtgaccacggggcagtgctgagaactgccagactatctactgtgttggaggaagggatttctgtgtcaaattctcatttactagcaacattcaaacaagcttcgctattttctgtgtctgaatatctgaaacagttgataacaattgagtgttggctgccatgatgtcaccatcaaaaaatcacgagagaaactctaatgacttctaaatataatctgctagttctcaacttattttatgtattcaggaaaagcagttggcattatataagaaaagaattatgaaaacctgtcctttccagtcagtcactggcaagactttgcagcaacattgctttataaccttgtcatctgtgatagagtcatctgtctcgtattcaatcctgaattcagaatttgggattatagaggcacctgagaggccagttggctggaagatagttcagccttatcagatattaatagaaaagagatgattgtttaggccgagtgcggtggctcacgcctgtaatcccagcactttgggaggccaaggtgggtggatcacaaagtcattagttcgagaccagcctggccaacatggtgaaaccctgtctttactaaaaatacaaaaattagctgggcatggtggcgggcacctgtaatcccagctactcggcaggctgaggcaggagaatcgtttgaacccaggaggcagaggttgcagtgatcacgccattgcacgccagcctgggcgacagagtaagactccgtctcaaaaaaaaaaaaaaaaagagaaaagtgatgatttgtttagctagttctacctcgtataattactaagaagtaactcctaaagatgttttaggagtaaacattgagtcaaaatgaaaatgttactgggtcaccagaccactgactgtagttagctatttaatgagacctttgatacagtggccagtggccagcatagaagcttaacttgctctccttccccaccttccaaggtagctagacaaggagtaaccattctaactcaactagaaggcagcccttatagcgcaaaatgcatctttccactttggataaaatgctgtctctgcaacaatttagctcctagagaagacagaaaaggcaaactcggttttttgttctttgggtttattttggccactacatgtaaatcaccttgatttgaaaaattcttgttactctgccctctcagaatcctatgtggtatatgtagttggcttccaagccaaaagcagtagctccatgtatttattccatgaattcagcaaaattcactgcaccatctatgaaaggactggttacgcaaacctacccttgctggtcggtcactgagacaggcctggagcagatgttgtaagcacaaaggtagccaggctttctgctttctgtattcattagcctttcctaggtggtggattggtctgttgttttattcctttgcttttaaaatttttggaatgcctctaaagttgagtatttcttgctgagagctgatatttaaagttacttgagaaaggactttttaaaaattctatatttaatttgtaaatatgcatctgaataagaaatatatttgccacagcaattttaagcctttgataagcttaaatgtgttggtaatgtctaccaacacatttttggtcgttttgtcctttttggaaacaaaattcttcatgtctgcagccacttgcatttttggtggagacccattacctgcaaggtttttaaggattttgcagcttctggaaagcaagacccatgaccaaagaaatttgggaaaaaagacttggctaattaaaagtatcagatgatgatactttttctgactttgaagaatttaattggctttggatgggaggttgtgtgtttaagcgttttgctttttctgacatgtgacttgacatgagttccaagaacaatcagctagttagaaggtttgcagaaggaagcattgtgctccctgttaatcagctgttctctctctattcccctctcatccctcttctgatttcagtggtgcttcatgccccacctccaaccaagatcaaacgggagctgcacagcccctcctctgagctgtcgtcttgtagccatgagcaggctcttggtgctaactatggagaaaagtgcctctacaactattggtgagtgggcaagaggagtcgaagaaaggctgcccagaaaggctctggaagtagccatcaagctgaatgttccttcccagtgttacttacccagcagaccctgtggtaaaacatatccttctttcatggcagtgtcatcctccgggtgtagtccagtccccttgggatcattgtactgcacacaaaagaaaaccattaaaaaccttgtggctctacagagcactaagttcatagggtacccagtccttctagggaaagagtctcaatcctgggatacttgatctgtggctttgaggcaggtaatatatacttcttcatgtctatcatatgttaatgtgaactttaagcaccagagaagtaatctccaaatcagaatatatgaaaaagtcttgaagcttgtgccctttacttaagaatatccaggccccaggaatgaagctttaattttaaatcattctttgctctagaagataaacatagatttgcctgaaagggggaggagaagagttgttaattcaaatgatgtcacagcacaaacagaccttcaacacatattctgactaattcctgggaaccctggaaatagttgggagaggggaccagagaacacctggcaaacatacattctcccctcacccacccaccctacacaggcatacacggagaattcttttagaaggagggaaaaaggaaaccggaagcagaggctaaaattatccttgagaaaaatcactagaagtgttaaacaagtccctgtgacgcagtgtgtttgtcacttttcagaggtacaaatatcccctcggggctacgagcgatttaactatgttaatgctgttatttcctggcaacaatgggctgcaaactagctttctgctggacctggtaaccatgctaatggcttcatttcagcttaatggttccttctctttttctgtttacagtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagaggtgggtgttgatctgggcttcttccttaattgtctccctcactcctatcctttctcactgggagaggggaagcagtttgtcttatttaccaggttcctaaaaagttatcattacattgaggcagcttgtgaggcaagactaatgataatacgaatatgactgtttatataccaccctgttcccaaggtactccagatggttgatggactacgacatccttataaagtaggtaagggagaggtaactggtattctcccgtctcacagaactagaggaagaatgacttgccaggatagtcttgtccctcactgagggcaggttcctgactcctcattggatgctgcctactattaatagaattgaacttcagttattaccatttcacttacatataagggacaattgctgatttatacaaggtaatattacttatctgattttaacatgttttaacagtaggagattagctaaggaccttatttgtacatctgcttttgaaatagaaatctcctggttacactgcaggtggtttttacatttctacaggcattgaggcatcaggagtaacttgtccagagtcattcatttgtcaaaaaagtgtgtgaagggaaccttctctgcacactccaaacctgacctctttatctgtggtattctagaatctcggatgcttgtggccttcttttatagaagatgtgctgggggcctgtctttatttcaagtttctctgggataggggggtagttgtcaacaatattaccaaaggatgcaagatggtggccatggtatttcatatctatctatcttgtgttaggtggatcggtgtgggggccacaatggggcgggagtgggaagaatatatgagtatacctttccccaggcctggtccattccagatgcctaccagtatttacttggaaggtcattttatttctagatgaaatgcaggggaaaaaataaggtccctttgtctggttctgatccccttcccgttttgctctgaaagtcaccattaagaacggcaaaatatggctggttgctgtttattccttggttaggccaaggaacacgaacgcctgtgttacacagggctcaaggggtgagcactgacggggttgtggggggctggctctggagtgggcctctattgccaccggggactcatctggaggacacagctgccgctgagcttttggcaattgttaccttgtactaacaacctgtacttgtgcagaagaatttggttacttggttttttatgtaaaaattgtagacttttttttttaagttggcaactaattcaaattaaaaacaacacctctgcagactaaacaaaacttctctgggcaaaatcaccctgcaggcctgccaatttgtgaactctggcctagatatcatttttatttcaatggttttttggtgtttttaaacagcatcttgctgattttctgcaagggttatggggaaattggggaggaagtgtggggtcgagtatatattcagtatttgaaactcttagcaaacttctatttgttataccatgaactgtaaaagaaaattcctttatctaatatttccccctcaatccttgttttttatccaaggggcttatgtaacatactgtattaacagttaactgagttgggagacaaatatcctagttctcctggagaattgggagatgggtagccccagtctcagctgtgaaataagcctgtctccagtccacccagccccctgagaaggaaggagttttggattcctgggattgatgagttatttgcccgtgggtgttgaaaggaagagaggagggaaccagaatgcaggtatttcttttcttgggtgattcctccttgaagtctgcctgtgcattttggacttacttcttgttatactctgcctttgagactgatgggtctaaaattcaaagctctcacacacacactggggtgatacagagatccttgaggtaattgaggtgaagggggaggaattctgtaggtgaccaaatcgattacaaacaacactgggcacttggatttccactcaagagtgctgtcctctcaaagttgaaagtgcacaggagtccccatgggagtgtggagcggggattttcaatgcagagtccttgttaacattcagagatagagtgtgtgggcctggggcggggcctggatatagtcttgtcacactttgagaaattgtgatccagctctctctaccctcatccttattccaccctacctttatttaaagcatgtattaccaaattctattcctactgcctttgtctattaatatggtcatccacgtgatatctatgtgacataaaacgcatcaaaaacgtgacagtgatttttcttctagatactggatagtacacagaaaatgagacagaccaaaatccctggtttgatatttgtaaaagtaatagaaattacagtcatggataatatcaagcttcataatcacatatttaataacttttatgcctgcccaaaagtggggcagattacttttattggtgactataggttgtctcttggcttagaactttttattaagattagagggactattacttcaaaacgaaatccctaatacaaatatatggtattttgcatgatagaagtaaagagagtctcatttgaaacttttaaccgccctgtgacataggcagagtgaaaaaacccattttataggttagaaatcaagcctcagcacagttaaaggactttctaaagctcacatagccaaatacagggtcctacattcagcaaccaaaaacttccatgacgtgtaattacgccatttgtttcagttatgattttatttgggctgctaacatccactaatgtctactataaaaactgagtaattgaccttgataaatttgttttgaccttgaacattatctgtttttttattatacttttaagttctatctatctcttcaactacaaaatcttaataaattcctacatcatttaatccaaacccatgtgcttaacatgtgtcttttttgttttgctgggtgtgccgtatctgttcagttgaatagagtaagctctttgaggataaaaacctgtgatttagactcctttctttaggccacatttagccttgtaccttatttgtcctcagtatatgtttattgatagtgataaaagtttgctaaaattataccgtaaatagctaaaatgtaatctagtcaaaagtacacccttgccacacatggcggcacacacctgtagtcccagttacttgagaggctgaggtgggaggatcacttgccctcgggagtcctgggctctgtagtacactatgccgatctatcaggtgtccacactaagtttagcatcaatatggtgacctcctgggagtggggaccaccaaattgtctaagcagaggtgagctggcccaggggtcagaaacagagcaggtcaaaactcccatgatctcattgtgccactgctctccagcctggacaacacagtgagacccccatctctaagaaaataatgaagaaagaaaaaagtacattcttaatgttttatatagtcttagcatgtaattcttcacaactcaatttatttttagaagataaatactgtgtttgaaagccatgatttataccagtgatttcctccccacaaggagaggggaaaagacatgtaatttgacatgttcagacatgtgccacttatcctgaaagaccagctgaaaaaatgttttttccttcagccttcccaatcttgtgagttttctcattgtgttatttatgatgtttacatgtgctgggtggaggaacttagaaaaatattcctatagtactggccgtatatatttttggcttttattaaaccgtatctcattatatcttgagttgaggaaagccctgcaattcaactgaagaagctccactaagaaaaatgtatctctaagaattttggaatacactgctttctcacttacttgacatcaaccaaagaggttaaaacccaagaagcagcaacatttaagaaaatgctcctgtacctgaagaatcctctgcttctggatagcccctaagggcatcagtattgtggtaggctagcatgctgtaattgacagaacaaaatgtgtagtgctggagtcatcaggaaaaggtcaactgggtagtgtcttctgaaggaggaaacagcctaagctgtttgagaatgtcaagaacgtctgcttcggtggttattattgaggattcagagcttaaagggatgggctaagttttctggaattttgatttaacaaaaactaccaattccttaaggatgctagataaattaagagattttatatactcgtttttcctcttgttttttcttcctctcttaaagttcattacccttaaagtaaattgctattcattttttgtccttcagattttgtagtacaataatttttagagaggaatgaacttgactgtaagtcacatttgtagcctggcctggaataaagtgaatgtgcctgatgcatctcttctccaagtgcctgttaataacatgttgtgtatggcagcacagattcactttgggatctgaaactgagtttcatggatgcttaatggatccttctttgacagactgaatgatgttcttgtaatggttagagtgcgtaggtttttttagttctgagtcttaagagggtttgtttttagcatttcatcatgtttactgtaggcttcttgttaccttttaacaagctaaaggacatttccttttatccccagtttactgaaagttttttaacatgaacagaggttgaaattcattaaacatttatactgcctcttttggggtgatcaaataattttctcctttaatttcttaatatggtgagttacactgatttatatgaaaccaaccttgcattcttgtgacaaacctaacttgtttattctttttttttttttttttttttttggagacagagtctaactgtcgcccaggctggagtgcagtggcgccatctgggtgcatagctggaattataggcgggcaccaccacgcccagctaatttttatatttttagtagagacaaggtttcaccatgttggccaggctgctgtcaaactcctgacctcaggtgatccacccatctcgtcctcccaaagtgctgggattacaggcatgagccaccatgcccagccctaacttgtttattctgtattatattttgtacattggtgagtttgggttttctaatataaatatataagacttccacatctgtcttcatgattgagaaagtacataatttttctttcttatattgtccttgctaggttttagcattaaggttatactcatcaaatgagtagagggtgtcttccgttttctatattttagaacatctcatgtgaaattggaagtctttattccttgaactttttgaagaatttactgctaacaaccatttgggcctggcattttctttgtaggaagatttttaattactggctcagtgtcttcacattttacagttttgccctggatttctatttagttgaataaatttaataaataaatttttctaagaagttgtccattttgtgtgagttttaaaattaattgacataaagttattcatggtgccctttctaaaatctctatagcatctgtagttgtctttttcatttttgatattatttatatagacctttttttttccttagtcttggcagacaatattgtcttcaacaaatctacttttggccttacttattctctctcgggtgttttctgtttcattgatttctgctctcactaaaatactttattctttgttttctttgggtttattctgtttttccaacttatttgttgtatgattagctcactaatttttagccctttttctttataatatgtaagcacaaaaccatataaaatttctcttaaggctggggtgactgtacatggaagtttgccaggtcacttatggtctgtctatgccttgtttagaagtgattgctaatagcttcttgcactctccaaaggatcctggtttggacaatcagttatttgatctccctacccaagttctgctttagatacattgcacaggttctgatttgcagtactttaaaaattcagctccaagtattttctattatttctttcaaccttggagttctttatagatatgtttcttaatttctaaacgtatgagatttttctggttgcctggactatatgatttttattatctctcatccagagagtatttttaaatgattgtagaaacagtataggccagtggctctggagttggacagactgacagatctggggttgaatcgccgctctgctgctgtgtgacctcaggcaggcactcaacttctccaaactttcgtttcttcgtctgaaaataggataatagataccacacagaagcgttgggtagattaaataaaatcacgcttggacagaggtgttcagtaaatgttagcttctatgacaattttactttttgaaaatcacttttattttacataaactatactaaaggacacttccttaaatgatgtaggtatcgcaaactgagaaacttcattgtttaatgttaagtttttaaaatgtaatgctgcctttctccctgatcttttcatcatcacactaatattttttgttttgttttgttttgttttgagacggagtctcactccatcgcacaggctggagtgcagtggtgcagtctcggcttactaaaacctccccctcccgagttcaaacgattctcctgccttagcctccctagtagctaagattacaggagtacaccaccacacccggctaatttttgtattttcagtagaggtgggatattaccatgttggccaggctggtcttgaactcctgacaggttatctgcctgccttggcctcccaaagtgctgggattacaggtgtgcaccaccacgcccagccaaagttattaatgttatatctacaactaatactttcaccatctgatatcctggggacatgtcttagtttcatcaccatccctctcccatatttgatcttgagaagtcagacaaacaggtaggcctacaaaggacatgctttttgttccttatctctcaatgtcttctcacagtttaaatgggcccatttgagtctcagcaatgttggcaggccttatggagttgtttcagagttctttggtgtacgtttagggacagtgtctggctcttcgttatatcgcaggaaaataaacatcattgtgaagttggcacattgccacctccaataaaaatcagcattctctttctgaaaaaggagaatggatattgaaaaggcaaccagtgggctcctttgatttgtgcatggtttgtgtgtgtcatagtcttccagttccttaagatcttctcttttatttgcatatcttttttttctttttttttttgagatagagtctcactctgtcacccaggctggagtgcagtggtgtgatcttggcctccacctctcgggttcaagcagttctcctgcctcagcctcccgagtacctgggtttacaggcattcgacactgcacctggctaatttttttgtgtttttaatagagacaggtttcaccgtgttggccaggctggtctcaaactcctgacctcatttagggaactcacatggtgatctgcccaccttggcctcccaaagtgctgggattacaggcctgagccactgctacaggctgacgcctgtaatcctagcactttgggaggctgaggtgtgtggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccactgcactccaatctggacaagagcgagacgccgtctcaacaaaaaataaaaagaataccttcatcagctgggtaccgtggcttttgcctgtaatcccagcaaacttttgagaggctgaaacaggcagatcactgagtcctggagttcaagaccagcctggccaacatggtgaaaccccgtttctactaaaaatcgcagctacttgggaggctgcggcaggagaaccacttgatcccgggaggcggaggttgcggtgagctgagatcgagtcactcgagtcactgcactccagcctgggtgacagagcaagacttttttttaagtctttttttagactttttttaaaaaaaaaaaaaaaaaaacaacttcgtctctcttttctgaaagaattccctttaggtttgcggcatgctgccggtgcccatgttctaaacgtcaagtgtaaacctgagacgggaatttacacttcttcaaagaccattgaaaggtttcttgaagaagttgtgccgtaaggcattcagcgccccatgaaaggctatcagcccactgaaccttcagtagttggtaaaacttgtttaagacattggccaggtggattctgaggcttttgatgtctgggataaaaggataagtacatgtaaattgcccagtagttttcatattataaaatgatcttaccgtgctgctttaggtagagtagtaaaggcagtatattgtgctgtgctataccctgatgtaaacagtgttctatctgtacacagatctcttcagtttaagattgtaaatcttgatgttctagaaatctgctgaccacctgttcccacacattgattcaaatcaaattcaaactattttattaaagctattcaagaattctttgaattaatagaattcaagctaaaagtagagaataagaccttaatattacaggattgtattatttttccttgaagcttggctcctactttctaactgagggtatatattcacaaatgcttttctttatacacatagattagtgcttcctgtctgtttcatggactgagagttcacacatctccagccttccacaaccaccttcctaaactctatagtctgtcaattatgggctgtggcagaaaccatactttacagacatgattgtatttcaccatttcaggagcatttggaggataatacatccccatgtcacagataagcaaacaaagccaagaaactttgcctttggtcacttccctactaaggcatggcaggctttcccttctacactgcacacccaacagggaaagggcagctggcacacatctggatttatctgacagctgaagagtgttaaggaaactcgactagtagcaacaggtttttattctatcttgttaaaaaacagtgcatatttattatcaaactatagatgagcaaaaaaagaaaatcacctaaaattataaccaccccacagataggcagtgttaatatctaaatgtcagtctttctgtggttttatatgacaccatactactacttttatttttgctaagctttgatactctacgtactgtttagcaaccttccttaatatgtcaaaaatacctttccaagaccttatatatttacatattatgtaatttctaatggttgctttcaaccaaatgactgtatcgtaatatatatagccagtttccttgttagacagctgcattggtgaccatctttgtagttatacctgatcatctgtgactgaattgctgttcaggtacctggcacagaattagtaactgcctgctcatcttccaagctaaaaggaaaaacacttctcttctgactttgttacttttttaattactaatgagttaaactttttgtttatgaccattcctattctgtaaggatattcctgtttatgtcctttgcccatttttttcctcttgagatattcatcttttgttaatttctaaaagctctttttgccaacagtgagattcctgtatctgtggagatttttcctcagttttacttttggttttgtttctggtgttttctgactactgcagattctttccccctggtttgatgtgtttcttttggttttgtttccgatgtctttttaacttatagaaatttatacagtgaggtatatccaggtttatcttgatgatttctgctgttggtatgatacttaggttttccctcactcccaagttttgtaagttttcatatatatttactttcatatgatggtttcacttttttttttttttgagacagtcttgctctgttgcccaggctagagtacagtggcgcaatctcggctcactgcaaccttcacctcctgggttcaagtgattctgatgccgcagcctcctgagtagctgggattacaggtgcacaaaaccacgcctggctaatttttttaggtttttttgttgttgtttattttgagacggagtctcgctctgtcacaaggctggtgtgcagtggcgctatctcagcttacagcaaactccgcctcccaggttcaagcgattcttctgcctcagcctccagagtagctgggactacaggcgcgcacaaccacatccagctaatttttgtatttttagtagagacgggtttcaccatgttggccaggatggtctcaatctcttgacctcgtgatccccccgcattggcctcccaaagtgctgggattacaggcatgagccaccaccgtgctgggccaatttttttgtatttttagtagagatggggttttggcacgttggccaggttggtcttgaactcctgacctcaagcgatctgcccgcctcagcctcccaaagtgctgggattactggcatgagccacaatgcctggcctggtttcactttttatattggaacctttaatccatatgaaatttattttggtatctgtataaaatggggtctaacttttttccccaactaatttgaaatgctaaccttaacaagtagtaaattttggaatatacttgacagtttttggcttgccattaaattcctttgacctgccaatctctcaatttgttgtattattgttttaattattgaagttttatgacatatgtcagtagctagtgggtccttatgccttttcaaaataaagtttagaatcattttgtcaagttagttgggaaggcatttgcttttatagattaattttcagtgaatcaatagcttcaaagtcctaaatatattctcttaaatcttttttctttcttttcctctgaaaacaattttgagattttattcttatatggcctataggtttcctgattattcctaggaatgttatgttttttattgctactatgaatgggattctctctcttttttctttttaactacattttctaactggttaatttgtattcagtctttaaaaattccttctatctataggtgagagaatggatgaactagtgaacaaacatttatgtatatgttagtgctatttgcagataattggtctcatatattcagatacataatctggcccatctatacagatagactgtgcataaaatatacatacatggaagataagaggctaccacatcattgctttgatttttttttttttttttttttttttttgccacttcctgactcaagagcttcgaaatacacaatgtaattttgggaagagggtaaaatgcccagaaataagcattattaagtactttgcaaataatttcattaattggaacttctagtccccagtgctcaatcatagtaggaattcatcaagtctttgttcaacatgaaaacctctttcttcttacagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcaggtcagcatcaaattgtgctattctttgcttcattcttgcattcttctgtctcgttattcagtgtcttatacatgcagggccttggggacaggaatttttataagaattttttataatttttataagaattgccctcaaataacttaggagctagtagagctgacatgtttatgcgcaatggaatacaaaacaaaacagaaaagctatgtaagtggtaggaagtgcggtaggcattcagaagtggtatgaagtacatctctgagtccaagcctggagagtgttggggttcagttttggatggaatttgctcgaccttctctgagataatacatagattgatctattcaggcaccagttggttatgggaaatgctgaggaaataggcagaagggagagacctgttgctttatgacagaaaaattaccaagtgtgaggtagtgatcgtgtgtaaacatttctatcagcattcctctggaaagctttgatgtatttttctcaggagtagcatgaacagcaacattttttcctttaagactgacattttgatctgtcctgatgggttttgcaccccactccactcccttaaagcaagacactcaacagaggttaccatatctgtaattctttgatctgagttgtattgccagggtgatggctcatcccacatggacacaactcaaattactgtctttcgtctcgatggacactgataacatgatggctgaagaagagatcacttgagtgtggtttggtttcagtatgacagccccagcatggcaaaaatggaccaaactgcaatcctctaccccttccaatgctggtcctggcttcctaacttcaggtcccctaatccctttggcctaaaaatactcccacctgttggagcaaaattagatgtgaccaccagcagtaaaggggagcaaattagaaaagatctaaagcagtcctcttcccgttcccaccctaacacccaggagtcagcatgggcaagaggccaggcttggccttttgaaagccagtattttttcccctgccattggctctttcaccagatttagtgttaacacatttctaaaataagtgaacaatgagagtgaaacatcttttttttcctcccgtgactcttgattaggagagcctgcctttcagctggtgggttatggtgtttgccatcttgcttattggtgtggcacctctttcccaggacaaagccagaaagacatgaccccagagcaggaagtttaggggctttaccacagagctgcagttgaccgatgtgctgtttctgctgcagaaactattgacaggattgtgtccacctttgctttcctttcagaagtgcctaactgccagtcatcctacatgagagggggttatttctccagcagccatgaaggtaaggaacctgcttttctttcctcttctctcctctctcctctcctttcttcctttctttctctcggcttttctttctcctaccttccttccttcctctttctttgcttgactaatacccaagcttaaaattgctcagtttccaggctaagatttgagatcatagtttaaaccttgcttagctcatgaatatgagagctgattgattgtaatcttcaattattttgcacgcagggtttcaggcatgcccctaagccctgtgagggctgccattttcattagcaatgaccccaactttttaacagtataggacaatttggagaaaaaacaaacccaccttatttccacatttccagaaatggaggttatgtttatataacactatcagctgaaactggaatttaggagttatgtcagtgagggtggtttttatatgttttacagttatgtcagtgagggtccaaggatgtcttagagttttaaaaatgtgtctctaggttttttacttagtttgagtgcttgggtgggtaactcttcattgtaattattattatatgataaatggttgccatttttaacatgggagggaaattgaaggtattcttcaccaaccttgagggggctggtggggaagtgagctagcagggggtagggagtactggggatgggagtggagaggtatgttatgtacaaaatgcattattgaaggacacaaatgttttctcattggatttttaaaaaatacctcaaaggagaaacatgagaacagatataaagcagtttacccacaagcctggattatcacatatcctaacatttatttttatgtgaagatgatcgttttatatcaagggtgtatgctgtctgctcaagttcttgtgccctatccctttgggaccaacttaattcagtaagtctctgagatcatctcactctaattaggagcaggagcagtaggcaaggttgagcctgtgactttgccttcattagtgctgacctactaattagggtgaaagtaattgggaacaaataagatgcataagtgttccatagcatatggcttcaaggaagtggtcagaatggagctagaatgtcagtttcttggaggagcttgctttttttcatctttttttgttgttgttgttgttgagacggagtctcggtctgttgcccaggctggagtgcagtggcatgatctccgctcactgcaagctctgcctcccaggttcacgccattctcctgcctcagcctcccaagtagctgggactacaggcgcccgccaccacgcccggctaattttttgtatttttagtagagacgggtttcactgtgttagccaggatggtctcaatctcctgacctcgtgatccacctgcctcggcctcccaaagtgctgggattacaggcgtgaactaccgcgcccagcctagttttctttcaaatataaacttttgtagcttatttttagcacaagcaataaatactgattacataaaattcagaaaatacaaacagacaaaaagatgaaaattaaatctcactgcccagagataaccattaacttgctacatagtctttcaatctttgctgtgcatatgtaaatataggattatacagatcgtataggactcattgttttatagtctttttttaaacaatagtcattaactcaaattgaacatttactatgtttcagacactgttatgtgttctttagatgcataaattcagttgtttaattctcatagcagccctataggatagatatttctgggtttggttttgttttgtctttttgagacggagtcttgctctgtcgccaggctggagtgcagtggcggatctcagctcattgcaacgtctgcctcccgggttcaagtgattctcctgcctcagcctcccaagtagctggaattacaggcgcgcgccaccacgcccagctaattttttgtatttttagtagagacggggtttcaccatgttggccaggttggtctcagtctcttgacctcgtgatctgcccgcctcggcctcccaagggatagatgtttctatttgccccatagggtaatgaaaccgagactcagaaaggagaaaagatgtgcccaagggcacgtggctgtaagagtagagccagaactctaagccaagccctgtggctccagagcccatactcttcatctccttccatatttcacagccaatgtcatctctatagcacccaacattacactatgatttcctcattaatggctgcacagtactcattgcatggggatgcttttagctaatcacctattgctgaaaagtgggtacttccaggttattctcaaattccatgaacattcatctagctaagtgttttcttgttctcttgattcttgaagctaagtttctgaaatttctgggtaaaggagggtatgacattttttaaggcatctgctgccggtttttgtgagggtctgttttgttgttgtttttagtacattgtcacagatttttaaattttacgatttatctaaagaagtaattagatgtgaatcaaaaggaagaagggatccttttgttgggggaggataatcgggcttttaagctcctgcataaatgaatgacagtagcaaatcagtgggctcatttgatggaaaggagccctggtagggactgagatcatgcttgagggatatgaaaggcctggagaggtgggctcagagcttaaagttacccttctgggcaaaggctaacttggtatggtggattgaggagttcccttctaaacattgaaatagggaagtttttttagaacaccttccccagatgtatgtcttctttttctcaagtgtatttctccctgaagatttaaagcagtgtgattcccaaaatctgtggcaacagcttcacctgggactttttagaaatgcacattctcaggacccatcccaggcctactgaatcagaacccccagcggtggggcccagcagtctgtgttttaacaagtcctgcaggagattctgatgcaccttcaagtttgaaatctactgagtagtaacggttctcaagtttggtcaaacattggaattacctgaggagcttctaaaaatgtagatttccaggtttcctccagagcaattaaatcagaaattctggggtgggacccaggctttagtagtttctaaagctccccaggtgattccagtgtgcatccaaggttgagaaccactggtctctgtcattttaaatgaaagtcaaaagagctgatactcatgaagcattgggtggcttttataagtgattagttcataagagccgtgtttatgggtagctgcttcgcactcacttggttagatgggagaccgagtgttgtttcactgggtaccctgtgatgttctgagtaagtgtccagccctggaaaggcagggctgtctcccggacactggctgtgatgggcacagctgcatggggctctttgaggttcctgaatgtttctacagaagcagttgatgtctgcagcaggcaaactaggagggagtgggggaagagagggaggaaaacattttgcataattacaacatttaggaaagagcatgctcttaagggaaatatttttagcaaggcattgggttgcttactacacacagactatctggtgcatttgtgtgtgttttccctccaccctttcccattcctttccctgacttcacacacatcaaagaagttagtttcaaagaatccagcatttttaattgttctaaattaccctgacatgcttttcctatccttatacaggcttgaccacagatgcctgtgaaacagttaaggaaacaagtgtttctgattggcatctgtgattgctaagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagcactgcttatcagacaggagccctggggcattctcctaagacgtgtgctggtaaaggagtatgcactggagaccttacaccttgagcacaggctgaactacaaggagggatgtgaccccatccaagttatctgttacctggctttgatttgaaccaccaatcttgacaaggtgcctagcgacatggtggttagcactgagtgtatattaggggtttgtggatgaagactgtcaggccatccttccttcttgagccctttaactttttgccttgccttcttttatttcgtttgcatgtgttgttgggccagttcctccttgacctctgttttgtcatctatacagtgaatttgtttcattgctagaaagtcttttcagatcctctccactgtttggtaataatacccccaatactgctttcgaaatcctctacaggcccaagtctttattcattttggcaacattctttacccttcaagctctttcgtaattgaacgaggtatgtgagtagcttggatgagttagtaggaaaggttgaaattaattttagctaaaaggaaaatggcaggtctgtgtacagatcaaccaaatccatccagctaggccaactgaaatagagatgtgtttccagctgtaaaggcttagtcagagcaacattgatccatgcagacctcagtaagcaaaatgcaaaggaacgtactggtgactcagcacttccctgcagtcttagctgtaaaagcaggaattgatgctgctctgactgaggcgcaggtgattacatcagaattggaatgcctaagccctcttgaagtccctgaaaattcagtctgccatagatacagcagtaggacttaggatctgaaatgataggattgcactctagtccttaaatccatagttttagtacaacacagaatttgttaagcaacgtagtctttcttttaaattctctttcaggtttttcatatgaaaaagatccccgattatactttgacgacacttgtgttgtgcctgagagactggaaggtaagtagccccatccaaggtttgttgccaggtagaggtttggaggtgtcagaacacctcagccatgactctcttcccaagtccagtgattaaatcagcatgaacaactcctttttgtcccaaccacctgagaaacttaggactaagctattgtgtgatgtgtccttgtcccaaacaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggtatgcactggatgctggactcagacgggttttgatttgttgttgttgatgatgttttttgtttagatttccattgaggctttttgtgtcaagtctgctcttgcttctcattcatattctggcctggccagtgggcttggctgtatccctcctattaatgggacagtttctaatacatggacaggcagagttctccagtgtagaatacatgaaaagtatttgtaacacttctgcaaaatttagggggcaagatcatgaagacttatattcaaataggatatgctctccctcttggaaagtctttttcaggtgctgtttcaatgatacagacttgttttggtcttagcccctgtgggccatagtctatctctgagtctacgtgaacatactgtatgacattttgacaatatattacaggatacaactacccactgtgtatttcaaatggctgtagcctggagaaataaaattatcagaggtggctcaatcttaatgagcttagattttttttttcaaaggtgtgttatggccgggtgcagtggctcacacctgtaatcccaacattttgggaggctgaagcaggtgtattgcttgaccccaggattttgagaccagcctgggtaacatggcaaaaccttatctctacaaaaaataaaagaaaataaaaataataaaaaattagctaggcatggtggtgtgtgtctatagtcccaaatacttgggagactgaggcagggaggatcgattgagcctgggtgacagagcgagaccctgtgtccaaaaaaataaaatgaaagtgtgttatgtgacatcacaatagagtagttgagagatgatacaaacctcagttattttaataggaaaaaaacactgttactgtttttgtgcccagaacagaaatacactgttgacagaaccagtgccgtttcttcagtggagaagacacaccctagaatccctttcctgaatatcacataacaaagtaaattaaatcaggctctcagtatagcatattctaaaggggttgatttttaatttctgtttgatttagaatctagagagattataaatggaacagaaataactgcccaaaaaaactgacatatgcttcttttagtagcatgttcttaggcatataaattaaaccagcagatcaaaaggcatctttgggttgggtataattaaattgggaacaacactcttagacactcttagaaagcatttgaacgagaattgctgttttcagtgttcagttaactctagggctcgctttagcacaccagagaaatacgctggcatggggttaacaggaggaggtagcaaccggggacttggtttggaacaagaaagtggtctaaagattcaaatgggaaaaggaggagaatgtgtggattagaaatttatgaagaatcctgattgataggagaagaaggcagacttcattcaaggcaattagaaaacaagatgtgcctatgtgttccctgttttatattcactcacgagaatggaaatgtgtcagcatctctagatggactaattaaacagcttctattcggttcagtctaccttcagagctggagttgagtgccactgtgttagtttagtgcctacgtgtttttttctggccatgtagaaatagagccatgttttaggcttctagcatccctgcagagccatccaccccacgccgacccatgcctctcctcactgctttctgaataacgtggcctggtttatgtgaagtttgagaaaagcatgtcacctaggttcactgaggctttctgaaagtagttctgtcatgtgggcagcccttattgatttatcttgtttcacaaacaggagcttttattattttattgccactgcctcgggcctaagcacaggccgtccagctgcaggtaaacctggttatgatccttcgtaaagctgttattgaatcttctgcactcctaccagtggcatagagaatgatgaacagatggcaaagggcccctgctttcttacttaataaagaaactaatattaatacagaatgctcgtaaatgccaggcagccaagtcatatgagaagcctgtggtgtccttgagcctccctcggttgaccgggcagctttgtttcttcaggaaatggtgctttccaccccaccttgaagtccccaagctttccctaagctccaaatgttcctttctcttcacccaggatcagttgggtgccacatgtgcacgttagcctcaggacaggtgacatttgctgagctccccccacccctccttgtatacctgtgagggccctgttcttgttaatgtcaggaagataccagcttctggaaaaagctgtaagaagtcgtcatgggggagcttgaagggtgaagcggaggaggaagctgttgggacgtaattgtaggcagctgtgtggctgagtagtgcactctgggtaattatccataatatccattacactgtgcatggaaattgtggttttagaactgcgttttggcaggccccctaatcaaatgtcttttgatagtcatccagcttagcaccctctcaattatgactgactcggctttaatctggagccattttaactgtgaatctgcattaatgaatattttggggggtagggttgtttgttgaacatgtggcagataactgctgctgggaggtttgaagggatgggctgctagaaagagccactccctgggctgtggctgctctctctttaaaggggagaaggaataggtagatccgttaactccttcagcctcagtcctcaagatacgtgctaccaaagtaactaatgagagagaagaaagatctgatgacaagctattgcctgcctccccagtcccagaagaggggcagccctaattcccagctgctctggagctgagccgcctcatgcattactgtagaaggaacagccgtggtgagggctacagaatcacagggctctggcccgggaggatgagtcagtaactatggctaccagagctgctttgaaatctgtgcgtataccaaacctttctccagtaagcaattgcatatgcaagtgacagctgagaggtggccgctgaagttgaagaatattcaaggattgttttccaccccttaacatagtaaaatgatgaggctgggcttctctgaaatttccctgtgtcacttgtggcagacagcaattaaagattagttttataaggcatcattgctttgaacagggtacaatgatgtatattattaggttagcagatgtctcttcttaccattatttctattggttttaaatgtttatcttctctaaccaggatgtaatttttggttaattttgccttttgggctgtttcaaaggtagagtagagtgggtaccatatggagaaaagaggagacccaggacatcgtgtctgctgtggggacatgaagcaactgaacggaaattggactttcacagggtttcttgcaaggcagagcagaatcattgctattattgtaattaagagagatgcattcttatcagatcatttttggcttttatgaaaggtcattttagaatcctgaatttagaagatgttgctttcattctgcctagatattttaaggaaaaggtttatgtgaaatgctgttttctctctgattcctactccatgtttaacatttggcttttaaaatatcgaaggggccgggtgcagtggctcatgcctataatcccagcacttcgggaggctgaggcaggtgggtcacttgaggtcaggagtttgtgaccagcctggccaacatggtgaaaccctatctctactaaaaatacaaaaattagttgggcatgacaatggacacctgtaatcccagctgctcaggagactgaggcaggagaatcgcttgagcctgggaggcagaggttgcagtgagccatgatcgtgccactgcactccagcctgggcaacagagtgagactccatctcagaaaataaaaataaaataatcgaaggaatatagtttgttttttttttttaagtttccaaaactgacctaaaatgctccaaacgtgacccctgacccctggtttgcatacatttgaaaacctctgagtaaaactcacatttccagggttattctactaccttgacagtcattctcataagtaggattttggaagctgatatacttgagaacagaaattgcttggctgccgtgataattgggtaaactctactaggaagttttcctgctagaaggctgctttgcccagagctccaattatattgccctatcagtgtgcctcaggtggactgggttggatataatgcatttcagaactgtttggaaagccctgttaatttttcattaagtggataatggtgctacatgctttcatgtccattctgcaagtctgctgggagcatgggattggatggcagcaggctgaaatgatctgattcccccttagtccatgagctgcaataagtaaacatctcccagcccccctccaatcttattagaattgaacttttgctctgctggcccattagcaactcactagtgtgtttctaatgtttcaggaatgaccattctaattattccttattgactgctacagaaaccatagcacttaatggcaacacgttaatggtctatgggtattggtcaataattcatacgtggagaaatagtagagggcctgcatcctctgggatgttagccaagccctctgcaatcttaaagtgctaggattcttccatctctaggtctcacctcctagtagttgtcactgaatcatcgcctttgttgaatgtttggtcttgagggagttaaatgccttcccttccaggtcagagtagcagatcattgaccaaagcagtcaggttacagaactggctctgctgggattgggagagaacatggggcccagggaatgcgtttccattgctcttcactttcctgtctcttcaggttgctcggcgctggggcatccagaagaaccggccagccatgaactatgacaagctgagccgctctctccgctattactatgaaaagggcatcatgcagaaggtgagccattatacaagacccttagcccactctggtctcttttaaggaaaaagtccagggcttctgtagtgagactggtgatcgtcgctacgaggaaattttagccccctaagtgattctgtggtaggaaacaatcttgagaagacaaacttgagacaagaatcaaatgagatatagagtacatttgatgctgttggttatgtggaaactagaagttgcatgcagaacacacaatagaaaattaggcttctctgctttcccaaaactgcttctatatatagaaatttccagaaacttaggccaactgttgtatccaaaaaggactacagggaatcaacttgaaggtctctacttcaacagcttgattgaagtctttagttattaaaacacctagacctccaaatctgttagtttgatatgctcagaagtgttagaggaataagagcatctgatttttctttcagacttacagaaactggaactcaagttaaaaacccaacgtttgtagaatggcagcagagtcacctggtagcaggttgctctttgtggaatagaggatgaagcatattttgaagaaatcagtacaaaattcttcgtgggataggtagcaaggggccacagtcttaacatcccatggataagtagaagatgggaatggcaagtctttcttagctaccaaattcgtaatgtactgttgcccagatactagcatttacacattgagccagtctacctggcagtagccaataagatgaacgtggcagaagcatatgggcaaaactgctgagaacttgtctacaagaagccagattcatctttctcataggcgggtggtaatgtgaccccatattctcctcgccaccttaaaaaatactcaacagctcattgtgattttctggataaactctagacttgctagtgcgtcatacaggctctgaggctgttcccagtctggtcaccacctaactctcgtttcttcactcaaacttgacggctttcactagcatagccaccttttaatgtaatgtagtatttgtttgccaaagaatacatgttacatgcatgtacattatcaagcataccataaaatggaagacacctattaaactgtcatcctacttaagacctagaacattcctaatgctctcagtacctggccagcccctccttgttttctgtcacctttccatttcagattgggttaggtggtcccctttgctgcttctgatggcaccagtacttgttcctaccactgctcttctcgctgtgtcttaactcctttcttgttactaccccccactggagtgtaagctcctttgggttaggaattgaggtttaacttcagtgcttgatacagagttaaatgctgtaggataggtggtcccctaccttacctctcctttttttaaagtatacggtccagtggtttcacagagctgtacaaccattaccacaattaatttcagaacattttatcaccccaaaaagaaacgccatacccatcagcagccactccccattgtcctctatcctccttagagttgatatcatcaggccaaatcctaagttcaggtgggagagccattattcctttgctgttcccaactccacatccagcatggggagatgcaacccaggacacagtaacttgaaccaatggaaatgagctgtccttatgactagcttctgtgttttctaagggagtagaagagaactttatttctgagaataagtaggcaaagagtacaggaaggcccaggaatgaggcttcgtgggctcagatcctaacacttcaatttgttagctgtatgatttgaggaaagtcacctaatctcccaaagcctctatttctaataaaaatatagataataattcttgctttaatcccacagggtaatatatttgaaaatatttcagaaataataatgtgccatccagtgtaaggaaggggttattattttatttgttacatgactcacgagtacatgagagctcattaaaaggtgaatgatagcccgtcggtgtgtagagagacttagaaaagctgtagtcccatgccctccatttttgaagggaaaattgaggttcacagaggttaagactcattagtgactaaaccaggactggaagccgtgcaactcccagcttctgatctaggattatttccactgtgctctcctgcctcactctcccacacaaactaatttttggggttgggctttaaggtaaaaccagcgtacaacactaactagaggtggttgattggtagagatgtggaagcagagccatacttgttcaattaaaaaaagattttagaatcacagcagaatgactgaagggcaggattaaactcaacagtttgcatttttaaatctaaaatgtttatcttatcagtaaatttggctgccttcccttccccctctgcgtctccagacagaagccgattattgggtttgattttcggtattaggtgcctcttgtactattgctgaacaaccagcagagagaaggtgatcccattgacgcagatgtctcatcagccacataccatgaggtccttgaacaaccaagaccttctggttctaatattataatgcagaaaacccatagaaaggtagttagcggttccctcagtgtagcagagccatgcggtgagtcatttaaagctgcaggtaagccaaaagcaattcttttcagctttggaacatacttaaggcttctgcgcaggctcgctctcatcagatttctaacctttctaaataacaaggccatactgtgaagactgtaaactctggaagtgactaaaaatgtggtcaggcttctgccttgcacctgtcagtccttaaacctttttggaacaccagactccaggctcagcataaccatgctttcaaagctgtcactggaagacagaaagtgaagattttcttttaagagtccatctagtgtgaattcgaaattcagatatcttcttttttaactgctgtagtgtcagtaaaacacttggcagataataggttcccaggagttctcaaaataagtctgagtgattggggtaatcggctgctcctttggtccctggctttgtgacttaggaatacctcgttctcttcccctgatcccatgccctgttccaactgggccctgtaaggtgtgtgttctcccgcaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtacctttggaaacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcccagccaatggtgagctgagatcacctcatccccttgagcccaccaagccaccaattcttagtaactctttttttaagtgtagcccatgtttcgctttgggttgtgtgaaaagattacaaagcagtctaggacttccgagtcccagaattatcctcagccccttatgtggatactttgaaaaccagtaagaacttaagaccattcattttctaatttttccccaataagttttgctcttgacaagtgaaaaatcaattaatggttgataaataacgaaaaaagctcaggaaggttttgcccactgtgtttttttctggccgtgcagcagtaaaaacctcctcctccaagtttgtctctttctcgtgaatatgtatcactcgggaaatacgtggaaggaaataaagttcgccgggttgtattgcggtgttattacggttattacggtttctagtgctcttatttcaccctttttctgcacctctaatttggccttctcaagactcctattacagtggagaaataaagtagagccttttttcaagcctagaacagaaggctttctgtcagtttatctgctatctttctttactgttttacaagcctctaagtgtagaaacatcgagactgaatgagtgcaccgcctcttgaatcggagcttgtgaggaatgaatgtctgccacataaaccccattagcttcgacagattaagaaaagatgcttggggagaaggggcaagggtgcgcaggaaaaagccgtctctgcctctcagcttcaccatgataaggctttaacaatccgctccccattattcacgggctcgttatccagcctgggcccggacccagatcgttaacctaacgcaggaggtcaccaaacactgccgcccttctagtgttgggcgctaggataaggaagctcagagaatgggaagtttactctgcatcagggtcccctttcatgagccaagccagggaaacaatgcgtattcagttgttagatgacaaagaggtagtgtgagcgcagaagaatgtggttttgagagccagagtatgtgcagaatctaaattctaatgcagctgggacaaatgtaaactaatgtggaagaaaaacactaatgtacccagacggttggaaactttggagagaccgttcattgcccagcggtgcaggtggctgctactcaatgtgtggcctctgaaatacaagagaaaggaaaaaagtccagaagatcatcagtttaatacaaatgcatagtgtaagtattgtttagtacaaatacatagtgtaagtattctattcaacataagtgtattgtacttaaaatagggggagggtgtgagggtggtaccaggcgagcggctatgtccttttgatcccggcaagtacactggtgtcccattcagaaggggccctttgaatgaccagccttagctcctccaactttaagagctggctctacacccaagcctgggtttgttgaccttggcagtgaacctcaggtaacctttgggtagcactttacacagcactttttcatctccattatctttttggcaggctttctgaaatggtaatactgttgaaattgagtctgaaaataccatggctgttagcctccaaaattaatttcttttttggaattttcacagtggctactgtggaaagaggactagtcccttggagcctagacatttgggttctggccccaggtcagtggttgattgggtttaactaaatggtctcaggggaccatctggcctaacctcctaggttcattgagggcactgatgaagtactactccccgatctcataggcagtaagggagaaagaaaggagtttcctaggggagtcaaggaatgtgtgtgcgtgtgtaggagagttaacagttaagaacatcattctcaagtcaccatttttaagcaagctctgaagatggctcagttccaccattaatggcacatttcttctttttcaatcatccactgagcacctgctaggtgccaggcactgctggatgctaaaaataaatgatttaggtggcattttcaagctaaagccctgtttgtggtatagtaattgtgtgacaacctcttacatgtttaagtgctatactttccaggtaatacttaaacaccactgacaccatcttatccagactatgttgaccagaagctggggaggctggggcatttatcctccaactcctgcccttattggttgaaggttatccccagagatgttaactcttcaatatatatcctatcaggaagagaagagtgtagatgcagataatcagtgtgctaggaactgttttcagatgcagttagcttagggggttgagggcacatggagctggcatcagtgatgtctgtgacacctacctttaacaattagccggactctcctggatgacctgtttcctagagtgaaacaagggtgagtctgtgctttcatcattgagttatcatgtaccaatcatcgatgatgtgtaagacactataatagacactttgcaggtgaagataagggagtcacaagcccaccctctccttcagcacccaacaatctagtgggggaaacatttctccaggtgaaactagaatgcaaggtataatatactgagtattactcatccaataaatagtgcctagtctatgccaggtactgctgtaggattcgtggagggaaataaatctctgctctcaaggatcttacatctgggcaagggaggaaaaaaacaaatgatagaatttgttaggtgttaagtactatgggatcagggaagggaaatggtgagtagtgggagtggagggttgcaattttaagtagggaggtcagggaaggtctcagttgagcaaagacccaaaaaagtagctgccagatggatatcggaaggaaaagccttccctgcagggggaagagcaagtgtaagaccctgaagctttgaacatgcttggaatatttatggaataacaaggactgtgaaactggatccaggagtcagatggaacattgttaaagtaacgggttgtatcatctggggccgtgtaggctttttaaggactctggcgtttactctgtttatgtttagctgttagagttttttgagctaagaagtgacatcatctgatgtgtattttgaaagatcactctgactgctaagttgaatatagactgtagggaacagggaaggaaggaagaagatcaagttgtaggaggctgcggtagtccaggcggggtgagatggtggcatgagccagggcataaggaaagcatatatgaatatatttgtaagatagagccaacaggctttggacttgcaaggtgagaaatgaaagagaagtcaattatgtctccaaggtttgtggcctgagcccaaggaaggttgatgttgccatttaccaagagggagaagactgaggaggaacaacgtggggacaggtgggggaagaacaggcattctttagggggcatattaactttcagatgcctttgagaaatccagttgggaacacattgggttatacaagtctggagttcaggggagagatccaggctggagatagcaattaggagttgtcggcatgcaagagagtatctaaagctaaaactggatgaaatcactaagggagtaagtataaatagaagaaaatttccaaggactgagcccttggacactccaagattaagaggctggagagacaaagaagaacctgaaaaggaggttgaaaaagagtggccagtgaaataggggaaaaccgggagggtgtctccaggaggaaggagagagggacaatggccgatgcttctgatgtgtccagtacggtgaggactgtggctggattagcaatgtggaggccatgtatgacttgcagatgccatttccagagtggcagaggcaatagaactgatcaatactactagaatccaaaggaggtttgaatgtaccctcagttggggacagggatcagagaagtttccatggatttcaaaatcctggatttgagttcagctcagcctctctcactagcccttctactctcagaccttcaaaggctgaaaaaggcctaggaaccctgccaggtagctggactggaagatacaaggtgggaaagagtatctgaggataaaggaagaaggatcaagatcctgttatcactacctttcccatccccttggggttctatttattctcatgttgtgctcttaaaataaatttctatttttgaaatgttaagtgtttttaaataacttttttcatattacacaattagcatatgttctttgtagaaaaccagaaaaaaatcatagcccaaattaaaaactattctgaaaactcaacctagagatcacagttaacactttacatcttcccagatggcttttctctatactgtattttaaatattaaaaatggtcatgctatacactttacaaagtctttaaacttgttttaagcattgtattttgaacatctttccatatcaagaaaaactcttttacaccatttttaatgacaggatgccattccatagtacgtatgtaacatcatatatttaagcagtcccctttgctggagataaagggaccacaaatatgatatacccatgcccaccaaaccaagtaatctacactccccccagcccaaaatcaaacaaatgacaaataataatttgggtcttttctattgttttaattagtaaccaactcctattaattctaccttctaaatatctctaaaatccatctccatcatcagtaccgtaaacctcccaatatctctcacctggactgttgcagtcaccacctaacaggtctcaccacatcttgccccacccccgccccttctgcatgatgtaatcagagtgatttgtttttaagcgcgagttactcccctacttgagacttttcagtgatacccactggagtggctaaagtaaaaaagaccagcaacaccacatgttggcaagtatacaatgcaggcaggagtgttaaatggtacaaccaactttggaaaactatttggcagtttattacaaaggtaaacatacatctactctatgatccagcaattccaattctaagtatttgccaaaaagagatataaacatgtattacaaaaagacgtatgcaagaacatttatagaagctttatttacaacagccactcaaaacaacccaaatgcccgtcaaccagagaacaaataaacaagtcatggtatccatacaacagaatactactcagcaataaaagaaaatgaactacagatacacatagcagtatggatgaatctcaaaaacattatgttaaactaaataataacacaaaagaatacatactgtgttattctataatatatgaaattctagaatagccaaaactaacctatggtgatagaaagcggtagcaagggatgggtggacaggtattggcgggaaaggggtagagggaacatgctggggtgattgacagaaattgtctatatcttggtttgggtgactgttatatgtatatgtttgttaacattcattgaactgaacacctgaagtctgtgcattttattttatgttaattattcctctgaaaatatagtcattgtttgagataaaaccaaaatcctgaacttggcctttggcaatacctcttcagcctcaccatgcaccatcctctcccctgtaatatatgttccacggcccctcgccttcttccagtgtctcaaccataccttgatccctcctgttccatccttgacacgagctattccctggagctgaaatgttatcccgcccctgaatccatctctggcctccaagcagcttaccctccacccattctttactctcatttctaagagcaccccagggaaaacaatcagtttatctttcaaataaatgaataattgcattttccaagccttccaagatttgctctcattcccctccaacaccattttaatactctttcagtgcttgctatctattttttatagaacttctcacaatttttaacctttcatttgcaacattagttacttggcctcccccaataaacggtacattttatgaaggcaggaccgtacctaactgctttatctacgataaagagtaggtgattaagaaatatgtattgactgactgagtgcagttatgagcatctttgttcacttacgacttccaggataaattcctagaagatatatgatttggtcaaaaggggggcaaattttaaagccatttatatagactgcaaaaagccttccagaaagattgtgaggatttgtacctttactagtatcctgcaacttctttcgcctaggttcttacaacctttgtctacattgggcattatttgtatgtacccctctgtttaccattcattctttcttatctttattcaaataatatttattgagcacttattatgtactgcgttctgagccagatgttgaggatgaaatgatgaattcgatcagtagttttcacattttttccttacattctctctaaaagaattttgaaaatctaggtatcctttagcactgttttaagtcgacccttaataatttccaccgtattgtaaaaataatttcccatttattataaattctgacatttaaaaatattatcacaatttagttattaaaaatgcaaaattagctgggcatggtggcaggcacctgtaatcccagctactcaggaggcaaggctggagaattgcttaaacctgggatgtggaggttgcagtgagctgagattgtgccattgcattccagcctgggcgacaagaaagaaactccatcccaaaagaaaaattttttttttactctattatacctgtatacaacaaattattttagataatttcctttgacaataaagctatatatcttaaaaattattctgtatttagtgattacaagtattagttcacaattgatcaaaaaacataaatatatcaccaaatctgatatacacttattaaacataaaaagtaaaaatctgtctgaattgaatctctgaatgagctagatgggagtgttattggttttgtccactagttcactgcaagaatgagatgggtttagcatcaattctattcctatttttccattttaagtctaagaaatatcatgtggcagagagtgctacctgtccaccaaaatcatttttcttctctttcagtaataagattgttaggtaaatatgcgggtgggctatatttcccagcattccttgcagtgtggctgtgcccattatctatatattgcctctcagctcaaattcacccttgtctgtttcctctgtaaagttgatctgggccctttaaacatttttcctttggtggctggcgctgaagctttggggtgctagagtgatactgaaagagaaaagcattttacttcctagttcccatgtgcagcctcctccaaggatcacagcttctccagtgcccagctactgcagtgcacagtagtcagcagcacccagcagccggcagcttcccttggcccccacccttccagtcagttttgtagcagggtgggttgagcaactttccctggcagccaatagggtagatttccagcaagtgcaaccagcaaggcacttctctgcccttcagcgaacaacagccatgccctgctgtgcagtaaaggattaactcagttcacattgtccaagccccataccttcaaaaaaaaaaggaaaaaagaaacgtattggaacatcctgcctgataagagtgtctttgtttatctaggaccttaggccacgccaggtagtctatgctaacggtgtgatttatagtgggggtcttggtatcaactggcctctggaggagctgaagacttgaataactaaggtcagctgtgagcacaatcagccatgcctatgtgatcaacccccagtacaaaccccggacaccaaggcttgggtgagcttccctagctggcaatactttatgagtgttttcacacatcattgctgaaagaattaagtactgtccatgtgactccactgagaaaagacaactggaagcttgcatctggtctgtcccagcctctgccctatgtgccttttctttttgctgattttaactctcttttcattatgacaaaccataaccctaagtataaaagcttttttgaattctgagtcctcacttatcactgaacctaaggataatattggggccctcaaatacacctcttcaatgaaatatgaatctcagccctgatgaaagagaaggaggtgggagtgctctttctcagctttagggatagtatccactttttataaatgttatccctttgcttctgaactgccaatcccttgtgactccaatcccctcttacagttaataattcttcctattaaacttcccctatttaaattactatatggtttctctctgctgattggacccagatggatataatctaattaaaggtaagcagaaataaaacatgctctttctgggctaggactattaagagagcaagtgctcctctgtgcattcttctagttgggtgtagatgatggcaagacccttgggggatggtggagccacacatggaagaaacctgggtgtcttattcaccacatgcaggagaacacttgccaattaggaaataaacttcacgtttgaaccatgtttgggtctatttgtaacagcaatttaacctactctaatacaccttgttcacttaaataagcacttaggaataaaaggagttgtgtgtgagagttttg

SEQ ID NO: 1151 - DNA, 2902 bp, Homo sapiens
gagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaaggcaattcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcat

SEQ ID NO: 1152 - protein, 451 aa, Homo sapiens
LKAIPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAAPPPPQGFKQEYHDPLYEHGVPGMPGPPAHGFQSPMGIKQEPRDYCVDSEVPNCQSSYMRGGYFSSSHEGFSYEKDPRLYFDDTCVVPERLEGKVKQEPTMYREGPPYQRRGSLQLWQFLVTLLDDPANAHFIAWTGRGMEFKLIEPEEVARRWGIQKNRPAMNYDKLSRSLRYYYEKGIMQKVAGERYVYKFVCDPDALFSMAFPDNQRPFLKAESECHLSEEDTLPLTHFEDSPAYLLDMDRCSSLPYAEGFAY

SEQ ID NO: 1153 - DNA, 22281 bp, Mus musculus
  misc_feature (1)...(22281): n = A,T,C or G
accctttgtcctggatagaccctgccttggccttgtctgccagccatatatgtgcaataaagacagagcaccacctgagagcaagaggctgtcttgtagcctctcagtggctccttcctcctctgcagagctctgtctgatgtactctacaaatgaccttcacatacatcagagctttcttgggaagaaaaaaaaataatcagaaaagcaccgactttcatcatcatcatcatcatcaccaccaccaccatcaccatcaccatcaccatctattattttacttaaaaaaaaaaaccaacctttttttcctccaagttgttaacatacccagctaaagtagccatattacatagctaagctctcaaagatacaggtaaaaccctgcatagagaggtcactactgccatatcaataagacaaaggctcttgaggaaaaagcttttcacgtctcatcttcactctgccttctaactagagtatggtcactgagtataacagccatgtgtgatcaggaatcaatgaatatagtgtagtggatggtgtgctgtaggtttaaagaacaaaacaataaaaggatgctggatttcagatggggcctggacacaactcgaagagcatgagtgtgtgtgtgtgtgtgtgtgtgtgtgtgtgtgtgtttgcccacaagcatgctcctgggaattctgaactacatcttaagaatgtttcagcttccagtttagcctcttgtactgctctctctaaggcatctcagaagctaggggccatgctctgagaagcccaagctgtgtggggacacagcttcctcctaggaaactctgatgtgtgtatggctcatttgtagagcacatcaggcagagctctgcagaggaggaaggagccactgagaggccatgtgacagccacttgctctcagtgcatctgccttcattcatatagggctgggagataaggccaggcaggcctctgggacaaatagtttctattcatggtaataaaaagagagaagcccaccttcttaacactctgttggagagggacctggtaagtacaggtcaggaaatcatgatgccagtaattaacattctcggggaagttttcaaagctcttgatgagcacactgttattttagcttcatggtaaccccaaaggggctgtcattaacctttttacagatgggaaagctgagagaggcagctttagccatttgtgatccctgcttctgaccaggtgctcgagatactaaagcactggccatttaatcttcagtgatcctgccctttgcagatgaggaaacagaggctgggattcataaaataaggaatagtgtcagagcatgacccacatttataagaaaactccccatccctttgggacactgggatggtgggctgggccttgttcctctttctgaaaccatatccagaaaccatctttgtgtgacctggaggggacccaactgaacagggttcagaggtacctgtcccatcatcctgaatcacagggagatgagacccccattcaggtggttggctagtgacctctgatttcttttggtgtgccataggtgcagggcttctcagttttggatttggacagtcagttgggctattggggccagacttaccttgctgtctctgaggtttcccccacttggagacgttctaaagaggctattcgttccttctggtatctgtcagactgtcaccagactgttgaatcctgactaaggagcttccctattctctgtgctgaggcagaggagggtctggacatcactctgcttgtcaaggatctgtggccagatctcccctagtctcctgaaattgctgttgggatgagaaacacagaaaccccacctcctgtcgtatcagcgttttattgtatggctccaccccgggctagggatggactgtgcctttttttctgtgatctagatggaataggacaccaagaaacgtggttggtatgagtgtggtcacaaggtggtgatatgactgtgaattttgaaactatctgagttactcttatcttggtggctttagcctcgaagggcaaggacagaggttagggtaagctggtctcctactagaagccccagacaaacatttattaaatgactaatgtgcctctgtgcagagttcagcagaaactgacccaaaggttaaggtagcaaaggagacaagcacaaatggtggaaatccctagcgtttttactcgtagttattgctagagcccagggttgtgctatgaaacctaggttgtgctcaaatcttcagcaatcaccctggttcagctttccttgttctaagagaacaggcaagcagtgccaagctcaatctcatcgtgttttagctatccattagacactcttgtgggctggaaggtcagtaaagtggctttcaagtaagaccttgaaaagtaccctatgtggcttctatcattttaaaccaaacatcagagatgtcagtcgcactagcacaagacctgcccagctcatcacctccagagctactgatgttcaaagtcaactaggagccagcaaagctagaattaaatggcgccacacttaagagcatgtactgtttgtgcagaggaactgagctcggttctcataacccacacggcactcagtcatgggttctgagaagatggagtgagctggtaccctacagttcccatgtgggacacttcatctctccaccaacccactcttctcatctgtgcaatggacacagcttggttgtcaaagcaagtgataggtctaacctctgcaggctcttggtttagattctctcttcacctcccagttccaatactgtagcttcagttctgactctagcttcctcactggcctcagtaatcagatacccctttccaaatgttctccatacatggctcagaagatcagaaaggatgtctattgtttcagttaagttaatttagcctcctggggctattggatatgggtggttactctagacaaagggcttaggaccttttgccagaagtaaatagtgtgtccagatccttgggacaccctatcttatttttccccttgaggtgcaagagcagatgctgtcctttagaagggtgatgtattttccagggatcgtaggcgatggtggtgatagtgaggagagtcagagctttagcttgtaagaagtccggccagatcggctagcatctgtgctcaccctttgcacacttgaggccaagcttctcagtctccagccacgacacattttccagcggtcagctctcctgtcctcagggagttagttatgcaaagtgagaagccatggtcctaggctcagcctaagggtgggaatggagcatgtggacaggaaagagcaagaaagatggaagatagctctagtccaggccttggaactggggtcctctgctgtgcactgggaccactgcagaaaaaggatttagggaagagtctggaaacttcaatagggcaggaagattccagaaactttgttctttttttggggggggtggggttggtacaagggaagagagtttagagtcattgctatcatctttatggaggcaaaagtgggcaagatgacctggtgaggaaggatggggtctaaccccttccccccagtaatccagggaaactcatattaaattgaactcagagtccagagcactcacattgccacaataactagtagcaaaatgtatttgcaaaaaaaaaaaaaaattctgagacaaggtcttactacatagctcttactggcctgaaacttgctatgtagactaggctggacttgaactcaccaagatctgcttgcctctgccttttaagtgctgggataaaatacatgttcccccatatatggcaatacttaggattcttacggtaggaatctttgagataggaaattaagtctctaacaaggtaaagtgcagacatggtgaagttaggtgctgaggtggggtggagttctaagtgaaggcccaattaagcattctttccatgtgcattctccaactccatgtctccaacaaggcatgcctctaggcctctcccagctttctctcggtggacagagaagctgtgttctcaggggctgtggctgtgcccaaaaacgtgaagggctgttggataagaaagtgggctcaggagccaggctgctgggctcgtccagcctattaaacattcctttgttattgtctgtttctcccactagattgtcatctcccttgagagggactgtgtctgttttgtttatgctatacccccgatgcctagtatcagtgcctctaattacttgtataaacagtgactagcaagcctgccactcattagtcatatgattccgggcaagttgttacctctcggagttaacatttaccaagccttcactgtattttagcagtgtttattccatgagccttgcttgtgctaactcaaactccacaagagccttatgagatggttactatttttatttccatcaatgaggaaaatcaggtcacaagagcagagatgacatgcttaaggtagctggtagcagaggcttaacacagatgagattaagtcattgacctagaagcaaattaattgttggtctactctggcccctccttctgcggtcatgtgaccctctccgtactgtgtctcagactgctcataactccttgccaataaaacagagttaatcacaactcatacttccttctgcctccattgcccactcccctcatccacagcctggcaacctcgaagaggagattgtgtcccagacaaagctgggtaccgagcccagggtgagggccatacaggcatgaggttttttgtcactggccaggaagccaggtttctcttctccttcctgtattcttctgggtgttgtgttttttttttttttttttttcttgtggaatggagaagctttggggtgggagagaacagagaagcagcaggagggtatttccatgtctggtcagtggtggtctcccccatgccagctaagaatggcaggggaaaacaaagaatagccagaaatgccaggcagaattaaaatgatcaagttcaaacatcaaagaccaacaaggaattaagcccagacatggtggtgcacacctctcaccccagaacttgggaggcagaggcaggcagatttctgtgagtttaaggtcagcctggtctacagagtgagttccaggatagccaggagatagctatgtagagagactctgtctcaacaaacaaaacgagttcctctgtggttggagagatggcccagaggttaagagtacttgctgttcttgcagaggacccagatttggttctcagcacccacatcagggggcttacaactatctgtaaccccaactctgtggggactcagtgcctgtggcctttataggtacctgcactaatacagacaacactcacagacagacacataagggaaaataaattacaatctttcaaaataaaatcagatctttaaaacaacaataaaccaaaccaaacaaataaaaacttgtttaaaaaacaaaaacaaaaccgaaaacctcaagtgatggcaaagtctgtgaagctgagcagggcgggcaccctgagggctctggccatacccactctcaaatttgggtttgatgatttgggggaaaagacacaagatgaagcccagggctcacagaggtgataagtagagacttgatcctggaaccccatggggtaatatgcttaagccaaaaaacgaacactctgccccaggactgcctggaaagtcactcgccccagcacagaacacaacagtggaaccttgtgagctctggagcttggggacatgccagctttctcatgaatctgtgacccaagttcatccattatcacttggagcagaaaggcaagaaagttcaagccctgacagctggtggctgcctcagagaacagccttctctctaggcttcaaaaatacctcctttcctccagcgaaataagcaattcacagtcaaaggccacccaacactcagtgctctggaggctgggcagagagggtgttccatggcctcagactcctcacctgtaaataggagccttagccagatgctcccaaggtctcccctgcacagatattctctggaggtacaccctaagagagcccaagatgtgtccccattttgtattcttggtctcttcacaataaagagctcagtagagggatgtgtgtagctggaagatgcaagcaggaagctgttaccagttcccagctttggggaagggcagaggggggaatgagtaggggagcggtgcctgagactctgactgggtctttgatgtgtgcgttgctaggtgggcggtgggcctgtaatagaggctactgagggatggaggcaggggaccctgagggcagcctcagcgttgacctacttgggtccttataattgctcccttcatctctcgagaggctacaaatagggacacccagttggtaggctcctacagctgaagcaacagcagcagtggtgagtatggttgcttgggaactgcattgggctcggagttggggcagctcagaaagccctcaacaggtagcctgttcctggagacagggtctggatatgggagcagaaagctgatgtgagcaggtgatggggactcagagggtcccttgtacactaaggagctgtaaggaagtttgttttgggtagtgtgcccagccacgatcttgtactgatgtgggggggacagtagccagctatgcttctggggtagcccttagtgagctccgtgcttttgctccttgactctttgcttcattcctggggacgagttgggacaggccagggctgcaggagaagagaggattcctttgagtcttcaagccctgtgcttctgaaatagcaactgaagtggcgccaggcaggctgggaggaatcagaagggctcagaggagccgagctcctgggatcacccctctttcctctccaaggatcatggtgctttcctcttctgggaacatggatccttgctgcagtgccaggctatcacagagaattagacccccataatgcttgacacttcagccccattctcctactttcctgccagctacagtcttgctagctatttgctccccatagagggaactcaccaggaagagtcttggctctggctaccctgtgttggaggactctagtcccccgagggagtcaggagtgagtcattggactcacatggaaacaactccattgcctccctgccagcccagggttcgcccaggctgcatgggcaatggaaggggacaatagatgtggggtgaaggaaggaattctaggaagtgtttcccttccatctcagtgggggactcttctcaaagccttctgaggtcccccgggggatgggaggatagctaaaggatggagtaggtcatagatgagtagatctatgtatgaactggtggactctgcagacgccacctggtccatgtttctgactaggcctgtgaggctagattatcccactttgcagataagacaactgagacccagagagaaacagttcgctcagggcttcagagtgcacaatagaatgagggtcctcaattgcagtttctttgagttcagggtaggaggcatagtgaggtggaggggtcctgtcaggcctcaccactgcctctggcattagcctcaccaggatctggacaaagaagccctgggcagggcttcctgtgcaagctcttacaggatgacgctccaggtctccaaaaggcagaggctttctaggatcaagggcagcatcacatggaatggtgcccaataaaagactgagaattcccaggtgttgtgatgggaaacgatgggagggagtcagagtcagagggaggctcccagttggggtgaaggtggtagatattctgctcctgaggaatttatggtgatgtcagggaactgaaacttctgtctagaaaaatcacaacaggcacagcggggaggtgaattgattccttgcgagtcatacccttgttttgtgacagtgaggatgacccggcccctggagcaggcagtagctgccatcgtgtgcaccttccaggagtatgcagggcgctgtggggataaatacaagatctgccagtcggagctcaaggagttgttgcagaaggagctgcccacctggacgccggtgagcacctcatatctctccccacttggactctgcaaatcgtggcctagggccaagcagcagcatagggtagcacatgagctgagacacagggctgggaagggggactgaaatgggtgtcttatcaggtgggtaggatgaggttggccccatgagggttttggtttggaatggggcagcctaaccatcggaggggagtggtgtgggaagttactttggctccttattctggtttcctgaccctgccttctcatcccttccacagagtgagttccgggagtgtgactacaataaattcatgagtgttctggataccaacaaagactgcgaagtggactttggggagtacgtgcgctcacttgccagcctctgtctctactgccacgagtacttcaaagagtgcccccctgagcctccttgcccccagtagcctctgatccaaaggtgtacgctatcccagaagggcagggtctgctccagtcctccatctttgtccttgaggtggtcctgggtgtgtagccacacccttcccactctctctgtggtacccctttcaatctagacttgccaagttcttgatgtgctaaccccacccagctacccatgagctttcgaggctttcctagggatgtctagcttgtgaggggtgggacagtagccagcctttgccgcttctcttcttggaagggaagaacatctctgctcagccatgtgcacacaactgggaccgctgtggcaggggcctcctcaactcccaataaagaaatgtcttcttggcttacttttgtttttttttttctgatgggacacactgggccttgggactgagtccttgttcctttatgctccttactactggaggtaggaggcttaccatggaaggcatggacccccaaagcagtgtcaggccctgtagaaatgcacacatttcaggagggtaggggtaacacaaggtcctatcagatgagactggagggtctctgtctctctctgtcccctgtcttgaggtagaagtccttatcttggactttctaggaggacaaggggctccttgggaggtacttgtgaccagatgctgcaaggagagtatggttgtgggagcccaaagccaaacctccgtctaaccttcactcaatctctgcatttgtaccctatccttagagattaatcctgactcccccttttacctatttcctctttaactctcttcttcaagctgaacattcaaccccgaatgctcctgtcattcctcaatatccttactccagcttccatccattcgaaaacctccaggccacactgccaccctaactccatcatggcctcctaggtatagctcctacttcatacctggggtggtcccaaggtccctcctgacttgctagcctctatcctgggtcttcctgattgtgacaagaagctgtttaggctggagggaagtgctgacattgtcccactggctggggtcacctccttcgttcctgggccacatatttccagggcagctccttatccctagcccataacatctccatctcctttcctgtggcccacacctcatgtccaggttgcccgttctcaaagcttcctaaacttctggctgagctgtggctgcttggtggtgtccaccccatccaagtctctgccgtgcccactggagctcactcactacttgattgtgcctgctggggagggagcaggaagcctggttcccagactgggctggtcgagggtgctatgacatttactacatcaaccaacagcaagagcacagtatccatgttcccccatcctctgcatgggcagggcctggcagggtataaataggtcagattgttgggctctccccaaacctctctattcagcacttcctctctcttggtctggtgagttgtgttggtctgatagcactgctagcggcattagaggctgaggctagggtagaagaaaggggggctgctgggggaacagatgtctttaataaatccagatgagagattctgatgtggaggttcatgtatgtgtgtgtgtgtgtgtgtttttcacgagaatgaaaaccaaaaaaaaaaaaaaaaaaaaaaaaagtgtataaatggctacatctgagctcccggaggttttgagatactgaggctggcttgcatgttgctatagtgtatattggtggtgcttgggagtcactgtcatgcataggatgctgactcgtgttgctgggtaatacaagacagtgtgtggacactcgggtacaggaagcaaagcgaaggcatcagtaggcctttttgttttacagtatttaaattacagtttttatttgtgtgtatgagcgtatgggttgggctggagcaaatgccaaggcgacattgtgggagccaaaggacaatttgtgtgggagtcaatctgttccttctagcatgtgggctgtggggatcaaactcaggccctggagcttggtggcaagcacctctacccactgagctatctctccagcaccctcctgcaggcattcgtgtttgtagtgtgtcttatttttaatagccctatgaacatatagcacctaggccaagaaagcctggcttccccaccctctcctcttgcatccctacctctgccacttcatcttactcctattaggcagctggggtttttccacttttttttgtctgcctctgggcaggcagccagcagccgcgcccaacgctgggagggagaagaatgggccagggcctggtgcttgtggttgagctgtgggagtgagtaagctgatggaaaactgctgttgttgaggccaggactgagaggcacagaaaggtgctggcatggatctccagagtttgaggggtaggctttgcaggtttcagagcccagagcacatgtgaccttcttgccatcaatgggtcccattcctctgatctccccagggggtgaggtccatctcttagagagttggctgggatagagcacttaaaatggggacagaatgagtgtgatttgggtcatgctcagcaacacatatccagttctcaacacactgttggcgtgggttggagaatgttacttttgtgtctcctgcccttaggtctcaacggttaccatggcaagacccttggaggaggccctggatgtaattgtgtccaccttccacaaatactcaggcaaagagggtgacaagttcaagctgaacaagacagagctcaaggagctactgaccagggagctgcctagcttcctgggggtaagtgggtcctgcctgtgtattgcacacgtgatgcatctgcaggaggaggctggggctggtaggcactagtcttgatgcagtacttagctatagctggcatatatccctgctctgggtgcttggtacggaaccacaatgaaccacctacttcacactagcccccagctgagacaggcttaggatgaagataactgaagaggcagaggaaaaccaaaacaaccacattaggcagtcagtgtctgaaaccacagcctagatcagggctgtctttccggagatgggcactagaaatcgagtttttatttgtgaagacatgatcgtggaggcacacaaatgcctgcagattatcctctcaataacaccttatattagttaacggatcactattatgacagtttcctattaagataattaaaacaagcacggggaagatgtggtcacatcctttcccagctatcccatgtgttcatcccatagtttagccccgaggctagcaaggagtgcttgcaaaccttcctgagctcctgactggaggcaaatatctggtttgagttggcttctaattgctcctcttctactgccagaaaaggacagatgaagctgcattccagaaggtgatgagcaacttggacagcaacagggacaatgaagttgacttccaggagtactgtgtcttcctgtcctgcattgccatgatgtgcaatgaattctttgagggctgcccagataaggagccccggaagaagtgaagactcctcagatgaagtgttggggtgtagtttgccagtgggggatcttccctgttggctgtgagcatagtgccttactctggcttcttcgcacatgtgcacagtgctgagcaaattcaataaaaggttttgaaactattagctgttgtctgagagactggaggctatgggctgagggctgtggtagagactgctggaagttgacctggagctttgtgggggccaaactaaaaaaggttggggaggggtgggtggcttattttgagtacattgcaagtatgtatttgtgtgtgcgtgcttatgcatgcgtgcatgtgtgcgtgcgtgtgtgtttgtgtgtgtttacgtgctcctatatatgcaacagagcaaactccgggaacactaaaggcagaaaccaccagaggcttagcttgaaaggctccagatgtgtgctgttagccagcccacagttctccctcctctctccagcactgcctctgggctcaaactgaagttgggatgggattaaaggtcacatctgctgctggttggggtctggagagaagacaacaggcctgcctgagtcatgaggaaggagtcttgaagccagagaagaatggagaggtggactggcactcagccctgacatttataggccaggtcctggcctgctaccccatctagctcattggcttcaaacactggatcaatcctttcctgtccatgaagggttggatgaagaagggtaatatagagggaggtcattcgtagtagcacaaggatctctctctttctctctttctctttctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggtgcaccagaagagggcgtcagatctcattacggatggttgtgagccaccatgtggttgctgggatttgaactcaggaccttcggaagagcagtcggtgctcttaaccactgggccatctctccagcccaggttatctactattctatgatagtatctactattactaagaatcaggttgcttagaggaagacaagagacctcagggagagtaaaggaggcagggggtagtagctaggtgggagggaaggagatgatggggaggtgaccatagttttagagacgtaattttggccataggacctaataaatagaattgagatccccatctcctcatcctcccaccctagagcacaagacataacgttgcctccctttgggataggcttaagggcagtgcttctggggtgaagaggatggcctgagattagacgccaagctcttccctgggtgatatggagatgcctaatgaaaggtgcacagaagccgtcccaaggctggcaggtttggtcctcttgacctcaggcttcctttctcatcattttgtgcttttctctctagcctcagaggactggggtaggtgactcagatgttcccttggagtttgactacagagacttaggtccaggctaagcctgtctcctctctttgcactcccagtcaatttgcccatcttgggagtgtgctccctagagcctccttctgcatcactctactttcggaaactcctgttgcttagagacaagtcccagatgtattactagtgtaatagttgtggtgggatgacaaagggggcagcagagagaaaacaggaaggctagcatgggacttcagccaagatgagtgttatgcccctaacccaattctgttcttagattcagtgtgagtgtttgcagaacacaggcaacttgtcttgacctctgtgccaatgatcgtaccttaacctgagcctcctccccagttcatactctcaatcccttttccagtcccaaaccttcctttggacctcccccaatcctggattcttagttctccaagctaggaagtctccaacaactattttccatctttcactttatgttagctagtgactttagccatgtccttggcagaaattaccttccttcactgatcccatcccaagaggggtcctttctgcttttggaatggattcagagatggaaggcttcagtgtggcgtttatcctagcatatggggagttaccctgtgtttgacccacaccttttaccattttttttctggagactttccctttctctgcctattacttcaccagatggtgaggcttcataggaaaaatggtttctgttattgaaaatacgtgtcatgggtaacttcatgtgccatatctagctctgtttgtaaatagcaagtcaaaatttccagcgaaggttccctccaaccttgtctggaagccctcatatttctgacccttctcattggctccacccatcctgatctcctgggtactggggacgagggaataaaggcactagtggggaggctgtggctgcagaatagattctccaggttcacttcttccttggtgagtccttccttcagatgacctccttcatttctgctgggtcagtctgggggagaaaactgtgacaagacatggagcccctccacaaggaaggtctggccttgctagtgggagcatgctcggggaggacaggacagaggacttggaattgtgactgtaagataccctgagatccaaccttggcagcaggaaagatgaggcaggatgatcatgggtttgaggccagctatcttaagatacattgtgagacactgtcagaggtgtgtgtgtgggggaaaccagccagatgtccctgcagaggctcagagtttcttccttaccttgagttttggtcctggctgagcctctgtgaggtgagaagccgacagtctgagtggcaggagatgaaggatgggtcctgcccattccaagaacttcttgggttggaggcagaggctgtcagtttctcaaccaccctcccacccagcccgggttctctacaggatctgcaaaagcccctggttctgtgggctttgcttccttcctctttaaggggaatgtgttttaagttttgcgtcccacaagcttcagttgtctgctcttttggtggagtggctatactgacagaattgagaccatcaataatcaaacctaacttccagaactagttcttacaagatcctggccatgctgatagccctgcccctcatctcctgcccctgccaggctttgggtacagctctctgggcaccagactggaggttactgagcaagtccagtcacctctctcctacttcctgctgagaccttatctcccagtttcagccccagccccctctgacccttggacttctttttgaccccctttactgtgagacactccatctcaggtgcctcaggataaaggagggtgactaggtgagaactgtggctggaagtgagtagggaagagacaaatcctgaccctttcatctgttctacctgaacctatactctctttgtcagcatgtcttgatcagggaagctgcaccttctttgggggttggacttacaactttagctgttatagtgtttgccatggctctcattacaacacacacacacacacacacacacacacacacacacacacacacacacacacacacaatttttttccccttgttggtggagtttggtctcactgtggactcctgtcagtggtggtttgtttgcaagagggtctttgggtatgcatgactggtgaggagcaagcttagcttctccagtgttgtgattgtcctctctcctagtccagggtacatatcgttatggagactcctcttgagaaggcactgaccaccatggtcaccactttccataaatattcagggagagagggtagcaagctgaccctgagtaggaaagaactgaaggagttgatcaagacagagctgagtcttgcagaggtaggtgactatccttccatatcccaccacatgctctgagcactccttctgggagatacccacctactctcagggtactgtagtttaagcagtttaagtgccagactgcggaagggccagagacaaggaaagagctggggaatccctggctatcgagtctctagacctctgttctggaaaggaggaggtgagtctggggatggacttctgcccatgggaggctaaggaatcggatacaggagactttgatgatgggttgcatagcctgtgttagggatcttgagggtctgagggatgtggggtgctaggtttggctgtgtacgactggagggtagagatccttcttgattatcctccatgcctggcagagccaaggtcctaagtgatgctaacaaatagactaataggctgatttgtgaacatggggtgagaaggagagagctttgaatctgattggatggccatgataggctgatgtgagggtctactccatagaataaccgaaccttggaaatatccgagaccttgtccattgggactgagctggagttctaggcctgggtaccaacctcttatttatttttacaatgaagtcctaaataccagtgtccccctggagacaaggttcctggagtatgtccacgggcagtggcgaagcagctgccacacttcttaggcctctgtgacctctctctctgaggcatgtgaagtttaccatagcatatacatttccttttctttttgagataggatttctctgtgtagacttagctgccctggaactcactctgtagtctcttacctggccagcctctagctcacagagagccacttgcctctgctttctgagtgcccccacacctggcctggcacatacacagtcaatcccagaaactgttttgctatcctggagctaataaaggtagaggggaggacctctggttcatctggtgctaattagggggacagagccccaggggaggagcccagtctggggaccaggatcgtgttccagagaagcagtttccagcatcatgactagcaacatcctgcatccaagggagacctagaactgattgcaatggagggaaagcagggtctacaaatttgcatctccttgttttaccctaaggctctgtcttcaacttcctagtagagccagggtgcagggaccaaactgggaggaggacatctggtgccaggccaggttttagggtagggggcatgctgggttctcagttccagtatactgatcttacagagagtggtgatgtctggatcctttaccagcttggccttacagtgcaagcaggataagtctaggacttagctcaggatgatgctcagggccacatagccagacctcaagctgttttcagtaggaattggtatgaattacagattattatttctttggatgggaagatgtcccaggagcaaaggctagactaagccttcctactgtaattcatttggaatatggtcctgtggtaaaggtgtgggctggggctgggctgctgagtagtctcctcctcttgggcccttgtagaagatgaaggagagcagcattgataacttgatgaagagcctggacaaaaacagcgaccaggagattgacttcaaggagtactctgtgttcctgaccacgctgtgcatggcctacaatgacttcttcctagaggacaacaaatgaccaggacactggcagctcctgatcctgacctctgcagcctctttaactgcccctcctatggcccctgcccttctctttctcccagatggatccttccagcagagaaataaagccttatccattacacgcactggttttaaggtggtttgtctcttggctgaggcaggggagaacagacattttggaccactcagccttgggccacacacaggtggtctgtggatagcaggagctgggctctcatccctctccactggcagtccttcatcatggacattgttggaggtgtcctgactttgttctgcactcctgtaaaataacaaagctgcccagacagcaaagatgcagagaaaacaagagaaaaggccgtgagagctaggaggccagagggatgggctgtggcccagcagtgatggtcccgcaggtctgacttggggatagcccgcaggagaccaccccaggagcccttctcctctcccttccaggaacacccctcccattactcactgaagagtgacttcaggatgctaatccctccccacaccctaccaacttcctcttctcaagactcctccccattaccccccccccccaggagaaaatgttcaaaacttttcacttgagatgagtaactgagaatgctcgctgggcttggctctactatgtgcacattcatgcataagctgctctaaggatgaaaatccaggcagtgagtgggaggaggcgagtgatgttgctagaaatttatggttggtgggggatgctgtttaaaatcttttagactgtgttctttccccatgccccctttgatacaaggctcaaaattctaccttttgggatcaacgtctttagctatatatcaagatttagaccagtggttctcaacctgtgggttgagacccctttcacaggaattgcctaagaccatctgaaaacacagatatacacattaagattcataacagtagcaaaattatagctatgaagtagaaacgagaataactttatgattgggggaccaccacaacttgaagaacagtattaaagggccgcagcattagtcaggttgagtgagaaccatttcttagaggatgtggtagacagactgcttcccctccctcacttggggaccttgccactagagggcaacagcatcagtgtggttcccagtccccctcacactgatgctaactttaaggacactgctctcgggctggcagaaggttcagcacacaagccagagtttcgagtcacgtgccagaagggaaaactaaacacggaattagagaaaacttgatgcctctggcttgcactggtctcctttgggcccgttagggcccgctaaactccctcattccgctcctaatcctggacagtccaggcaacaggggcgtggaaagttgagggggctgggatgttcgtttgccttgcctcaggcgctgggtggggtcggggcgtgccagcactccctgggcggacctcacggatgctggccactataaggccggccagactgcgacacattccatcccctcgaccactcctttggcgcttcgctgtcgacagtgcggtgagctctcgctggggggtccctctagggtctttctgctcctgggcaaggggttaagccacttccttcccccgtcagcctctgctggctcagtgggtggaatgcattgggatccaagttttcggagcccagggaggcagggagagccatgattaggtgggttgtatcaggcaaacccagaggctaatgcatccctatggggcggcaacctgagtctgctcttctggggtgcaggagggtttgccctgggtgtgtcatcgtcccagtgtgtggctatgtcaggaggtgcccaggggcactctccattctcttccttgctcagtcatatgccctagttctcttggaagccctggaggacagtgctcacagatcccaaagccccttccattcttatatccctcacctaagttgccccggctgccacctgtgttggcttgagactgactgcctcaggcaggggggtggtgagagaactctctgctatcagcagcactgactagcccctctgtcaaacagcttcttctagcccagtgatcagtcatggcatgccctctggatcaggccattggccttctcgtggccatcttccacaagtactctggcaaggaaggtgacaagcacaccctgagcaagaaggagctgaaggagttgatccagaaggagctcaccattggctccgtgagtagcccctgtcccggttccccctcctgcctctcatctgagtggcatttaatcacagttcctgatcttacttcctgtggagggatgctcgtatgcctccatgctgccctgtcccctgagggaggagcaggggctgaggagagtaaatcaaggtaaacccaagctgaaggcccatctttggtcccaacgagcacttgtttgagagaggacttccagggaaggggtaaggaatctagggtgttggccaccactgagtgtggacttctccttcttaatgtattagaagctgcaggatgctgaaattgcaaggctgatggatgatctggaccgtaacaaggatcaggaagtaaacttccaggagtatgtcgccttcctgggggccttggctttgatctacaatgaagctctgaaataaaatgggaccgttgagatgacttccgggggcctctctcggtcaaatccagtggtgggtagttatacaataaatatttcgtttttgttatgcctactcatgtgttctggcttcccactgatttccagttgcttcctgccttgctgctggacccaccatccagtggtcttagtcacagttaaactctgggagtagtagctcattggcccaccaggccaggtctgccagctgaccaggaatctttatgggtattagaagaggaggcccctctaggcaaagccactctaaacaaaggctcaatcaagtgaccttcaggagaaagtggcctttagaggcaggtctgcagtagtcccagcagtctcctggcagacacactttggtctgggtgtggtgaaacagggagtactaggtgggccctgacgttgggcaatccaccttttcactgtgtgtttgtgtgttatatgagggaggcgtggggagaggcacatctgaggtgagcagggagggacacaggatgactgagttttccgtagctgcctgtgttccagttggaggtggaggagactgtaggagacggtccctagtgtcaggtatggggtcctttttgttgagctaaggagctggcagctccacgcacatgtgactcacgaggtgctcgcaaacagggcagggctggggtcccgagacatgccagatgcggcatcaggcctttctgtcaatattgacccagcctgtccctgcagaatgactcatggggctacttccctggaacgtagttgaaccctcaatccctatcagagtagatggccaatggagtaactgtctattgtgtacagttaaatcataggtgtgggggaagctgtgtgtgatgtgtctgggtgtcatggagacagcgtttgttgctattcctccagggaaggcctaacccaagttggacaacatcctggccaagccccgaagggcaaagatctggacttcatgtggagaccatagctgttttcacttcttactacccaccccttctccaatccacttaagacgttaaatggtcttcccatgctctgggtggggcaaataaacagcaacagctgtatttcttaaaaacctttcttctccagcagtgtcctggtcttaccacgttgttggacagccagagggtccccgggtgggccacccccattccatgctgttcagtataggctctattcagtggctctggaaaagtacaccacacccagttgttgatactttggggtgtggagggatcgccctcttgtggacagagagcaggttactggtagggaggctgcggttggtggtggtggtggggcgtgtcaagaaggagtggggggtggggggaggagcctggcaggtgggcataggaagaaagtcagttaattttctgagccttgtggaaggagcaccagcggcaccgtggatgggagccaaagcttaagaggtctgggctgtgagagggggttggaattagctattcagggaatgtaagagtcgagccatcgtttagttctcagcaatcaaccctacttcatccgaggtacatctatgataagcaagtcaagggagggaaagttttgttaaagacaggtggaatccagtcccatcctgccctcctctttctgtggttagatggtcagacaatcatctaggctcttggagggcaagggggaatttttttttcttttaggtacagggcctggtggtggaaggagatgcttggtcccttaggaggccggcaggcaggctttgctgtgtatcaggatcacaaggctagagagg

SEQ ID NO: 1154 - DNA, 504 bp, Mus musculus
ccccaaacctctctattcagcacttcctctctcttggtctggtctcaacggttaccatggcaagacccttggaggaggccctggatgtaattgtgtccaccttccacaaatactcaggcaaagagggtgacaagttcaagctgaacaagacagagctcaaggagctactgaccagggagctgcctagcttcctggggaaaaggacagatgaagctgcattccagaaggtgatgagcaacttggacagcaacagggacaatgaagttgacttccaggagtactgtgtcttcctgtcctgcattgccatgatgtgcaatgaattctttgagggctgcccagataaggagccccggaagaagtgaagactcctcagatgaagtgttggggtgtagtttgccagtgggggatcttccctgttggctgtgagcatagtgccttactctggcttcttcgcacatgtgcacagtgctgagcaaattcaataaaaggttttgaaactattag

SEQ ID NO: 1155 - protein, 119 aa, Mus musculus
PNLSIQHFLSLGLVSTVTMARPLEEALDVIVSTFHKYSGKEGDKFKLNKTELKELLTRELPSFLGKRTDEAAFQKVMSNLDSNRDNEVDFQEYCVFLSCIAMMCNEFFEGCPDKEPRKK

SEQ ID NO: 1156 - DNA, 22197 bp, Homo sapiens
tgtccatgttccaggctggaagacagaataaggatgaggtgcaaaatgccttttccacaggagcctttgcctttttattatgatagaagtgccctcccccagagacttccacttacatctttggccttaactgtgtaatttggctagtcttagctgtaaccaagggtttttagctgaccacattgacatcttagaagaaaaaaaatgggtcttaataatgaagaaagaggggatggatagtggaagagtaatgcagagtgttttcctgaattttttttttttttctgagatggagtctcattctgtcgcccaggctggagtgcagtggtgcgatctcggcgcactgcaagctctgcctccagggttcacgccattctcctgcctcagcctcccgagtagctgggactacaggcgcccgccaccatgcccggctaatttttttgtatttttagtagagacggggcttcaccgtgttagccaggatggtctcgatctcctgacctcgtgatccgcccgcctcggcctcccaaagtgctaggattacaggcgtgagcccccatgcctggcctgaactgtttttttacttacttgggaaatcgatctttgagaaccacttccagagtagctcagatagggtccccagagacagaaaaggccaagtgagaaggcgctgggacaattgcttgttctcacttatgattctgccttgactgcacatctggggctggcgaggcaaggcggagcaggccttcaatgatacatggtctcttttcatagcaataaaaagagagaagcccaccttcctaatatcctgtaggaaagggagccagtaactataggtcagggaatcatgatgatggtaattaacatttctgtagcagttctcagagttcctttcatgcacactgtaatttcagcctcatggtaaccccgagaggagctatcattaggccgtttttacagatgaggaaactgagagggagcagcatctgtcatttgtggagcactccctccagctaggcactctgctggtctattcaagtgtcatctcatttaatcctcggggcaactgggtgagagcagagctatgctattagtttctgcacgtcacagacaaggaaacagaggctgggagaggttaaataaggagtagcgtcaggacttgacccatgtcttaagaaaggtcctcatccctgtggacactagggtggcagtccgggccttcctccccttcccacagccatctccaaagcctggggctttgtgtaaggtgaaagggacctggatgagcagcatccagactctcagtgtccctatcctgagtcactgggggaagcaggcccacttgctcctggtggattagtgcagtctggtttcttttgggccttaggctcacaacaattcctggcttctcttggctcaggttctggggctgttttggctggtggagactagcctcagctggctgcccttggagctgggcaggttctgaaagaggctgatttcctttccttctgggcatttgacaaactaacaaacaccactttcccagatggttccggcaatcttcccttatcccctttcctctccccaaatctctgtgcagaggcacagaggaggagagtctagaaatagctctgttcaaaagtttgttgggccagttgtctcccacttcctcctagagctgctgctggaggagagcctcaggaacacatacctcaccctgcatcctgccctactgtcactttggcatttgctgtttcgcattaatccctggcagcctattaaccctccaggaaaggacagaatgaaggcaaagctgggctctgagacaagggactggctgaaatagggcccccatgcccttgtctttaggtcacttgatctctccactgactcactgctctcatctatgaattggtcacaatcagtcaatgacttggcagtcaaaagaagtagtaggtctaagtaataggtccacaggcctctttgatctcagttcagatcctcttcccatctccccaggcccagtccccaattctgtagcaaaggccttcctggctctacaccagtcccagtcatcaaataccccttcctacaccttccctatatttggctcagatgatgagaaaggaagctaatcattttgacaaggttcgttggtcccatggggctatgggattggggtgggttcaccctgtctctggggcccaggcccttttggcacaagcatgtgggatatccagatgctcaggacaatttatcttgttcttccccgaggttcagaaccagacactgaccttcagggaggcggtgcagtttccaagggcgtatggtgatagtggtgatattggggcgacagagccagggagaatgggtgcaggggagagagagtcagtgctataataagtcctgccagatcagatagtgtcagctctcacccttcatgcacccacacgcgttgcccctacggggagagagctccttgccctccaaatatggtgcatttctcagtggtcagctccacatctgcagtgggggcgggggaggcggctctggaaggtgagcagcaagggtcctgggctcagcccgagcatgaacaattgagtgtgtggacactggacggggtgtgggaggaggacggtccctctccaggccttggaggggcggttcatgtgggatgcattcggaaccactgcagaaagggagattcaggggagatgctggggaagaacttccagcagggcagagagtccaatcatcccaagaagagtttgtgaaagcaagggaagggaagttacagctctcccctccacctgcatggaggaggcaggaccaagtgaactgttggggagaggctggttctttccctcccctcccgccctccctgaagccccactgaggtgactcagtgcatgtttgttgaattggactcagaggcctctgccctgacattgtccacagtgacagcgagtgatagaaagcgctttcatgtcggattcttaaagtaggaatcttccaaacccattttggaggtaaggaaattaaggctctaacaaggtaaagaatgtaacatgcttgagggcaggtggcaagaggaaggtagagcctagaggttctttccatgacagtctgccaaccccaaagtcctgtaccttgacaactctgtccccccaccccacccctcaggcctcacctcccagaatgagctcccgccctccccgcagtctcagtctgagtctctcccagtcctctcccagtggacaaaccaaggtgctgcaacccagagaggtctgccaagctgagaaacgccaggggctggcggatgaggacaagggcaaggagccgggctgctgggctcttccctgaccacccatatattaataaagtacgtcgctccctacgatcatcttctttctcccagctctgctttatttttcttcatagcatttatatcagcaatctgttaagcacctattttgttattgtctgttttccccaagagactgtcatctccacagagcagggacttttgttttgtttatggctatacccccaatgcgtctaaatatttatacgaaaaatgaatgcctgctaggcctgccactcactattacgtgaccctgggcaagttacccatctctctctctctttttttttttttgagacagtgtcttgctctgttgcccaggctggagtgcagtggcacgatctcagctcactgcaaccttcgtctcctgggttcaagcgattctcctgcctcagcctcccgagtagctgggattacaggtacgtgccaatatgcccagctaatttttgtatttttagtagagatggggtttcaccatgttgccaggctggtctcgaactcctgacctcaggtgatctgctcgccttggcctcccaaattgctggtattataggcgtgagccactgcgcccggcctcacccatctcttgattaacatttatcaagcccttgccatgtgctgggcactatttactctatgaactttatatgtattagcttatttaaaccccgcacaaacctatgaggtagttactattatcaccctccatcactgacaggtgagtaaaatgaagccccgagagcagaggtaggctgcttaagggaggtggctgggggcagagctgggatatcataggtgggaataattaagctcgacctagagctgaattaattgctggtgcactctggcccccccttctgctgcgtgactgtctcttgttctctgccccctgctccccatacttccattaaaaagcccatataaaacagggctatgtagcccattataaaacagggctaatcacagctcctcttttccttccctcctctattgctcactcccctcctcaacagggctgagtctccaaggagaggacggcacaggcaaggcttgggtgctgggggccgagggcgaggtcgaaggtgtcactggcgctctggctgcctgcacgggcaggaaggcttctttgccggcctgggagtcaatctccttcctcttttccctctcacgctcttctaggttttgggttctcttcctataaaacagggaggagtttctcaggctctggtgtgagggagagaatagagaagttacatgaaagtatgtctgtttctggtaatatggtggtctgtgcccacttcagcttaaaaacaacaacaaatgctgcatagaattaaatcttttcaaagcattgaagagaccacaaggcagtaagaaatgagtaggccaaaatctaagtcaaagcagaatctgtactggggccccccgtgccctgaggtcattggccaagccaagccgaacctgagctttgatcctgatggtttggggagtgaggaagacagaagtggaagcccagttctcaccccaagaggggacacaaatggatgaccctcccatgatgctgagaccccaaaaggctacacactcaagctaaaagccagaggaaatcccatcctgccacccacaagacttcaaggaaagttgttttggtgctgagcagagcaggggaagaaggaaaacagcccttaaggagctccagccactggccagccttcatgtgactctagcccaaattcattcccatcacctggggtggaagggccagaaatctcaagcttagactctggaagtgcccctgggaggaacacacctccttcctgtgcctcaaagacatcccacctgatgatttcccccctgggaagcaagcagttcacagccaaaagctgggatctggtcaggcaagttcagacttctcgtctgtaaaggggaggcttagccacgtgctctccaagttctacccggaatagagatttgtaggggtgcaacctgagcgaggcagaagtgtgtccccacttggtattctgggggcctctgcagagtgaagagatggggctgtgatgtgatggataagccagactgtctcctccaactgagctggaaggacttggcaggagactgtcccctgttcccaactctgggggagggcagatggggaatgaaaggggagtggtgtctgagcccagactggcctttgatgtgtgcgtggataggtgggcaggtggggcctgtaatgggtctgctgagggatccctgagggcatcctcagtgttgacctacttgtgtcccccataattgcttccttcctttcttgggaggctacaaatagtgacgccctgtctctaagctcctacagctgaaacgccagcaccagtggtgagtgccagctgcttgggtcctgccctgggttgagtgtcagggcagtttggggacccccagtagccagcctgactcctgacccagggtctggcattggaagcagagagatgaccacaggcgggcctgacacggggagggaagtcagatatagtggacgcagaggtttccttacacagtgaggggctgttggggaagtttgggcagggaggtgtgtagagctaaggtctgccttggggtgggagcactgggctcaaggctctggtcttccccttgatcaggcccctcacctgctccttgcctccttgcttcacctctgagtctcctcatttctgaggatcatggccctttcctctcctgggaacctggacaccttgctctaatcctggggtgtttacaatgaattaaatcctggcagtgcttggcactccccactccccttcccctactttcctgccagccacaaccatgccagccatttgctcccagcagggggcccagcagtgggcaaatcttcagggagagtcttggccctggccgccctgtgctgcaggactcttgtcccgtgggggaatcaggagtgagtcactgggctagcatggaaaaaactcttgccttcctggctgccttcgggttttcccaggctggaggcatcatcccagaagggcggtggaaggggacagtggaagtggggggaggtgagcaattccaggaagggcttcccctccaatagaacagagtatccctatacagaacctccctgctcaaaacccccaggggtcgggagggtaacctcaggggaggccagtctcagattggtaaacacccgaactggtcaactctcaagagaccatctggttcaggttcctgactgggccagcgaggtgagatgaaccccaacttacagatcaggccccgcccctgagacccagagagacaaatggctcaccaaggttgcacagctggcgacaggcagagaggatcccacaagtttttcttctgggtgcagcttcctcgagttcagggcaggaggcagggtgagggcagtggtggtgaggctgtgggggcgcctctcagacctgcccctccctgctaaggcctagcttctccaagggctgagggcagagaagcacagggccaggctctccttgtgcaagttcctgcagggagggaggcttctagggcatctcatgggctggggcagactgggaccgagccatccctgggtgttggggataagaagaggtggcagataatctgagagtgcttaaggagccccacggtggggtgtgtgggtggtggggtaggatgctgtctctctgaggagtttacagcgatgttggggcaatgagacctctacatggggaaataacaacaggacagcagggggataaattaggaggggctggtgtggtctgggagggctactcagaggagggggagactgcggggcctgaagcctgatggaggttaagatgggtctgggaacagtctctgagaaacacagagggcagaggtgagctggggggctggcctggaactctgctgtgagccacacccttgttctgtgacagtgaggatggccaggcctctggagcaggcggtagctgccatcgtgtgcaccttccaggaatacgcagggcgctgtggggacaaatacaagctctgccaggcggagctcaaggagctgctgcagaaggagctggccacctggaccccggtgagcagtcagagtgtccgtcccctcctcctccggggggaggcactgcctagactctgcaaagagagacctggggacaacaagcatgagcacaggacagcaagggagggggctggattgtgaggagggagtgggagggggagaactgacacagcagaaacctcagcttcctcatctgtaaaatgggatgacaatcatccctgctgccttgcagagctgttgagaggactgagtgagagcaccatgaagaatgcctaacacttggtaggcactcagtagcaaatagtaggtgctcgattaataatctgagaggacagatttgggaggggattgcaacgagtgcattatcagagcagggaggttgaagtcggccctcagaagggtgtagtttggggtggggtgggtccacttgggagaggaaggagggaggtggcgtgtgaggctgttctgccctcctcatcctactcccttacctctcccaacccttcccttgcacagactgagtttcgggaatgtgactacaacaaattcatgagtgttctggacaccaacaaggactgcgaggtggactttgtggagtatgtgcgctcacttgcctgcctctgtctctactgccacgagtacttcaaggactgcccctcagagcccccctgctcccagtagcctctgctccagggggtgcgctggctgtcgggggctgggcatgtctcccacaccccctcctaccctctctcctgtacccctttcaatctggacttgcccaggtcttctgcgatcagttaacccattttacctaggaggcccagagatgtgagggctccttcctcaggatgcccagcgaatgaggggtagagccactctggggcccagcctgcctgccgcacccctgtggcctcccttgtggatgggaggaggcgggatctgctctgaggccctcgaggctcagcagagcgtgcaccaatgagaccacgatgggaaagggcctatttaactcctaataaaaaactggcatcagcttggttttgtttggttcttctctgaggacgcgtctcctgagctctttgctcctctctggccttttccactgcgggaaggcagctgagggcaggggcagggtgctccctgagggaagttgcagaccctgcagaaatgcagtggcctccagggtccagcaggagggcgtggggacaaaacaaggacccctgtcctcccttcctctctctctttctttgggatctttgagagaggactgcctgagtttcccctgggactcagtgctcatggttggaggagggtggggccgtgggtgcagtgggggtgtttgttccctgcctcgggctgtgggagcccagagagcagcactaatgggattagggtgtctgaggtgtttctcccagccaggaaggggtgctctgtatggaggggtaagggaataacttgagctagcccctatccctgaagccgcagccccctgagggccttaaccccctacttctaaccctcactgggtttgtagcccaccctgagaggttgacccgaattataactcccctatttcatgccatttcacctctaactctccaccccaacctggattcttcattcctgacactcatcccaactttaaatggcccctcctgataccctctccgaacctgagatctatccgtgagcccccacgcctcactgccactccactccatcactacctcacccaggacctttcccactgacgttcctgaggtggtcccagagcctcctttgggtgtgagcctgttcccctccagatccccccgccccgaccctgagccttacttggcatggcagacagtaccgggcatggggatccccaccccagtttttgtttctgaatctttatttttttaagagacaaggtcctctgtgttgctcaggctggagagcagtggcttgagcatagccaactgcagtctcgaactcctgggctcaaatgatcctcctgtctcagcttcctgactagctgggactacaggctacagccatgctgcccagctaattaaaaaaaaaaattgtttttcctttttatagagacagaagtctctctatgttgcctaggctggtcttgaactcctggcctcaggcgatcctcccatctcccccctagcttttgtgtcaccacatttccagggcaatctcccacctgtcacccaccaccccctgcatctcctttcctaggtccccatgggactactccctgtcccccatgctccaggcacaggctgccccttcctccacctctctaaaactcaggctgagctatgtacactgggtggtgcccatctcatccagtcccctgctagtaaccgctagggcttacccgttacccacgggtgcccacctgggaacaggaggcttggttccacggctgggctggtggagggtgctgtggcacttaccgcatcagcccacagcaggaaggcagtatccgctctcccctgtcccctgctatgggcagggcctggctggggtataaataggtcagacctctgggccgtccccattcttcccctctctacaaccctctctcctcagcgcttcttctttcttggtttggtgagttgtgttggcctgactggcatgcaaggggtgtcagaggccagggctggggaaggagaaggggaggctggtgggggccagatgtgctaaagagatccagatgtgagattctgatgtggaactctgggtggattgtgtgcgtgggtgtgcatggcacacacacacatgcacgtaagacggaggaaaaaacaaacagaaaagtgagcaagtgactgaatttgagctctccaggtgcttctgagatgtgggcttgcacacgctgttgctatagtacgtgttggtatgtatgtgcctgtgggtatctgcactggctcatgtttgctgggttgcgcactcgggagcaggaagcaaaggaaaggcagaaggcaactgtgggcctttgtctggtggtgtgccccatgagcctctgccctgcacgcagcagcccagctcgagaaggtgcatggcctctgcagcttctcttccaacccttgcctctgccacctcactttgcccctccccatgctgagagctaagcggctgtgctggttttttccactgcaggcccctgggcaggcctccagcagccacacccagttctgggagggaaaagaatggcaagggcggggcctttgtggctgagctgtgggagtggatagactgagtgaggggtggaaaaaatgctgttgttgaggcaaggcctgggaggccctgggagtttgctgcccgaatctccagagcttgcgcagcggatcttgcaaatgttcactgcccagagcatgtgttccccactgtgcacaccctcccagccaggtgcgggggcccactgctctgggctcccccagggagggagcagagtctcgccaagtgctcctggagggatgggagtggagcctggcattctgaacacatctctgaggggtgggattaataagacggtctctgtgcctcctgctcccagatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttgggggtgagtgggtagtgcctgagtgagtccccacgtggggcatttcccacagaggagggcagcagtcttgctctagagcattagctacagagggcatctatcagtggggtggctgcctggggtggaaacacattgaacaccaccactcactgcctggccccatgctgaaagagggctgagaatgaatgggtcagacactgccaggtgctttgcacaacttaactgaagggaagactaagctcagagtgctaagtaacttcccaaggtggtcagtgtacacaactgccatccggaccgggactgtctgactcttgccatcactccaacagtggacactgtttgagtttctatttggcttgtagatgtgaagacacagatgtggagatgatcacaggcctgcagacgttcccttcaaacaataacaatgtatatttgtatcaaacataacacagtttatatattgttttcatgactattactacctcatgggattattagaacaaccttgggtgaaaatgtagtggtcccgtcatttttccattgcaccaggtactcagacttccttatccaaggagcaccttctccaccctagcttagccttgagggttggagttccaaactggacctcccaaaggagcctccctgaactctggtctgggagtagaaactgggtctggtcctggctccacccactgggcttctgttttctatctgtagcctcttctccctccagaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctgatggtttgagagactctgggggcgtgggttggggactgagggatatgttgtggggtggtggtggggagagctgggagttgagctgaagttttatggacagcagaccagtgaagttaggggagggatgcagggtgactaacagtgtgtgtgcacaggcaatagagttcactcggtgtggtcaaagccgagaaggggacccctcaccacccccctgccaaggtttggaaggtcccagctgtgggatctcagccagcccacttacccctcccacctctctccaaccttgcctctggcaggatcttgaaccgaggctggaattgaaggtcatatctgttcctggttggggtctggaatggagtttgggtgtcctgggagtaagtcggagggaaaagaataaggctgagttgcagggaggaagtatttaggcgagagtgggatggggaggagggctggcactcagtgctgacgttgacagtccaggccctgtcctgccacccacttccagatcattggcttcaaaccacagggatggattaatcctttcctgtgcgtggtaggatcagggagggcaatgtggagggagacccgctgtttgcagcagcatgagaatataggcattctcgaatccaccgtctctgccataaaggtccctggatgagatctgttatcagtcaggaatcaagctccttcagagaaggacaggggacctcagaagagatgagtgggggtcagtggctggagtgggagtgaggcaaatggtgggaaggtgaccatagttttggagacaaaattccacatatatgatctgacaaatgaaattgagattattttccccccagaaaatataaggcatgatattgcttccccttaggtaggttcaaggccagtggctccagggtgcagtggtgggttgaggttagacttcaaggccatgtctgggtgactcagggatcttttaggaagaggtgcatggaggtcaggtgcagaggctggagggctttgtcccactgacctcctcttgagggtcctctttcctctcatcacatggggcttttctctcaggtttcagaggagtggggcaggtgactcagatgttcccgcagggtttgaatacagagacttgggaggaatttcagttcaggagaaagtctgctgccttccgctgccctctccatccaccctccctgggagcgccctccctggggcctccacccaggtcacgctctccttcagagatgcctactgcatagcaaccaatccctgctgcctctccaatcttgccagctgggggtggggtggagtggggagcagtggggaggccccccaggctggggtgggactgcagcagtgataggtactacaccctgagcccaggtctgttcttggactggtggtagaagtatgttgttctactgtggtagaacgatgtctgagtgtctcctgggatacaggaaactctccctggcccctacttcctccttgactgcagcctgaacctgaacccccctccccaatccacaacctctaccccagtgctgggccttagcccttcgctggacaccttccctattcctgattctcagtcctccatgccaagagtctccgacgagcctttcctgtgaagagcagtgaggcctagaagaaatcgttcatttaaaagccctttaaaaacctctgggcccatattagctcatgaccttgaccatatccttcgcagaaaatatcttcctccactgatccccatctcaagggctgtcttctctactcctggagtgggtggcaggatgggtgggaggggcccgatgtggagagcttcctaggacacggggagatggtgccctgtgtttgtcccacacttctgaggttttctttccaggacagcctggtttcccttcttcggcttattgttccatcagatttcagattttgagttctgatttttggtcagaagagtaaagtttctgggattggggacgtgtgtgctatgggaactcagtgtgtccccagcccttgtttgtaaacaaggaaggtgagattggcagaaggggtttctccccagctccatcccgggaggctctgacgtgggcatcctcaagtccccaacaacttctcatgggccctttctctcccctggattcctagggacagagatcagggaaataaaggcagaaggcagtgagagggaggctatgcctgctgcttggattctctgggctcactcccacagtggtaagtccttccttcctatgtctctgttcatctgatatctggtgggtcacgctggatgatgagggtgacaagtggtggtgacctccaccaaggaggcctggccccacaagcgggcatgcgctcagggagaagagggcagagcctttggaatttcttgagaaatggctctggggtggaggtgggggtctggactagccaggatgctcctgcaggtgcacagagtcccttgccttcaactgtggtcccagctgagtctccttgaggtgggagaggctgaggtttttgtggtgggagaggaatgatgggtctggttcaagaatggcagggagggctttgggctggaggtgaagactctccacagatttaacctgcagccttcaagttccgtgggtgttgcctccttcctccctgagggggaagtggtttttgagtctgagtcacttgagctccatctgtctcttcccttggctgagggtggctgtgctattggaatccaggcccttattcaagcgtagcctctggatccaggttttggaatgatcctggagatttcaagaggccccctgccctccctgcccgctgacccgtctctgtgtgcactgctctgggccagagtctggagaccagctgggccagctcagctcacctccctgctgctccttgttgagaccccatcacccagttccagcccagccccctctcagccctggactctctctttgccctgtccccgactttaataatgggacactcctcgatatcaggtgattcaggcactgggggaaaggctggtgaactgcctgtggaaaaccagttcctaagctggaagaagcagagagaaaatcgtgacccttgatctgctccaccatctgccaccagggccttttgaggaggtcgtcttctcatctttctgcctcaggcctacttttcaacaactccccagcaggagagtctgtggtctcctttggggtcttgctgttctccttgtaccagcagctccagagtttgttgtgggtctcattgtaacctgtactgatatagatgggcgctcttgttagtggatttcagtctcatcctgggttccagtctcttgttctttgagggaggggcctcagaggtaggctagtgctgctggtggtgacttcctgaggaatgggatcttcccctctccctctacagagctgcacactgtgatggagactcctctggagaaggccctgaccactatggtgaccacgtttcacaaatattcggggagagagggtagcaaactgaccctgagtaggaaggaactcaaggagctgatcaagaaagagctgtgtcttggggaggtaggtgattgttccctcatcctccaccccaaagtctgagtactccctctgggggacacatacctaccctcaggatcctccagcctaagccaggggcagggtggccaagggctacagacagagacaaaggaagatggtggggatttcgggccagcaaaactctagccctctgtgaaggagaatgggtcagggtctcactgagaaggaggaagggctgagtctggagggtttagagaaggagattgaggagccttcgatggtggggccaggctctcccagcagtggcagaacctgtgctaggggtcatgggtggtgaagggatgcagggtgtccaggtccagctgtgtacaactcaagtgtagggactctgcctgattcttctctgtgtgcacagcatggccagggctctctgatggtgctggcactcaaactgaaaggttaacttgtaaacatagggtagtgaggagacagaactggttctcaccagatggaggtggtgggagggaggtgactgacagaggggaaggcccatgaggttattataatacaatatccccgaggataataaataaataaatatatatatatatatatatatatatatattttttttttttttttttttttttgagagagtctcgctctgtcacccaggctggaatgcagtgacatgatcttggctcactgcaacctccgcctctcaggttcaagcgattctcctgcctcagcctcttcagtagctgggattacaggcacgcaccatcacgcccagctaatttttgtatttttagtagagatgggggtttcaccatgttggtcaggctggtctcgaacacctgacctcgtgatccatctgcctcggactcccaaagtgttgggattacaggcgtgagccactgcgcctggccaaggataaatatttttgagacagagtctcactctgtcacccaggttagagtgcagtggtgcgatcatggctcactgtagccttgaactttcaggctcaagtgatcctcttacctcagcctcctgagaagctaggactacaagcaaataccaccacgcttagataatttttaaaattttttgtagagatggggtctcactattttacccaggctgttcttgaactcctggcctcaaatgatcctatcgcctcagcctcccaaagtgctgaaattacaggcatgagccactgtgcctagtcttattatttttatagttaaaaaaaatcaatgctcaaatacatcaaataacttgcctaaggacaatccgctagtgggaggctgagctggagttctgggccaggcctgtgaatcatcctccctgtttcctttaaaatttagcctgggtgcctctccatctatcacaccttgagccctggtaggccctcccagaaagaaggtccacagtgtgccacatgggcaggggacagaagcaggtatgggcgtccccaggcctgatctctggccttctgccaggctgcctgcatcctggaggttaatgagggcagagggaggggccacaggtccagcagggattaattacagaaggagagacgcccagaggagggcctggcaataacaggagcccaggctggggactaggatcacgtgacagacaagcagtttccgcctttgtaagtcccaatgtctcctgtgaaaacctgtagctgacggcaatgatgaggagacatcaggatctgcttgtctatattttcttcctgttccacccaaaggaccctgactccatcgtcctaatggagccaggctgggacatcaggggactgaacaacagtgcacaaccaggctccaggcaggcctcttgcacagctctcctagcaggggagggatgcagtggcttcacagccccagtgcactgctctcattgagagacattttgtccggggttattctcacctagtccttagaatggggagagagtcactcagagacttggataatgctcaatgccacataatcagcaaggtgttctttttttttttttgagaaggagtttcattcttgttgcccaggctggagtgcaatggcatgatcttacttactgcaacctccgcttctcaagttcaagcgattctcctgcctcagccttccaaatagctgggattacagggatgtaccaccatgcctggctaattttgtattttcagtagagacagggtttcaccatgttggtcaggctggtctcgaactcctgatgtcaggtgatccacccgcctcggcctcccaaagtgctaggattacaggtgtgagccaccacacctgacccagcaagctgtttttatcaggtgttggtataaaacctagatgattgtttctttggctgggggacagtattgcagggaaggcaggctaggctagcattcctgctgtcatttatttccattcaggagtcaggtccctgaccccctacctcatgccaggcccttccctaggtgtgggcagtgggcagactctgggggtcgagatgctgacagtgtcattgactcagctggggctcaccctgaagtttcggggtggggatgacaccatgcagtggtgcgagggcagggctgggagcggggtctgagctgtctctccacctgggtccacaaaagatgaaggagagcagcatcgatgacttgatgaagagcctggacaagaacagcgaccaggagatcgacttcaaggagtactcggtgttcctgaccatgctgtgcatggcctacaacgacttctttctagaggacaacaagtgaccagggctgccctccaccctcaccctccaccctttgctgctgacctcggctgctcctctcacagaccctctttggccccctgccctcctctccctcccagatggacccttccatgggaggaaataaagtttccatcgcaggtgctgggagtctggttttgaagctgtcttgtctaccttggcctggggagaggggagcacaggaagggtctctccttgagtgggttgagacagcttctgcctctgggggttagggtcctgggctcccactgcattcctctccttctttggtgtggacgtcattggttttgtcatggcttagttttgcctgcctggaaaatggggaagttaggccaggcgggaactctgcaaggatgcagaggaagttaagagggaaagttgctttgagaggaggacactgggaggggttgggagtggctcctgagggcggtgataggcaggcaggcctgacttgtccacagctcaccggaggccaccttggcagcacctgtaggaagggcatgtctggcctccacaccagccccctccctcttcaccatttccccttcaatagcaccactctcatcatctatgggggacagtgctttcttctctccctgcctcctccatcaaaatcttttctcaggggagggtctgaaaaggccttcactcccccgtaaataacgaatggtgcttacagggctgggctcccacgtgcatgcacattaacaccaaaggtgctgtagtgaatggaatttggggcactgaggggaaggagtggaggtgttggtaggaacttgttgctggtgggggatgggcgccgtagatatcctttacaccactggctactccccctatctcctctggggtgaccctgagtatcctctgtgggacaccggcatcctgtgaggcgccctccttgcccacattgacgctgcgctggctcgagggtcacattcacggtctggcagaggaagcaggggtgaccgccgcagtcctcctcctgctccccttgccgagtcacgtgtcacgaagagcaaactgagcaaactgagctgcgcagatgaggggagactcgtcaccaggcgtgcagtgggcactgctgggctcccccatcccgtcctaacccggaacagccccgggcaggaggcgtggaaagtcgagggggtaaaccgcgaatgtgcgttgtgtaagccacggcgcagggtggggcgcgggcgggacttgggcgggcggggtgggcttggccgagctggcctccggggcaccgaccgctataaggccagtcggactgcgacacagcccatcccctcgaccgctcgcgtcgcatttggccgcctccctaccggtgagttctctccaggagccctgggtactttccagggccagctgccctcacgctgggggtccagccatcccctgcccagttcagccgctggatccagactggggccatctgtggcgctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctctgaaaatgactcattgactcgccaggccagaggacccaccctgacaaggctgcctctagcacataaggtgcctttatgtgaatgaggagagatgcccctcttggcaacgccatcctaaggaaaggctcaagtggtttccagtagagagagtcctgggatgagcttggagatggaaatggtccctgggccgggatgtgatggggtttgggggcctggaagtgaggcagagatagtcccagaggctcccagatgtgttttgctctgggtgtggcaagaggggccctggggtggggcaagtcccctttctcatcacagcgcaggggttagatagggcacatctgagatgcctgaggcttggctcagggagtttcctacaccagtgaggacgctgtgtgactgagtctactgcggctgcccaggtcccaggtggagtgggggaggcacactcttggagtgtgtccctgcattcagggtgagggctttttgttggaacggtggtctgaggagctggcagctgcaccaacacgtgaaccacggggtgttcagtaatggggcggggtatccctgcagcctcagcgtaatgactcacccggcacttccacgggatcccagcctggatctcagcccccatcagagaagatgactaattgaatcattgtccatcatctggattagtgttttcaggcagaagggaagaggataaggagggtaaacgctgtttccgggtgatgccacatcattcagcctctctaggcctagtccgagctgggcaagtttacctctagcttctggggaagagatcttgactttagatggagaccacatccttctttccctctcacctccccacttcccttgggggtccaactttgtggaattaagttgtcttctgtccccact

SEQ ID NO: 1157 - DNA, 615 bp, Homo sapiens
gtgtgcgtgggtgtgcatggcacacacacacatgcacgtaagacggaggaaaaaacaaacagaaaagtgagcaagtgactgaatttgagctctccaggtgcttctgagatgtgggcttgcacacgctgttgctatagtacgtgttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttttgaggctgatg

SEQ ID NO: 1158 - protein, 101 aa, Homo sapiens
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 1159 - DNA, 23686 bp, Mus musculus
  misc_feature (1)...(23686): n = A,T,C or G
agaaattgaagtagctatgtaaaaccaatcaacgaaacagaagggaaggcaggcaatgtgggagacacctcaccttttgttttcagtgctgggaacagaacccagagccttgtgcacactaaacacactgtcttcccttgggctacacttcagtcctataagaaaagtttttaatactcttgcttccctaacagccgtacctcactgctggcccctatctgacctgcttccaaactgcctctgctcatgtgtgtgtgtgtgtgtgtgtatgtgtgtgtgtgtgtgtgtgtgtatatgtgtgtgtgtatgtgtgtgtgtgttttcatgtgaccttatctacaactttctattcagcctgcctcaggaaacttccacatcttccagtctcccaacataattattttgtttgtttgttcatttgtttgttttgaggcagggtttctttatgtagctctgtctgtctgtctgtctgtctgtctgtctgtcttgttatgtagaccagattagcctagaattcacagagatcctcctgcctctgcctcctgtgtgttgggattaaagatgtgtatcagccactatactctgctccaacattagtcttttcaagatcaactaacactactggagttcccaaccttgacttatcagctgcatttgatgaaatgctctctcccctgcctagaatcatttttacacattctttcaaccacttctaaatatttaagtgccctaatgcttactgcttgggttttttaacccctctcactccatcctatagcttcttaaataaaaaaaaaatgcagggtatcacttgcttagggtagccttgaacttgcagtgtaactgaagatggatgggaatgatcttgacctactgatcttcttgtcttcagctcctaaatgctgggatcacaggcatcaccactatatccagctagccctacagtgttaacgtcacctatgtgcttaaattgtcaaagtcacactgccaacatagatctctttctcccttggattcaaccaagtacctatttaaacttccacctggatgtccatagacatctcaaatttaacatttaaaaatgttttacaggggctggagagataactcagcggttaagagcactgactgctcttctggaggtcctgagttcaaatccctgcaatcacatggtggctgacaaccatctgtaatgagatcggatgccttctcctggtgtgtctgatacagggcttacgtataataaataaattttaaaaatgttgtacatttgacacaatccccctatgtctgtctccccaatactaggattccaagtgtacactaatatatgtggcttaaacccaatatgcttaaagcaaaatttgttccttcttcagtacactccatcctagcaaatggtttccttcgtggtttaggccaaacccttcgtccttatggtctcctcgctctcagacacagatatcgaagaaccccagcaactttccctgtctcttcatgtacactggtaccaccctggcctgagacttcatacctagagtattatacagtctgccaactggtgcccctacttcttgctcttttaagggcttctcactgaacagtcaaagccattcaagttggccaaagtcagatcaaaactctgctcaaagacaacctactggaattggaacgaagctgagtctttaccatggtttataaactgtacaccatccaagcccctgtgttcctctctgatccatctaccacccagccccgatcactatgggatccctactggattactgctcacatgttgtccctcaaccatctcgaggacattctgaacctttgagacttgagatttgctgtttcctctgcctggaacacaggaacttacatagtctatcgcctcccccattcaggtctccacacacatgccactgtatcgaagaattctttcctgctgatgcagcatgggccttcctctctctctctctctctctctctctctctctctctctctctctctccctccctccctccctccttccctccctttctccctccctctttctctcccctgtctttttgtcgtttttggcactcacaacaacatgacatattacgcttatttatttgtgtattgtgcgccttccacacttgagtgtaagcaccattccatgacagcagggactttggttacttttgttctccgctgtgtccccagagagtctggcatctgctaagggctcattaaaaatttaatgaataaagaaatgaacaaataatcgtgtgaatgattattcagagagactgatcagagacagaaagcagggagtccctgggctcttgttgttgtttttaatttgggtgtacctttgaataaactgaagattgaggttagaatcatgggatgttttctccatgttttcacagtgtgaagaagaaaatggacttgaggaaggtgggcctgtggcaaggatgctcactatttctaatttcacctttcacacatgaaaagtcagctacattcatgctttggaagaacttgtggttttatatttattcccagccataggacactggccaggctgctcacctcgcctttctttactacattttccttgacagtgttttttcctgtatgcaaaaatggccagcttttttgaaaccctggccttaccttatttgagtcatattttagatttatttttgtatttatttaatcttatgtgggcaattcctttgccttcatatatgtattgcactacacttatgtctgctgcctgcagaggtaagaagaaggcaaaggagtgcttgaagctagatttacaggtggccgtgagcggttctgtggttgttaggaattgaacctggtcctctgtgagagcatcaagcgctcttaaccactgagatacctctccagcctcctttgttttgtttttgaggcagagtctcactttgtaatcccaagctggcctgaaactcactatgtagcccaggctgggctcaaacttgtgggcttctgcttcaaacccccccccccatcatgctgtgctaacttcttcttaaatctagttttcttccacagagtcaactttctctaaggatctgaatcttatcttaccccagaactttaaaaaaaaaaaatcatttgtgtgtgcacgtatgttgtgtgtgggcacatatgccaagatgtatgtatggcggtcagagggcagctccgtgacattggttctgtctttccacctttgtgtgagttttagagatttgaactcattctatctggcttgtaaggcaagcacttctacttcttgagcttctacctcccacctccagaaccttctgattagttctctgttaattaagcccaagtggccttgtggaatgcaatgtgcaaagccaccaagtctttgcacctcctgaaataaaactcttcggtcccctccagaagatgagtaccctagtctgagaccctttggaacacttagtcctctcggagtttcatctgcatgagatggccatggtgtctgcatcaacaccatggccatcacaggctcagtggcaataaagccagaggatgctgcagcagactcagaaagtactgtattaatcatggtcggccagttccacaaacgggaacccctaacacggtcatttggaacaaaagaggagtaactgttgtgttaacgtctgactttgtctctgaaaccagctgcagggagttggatgctcaatagctgcaggagtcaggcctacaatgccatgctctctcttctctgaccatgttcacatgttccttcttcttctcttctgaccctctgaagatagactctatcggcatctccatcacacgttggctgaagaagtgttcttaaacgggtacttctcatcccaagtccacattgccttactagtctttaactcaccgagatctgttgtctgagtgttcagcagcctcccaaattacctacccaggtagtctttccaggctcgccacacccaacctttacttttgctgtcagactccacttcctaagacaaagatcccattgtccaagacagtttggggcccttaacagttacttccctgtgcagagccaaggctggagtcatcagaaagcaagtgcaaccacgcccctgaggttcaggggatcatgccaggctgtttccaactctactccaaatcttcctcctttgtcttatggcctttctgcctcctacccagcactgcctcccagttccctttggatcgattcgacagtgggacgaagtctgcccagtgtttcagtgacctccatccttaaacagtttcttagatgaccctcggtttccaccgctggacatcactctgtctgatcagttcaaagctctggacactgacacaggtccaggcccaggcctgcttgcttgcattctggagacaagtttggacagaggttctttctgcctctcttttatagcccatgaccgtctgacctcatctgagaccaccttccctcctgatatatgctcataattttatcagcattttcttttattcttgattgagcggggggggggggggggtgtttcccgagacagggtttctctgtgtagccctggctgtcctggaactcactctgtagaccaggctggcctcgaactcagaaatctgcctgcctctgcctcccaagtgctgggattaaagaaaggcgtgtgccaccactgcccggctatattcttgaattttttttaaaaagatctattatgtatacagtattctgcctgcatttatgcctgcagcccagaagaggacaccaggtgtccttatagatggtggcttcccatctctagttcttgtgtgtgtggctgtctgccagtcaagtgtatatgctccccacaggcaagagctgagatttagtcatctcttaatcccccacgctgctgaaacaaatgcactgggaattttcgcccacggtaaggtcagatccttctgctacttcaccctcctggtgtcctggtctttccttacctcttgctgtgaacagctgcattctgaggcccgcccggtccagtgtgagttgatgctcctgtggatactctccccttcctttgccttgtccacaggtgtcctttgactgcatcaggcaagctcccacccagagctttcgcactccctcttgtagttactgggccacactctcttctcacagacttggcatgcctgttttctcaagccctcaggcctctgtggaaagccactttccctggccacagtgtagccctttcatcactttccagttttccattgttgctcttccagagtgtctccccttcatactcaccttgtgttacttagtgtttatcttctgtccctccccttctcttactacaatgaaaactgcaacttaatttccatccccagtacccaggataaagcctcctttattggcgatgccaatacatacggaaaagggcagcaaacaagctatgtggtcatatcaacctataacccaaaggctgaggcaggaggattgcagcacattcaagaccaccttggattacacacgaaacgcttcaaagcaacaacaacaacaacaacaacaaaacccaaccaaagaaaaccaaaacaactccccacagaaagaaacaagtaaacggagagaaacactgcagttggtagggaggcccacctcccataatcctagcattcaaaggggaagagaggcaggcacagaggctgaggcagaaaggaggcctgctaaggcagccgaagctacagggtgagtttcaggaaccgggctggggtgaggagggggtaggggtgggcgggcgggacactaggacaaggaaagcaagcgagcaaaaaaacaaaaacaaacaaacaaacaaacaaaaaaaaaccaaaaccaaaaccccccagcacgttaactcgaaggagcacagtaaatatttattaagttgaattaaaagtgtcagaaacagggcacgccttccccggctctaagaataaggcagttgaagagattgggggtatggagtgaaagttgtcgtcttgtatgggtttgcggtgggaggggtgggagggcagcgagactgctcttcagacacagttggggctcataattgccctaggagaggatcgcacctgggagccgggctgctgggagccacttgcctgccaccccgttgggacacttatcttccacgcaggtgttcttaattgttttggtcttcgcttctatctaaactcaaagtctcagcgctcgggggaaggggtggaggtggagggtgttgcatgagtgacacttctcagagctatgtaagaaagcacccggagtggaaaagatgaccaaactttacaaaggactaggggggtcttggaaaagcaaactttgatgaagggcagtgtgttgtgggactttattcttctgcccgtgagaaaattttctccctggtttccttttccgcaagtccttaaactttctacaagggactgtgctctgatctccgcctccttcttcacaactccatagtattttttttctttttctttttcctttttttacgcatcgctgctactacagtaggcgcctgccttcttggtatttgccttccgatcttgggtgccttgattgtaaacaaaacactttagatccgtagtgaggtcggctaagctcagcctttctgctggcagccagacttcttaaggtggagcggccaggactgctatacatgtgagattaacagatcaacaaaatggtgctcctgcacaaggctgagagactccggcggtgcagggacagaagtgttaactttctgctttcatacagacattatcgtgatgaataaaaaaaaccttctgaagtggattgtaatttctctatttttacataagagctatagttcacacagaaagaggcagaggagctccttgctgcctagtgattgtcttttagtttaatatttgagacacggtcttacatagctcaggatggctgtgaactctctgtgtagttgagaaggactttgaattcctttacctctacagtgatgacatctctagcaatttaaaatgtttatggtgctggtgtcaaggctgggcatataccgtagacataaggctcaccccattttactgtgttttcttcccaagttcagtaaactaagtaggtatgttagatatggggggaggggcaacagctgggagactggtgagtgggttcaatgggtcagacacctgccatacaagccggacaacctgagttcagcctgcaggacccatgtaaggtgtgtgtgggggacctgattcaacatagtcttctgacctgagcacacatgcatgccatgacgagtttgtccacatatgtgcatatcatgcacaacattgcaataatattttttcaattatagtgtgtgtatatatgtatgtaggtaggtaggtcagaggtcatagtacacctaccaagaggagtcaactcgctctctatcatatggattccgaaaactgacctcagcatgtcaggcattttggcaagcacctttacctgctgagccatctcttagcccaaatctacaaaaaccaagacaacctgaacacagtggggtggacccatagtcccagtgactgaattttgtttttagatacagaatctcctgtaacacagtctggccaccaactcagctatgcagtcaagaatgacaaattcctgatcctcttgtcttgctgagcatcctagctactgaagctgaggcagagcccaggagttcaaggccagcctgaccaacacagtgcaaaaccacagcaaacaaagcaccccagaagaggcaactccccaccttggtcccaactgaacagtgcagaaggcctggatttgaagtccacgcctggatgctgccttctttcctactcaatgagccccacccatctttttggaatctgtatttcagctgaactagtagatagtgataccaaaggcttgtgacagctgcacttgatgatcaaggagacatctgtgggcatccaaggcctggaaagagaccttttggatccttgtaagagagtagagtctgcagactgcaacccatccaaatccagacaaaatcaggaacactgagaccaccagaagaaaacagacaaaacccaaaccagccgagaatgaggagactctgccaccaactgaatagaagtccccagacaggaaacctgagtatcaatttcctcattggtaaaaagaggctaaacctatctaagaactttctggactgttacattttgaatgcaggaggcaaggcacacacacacacacacacacacacacacatcctggcaaagatgtggctaagaaaacaagtcaatattcagtctcacctacaccagaggaagataggaaaaccatgcttctttgggacactaaaccagaaatttaatttcctgtaacatgttttgtgtttagcgcaaaccaagactgtttgggaatactagtgggcaaagcccttaaaatctcactgaactctgagatacgacaggcctggctattctgttttaacttctgtcactgtgctcagcagtgatagagaaatgtgaagttgcccaaggcagctgaaaaaaacccacccaacattactagatgttggtaataccgtggtggtggtattataaatcacttgcaaatctagtcttagatccttaaggaaagtgttttcgccctttaacaacctgcagctctctaaaagtatttgcttgtatttgaatattgtactgagtaggttggaagcaacaggctggtgggagaaaaaagagaaggaaggcactgttgtagttggcgtctggactcaggtggagggaccggcttcgcccgggaaagaacataagggtataaaggcgagttcccacacgctatagcaatggctttcactgtgcttaggaaccaagaaaatcagaactggctttttcaaaatttagtgtctgggacggctctaaagagaggcttgggagagcactgggggttttcaatctcgagatcctacggtggaagcgcttggattcagaaacaccctgataagagcggtcagtcctggcttctttttgaaaccgcctcctggcctgtcctacatagcagagacttctggggtcaggctaagcggccgattccgcaccccagctaaggcaccctgccgggtgggggtgggtgggctgccccaggccctgagccaaggtttcctgaatctttcgcataccctcctccattcccacctcggcgaatgcaggtgggctgaactagccaccgaagctcctaataagccgccagcgacctcggagcccactggtccaggccctaggtttcgcgggcaaagacctggaggtcgcagtcgggagcggtgacgcgcctgccagcgcagctctgcagcgccgggacctagatccccgggtccctgcctggccgccgcgctggcccctccccagctctccggccgtttggctagtttgtttgtcttatttttaatttctccggggccagccagagcaggtttgttggcagtcgtacacctccgagtagtcacgcgaccagccaatgtcctggcggcgctacggggaggcggcgcgctcgggagcgcggagaggcggcggcgccgcgccccgggccaccttaagagcgcgctcgccagcctgggcggagcggctcccggcgccgagaccaatggagctcctcctctgtttaaatagacttgcagtgtcaatcatcttcttcttcgtcagcctcccttccaccgccatattgggcaactaaaaaagaaggggggctcgtgcttttggggtgtttttcccccctcatcccttgtcccgactcactcgcggctccgagactcgcgcggcggcaaggtttggagaggggctgcgttcgcgggacacacgggctcgccccagcctacgctccgactgtttgccacctcctcctgcctcctcccctcccttccccgccctccagtacacttgatcactgaagcctcgagctgcgcggcggctggggtgtccctgcgcctctcttccccagacctgcgcgctactgcggctcgggcggtcgctcgcctggctctgctccatttgactgtctgtgtgcagtcgcagaacttcgaagagggttttgcgctccatccgtggcgtttcgcttttgttcggttttgttgtttatttcatttttttttttccggagagaggcgaggcggtggtccacacccgcccgaggaggaagatgtcaaacgtgagagtgtctaacgggagcccgagcctggagcggatggacgccagacaagcggatcaccccaagccttccgcctgcagaaatctcttcggcccggtcaatcatgaagaactaacccgggacttggagaagcactgccgggatatggaagaagcgagtcagcgcaagtggaatttcgactttcagaatcataagcccctggagggcagatacgaatggcaggaggtggagaggggcagcttgcccgagttctactacaggcccccgcgcccccccaagagcgcctgcaaggtgctggcgcaggagagccaggatgtcagcgggagccgccaggcggtgcctttaattgggtctcaggcaaactctgaggaccggcatttggtggaccaaatgcctgactcgtcagacaatcaggctgggttagcggagcagtgtccagggatgaggaagcgacctgctgcagaaggtagtgactctttggaaaacttaaaatgtctgtctgtctgtctgtctccgtaagcgcccctttactagaccctgttcacttgctttctccagcgtgttctgctttagctctgggaaatcgaacttgtttgaagcttaggtttgacataccccctatccgactgcttgccctgtttatgattttgaagtcagaagccggagatagtaagatgtgataacttccctagccgaacgcatcacagttcctcccctctagccagctgtagatacgtgacaaaagttcggatgtttaccaactgcctcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgtggggtgtagaatactccttgtgttagtgggaacaaccttattttgtgtccttagatgctaccggggatgacgggtccaggggtcgtgggtggaggtagtgagtgggttgttcatcccttgggcctacttctgtcagccattgttgtcgataataaagatggtttgtgtgtgttctcttaaaaatttccccttgcccccctcttagattcttcttcgcaaaacaaaagggccaacagaacagaagaaaatgtttcagacggttccccgaacgctggcactgtggagcagacgcccaagaagcccggccttcgacgccagacgtaaacagctccggtgggttaatgaggaagaacacaaaactgacaccccatctgggctgcgctccccggggggcctgcagaccccaggactgctggcagattagttgcctgccaggaggaattactttccttgatcaaaaaaattaacactggggaaggctggaatcacttgaggggactataatgcagtatttgcaccccaagatatttaccttaaagtggaatcagaatgaggttcccaagcaagaacttgccaccaaggccccaaaggatagggacggtcgtatccttatgaatcccactaaaacttaggctgggaatgacagttttcctttccagtctcagttcatgagaacccatttcccagaggttcgttttgagccaatagcctattttgaaccatttgaactgtagaaaaatggcaaatatatacttacatgtatgttcttaagagaaaaactaggtacccatagtgcacatttgattacgagtgtgaatagagctgccgtggctcgagttctttttatcttttgcttttgttttggtttttggttttttgagatagggtttctctgtgtaacaaacagctcgggctattctgggaattgctctgtagaccacgctggcttcgaactcacagagatctgtattgtctctgcctcctgagtgctgagattagaggttgtgtgccatcacctctgggtacttttttatttttattttattttttaaagttgtgccttgtatgctggtaaattttggagagtgagaaaggaacttcatacttaaaaaaaaattagaatggaaagttcagaagtactaatgctcccacagaattgattttaaccctgaggttacaaagcagaagttaaatgaacagctagaggaagcagccttcccacacgtcagcaccgtatgctaatttgctggaacagaccggtttggatgtttataggggaaatggatagtagatgttaggaccaactgagaaggtccaacacaagtgtggatttttccatgtgtcaaaaatctcatcaccccacttgcctaattagagtaacccagcccctaaatttacatagattgactattcatatgctctaactacttataatagtttataagctccttatgaagaaaaccagcattctctatttctaaagcccacttataacccagcatacaaatagatcttaacagtttattattaacttttcaggtcctcatttattgaaatttaaaaataaatgaaggaatatagagatggcacagggttccagcttgttgtgtttataaatcataaagtcatgatataccttctacagacatagcattttttcagagatggaaaatggccattagagtcactttccgtattataccctctataaagttgtcgaattggatgggagttctttctaactagccatcacacctgtagctttagttgctttgtgtggcttctggcctagcttttcagatgagccgcctggatttttacctggcctgttctgataaagaggcatttattagccaagcaaccataagactctagtcaaaagcactagtgcagatatgctgcatatgagtaagaaattgcaattttgtaaacattcctcgacttggtggggaggaataattttataattgcatttccaggtatttttcaagattacgaaaatatgctactctgaagtgttatggttcctgaatttcttttctttctcaccctctttgacccagattttatagagcgagtttctcaacctctgcacagttgacattttgagccaaattattctttgttgtggtaggcagtcctgtgcattttagaatgtttggcattatctctggcctcccccacaagatgccagtagcaatcttcttcccgaagctgtgacaatcagaaatgtctcttagacatttccaaatgtcccctggggcatgggagggtttcacaaaattgcccacttgttaaggaccctgactctaataccacacaaaacagaacaaaaatccagcaaagataggatcggagatacctgcagtcttcagacctttagtgcctgtatttatccatcattactgaagtatttgttaactaagctagcaacaaaataatttctgtactttggcaatgttactctagtgtcttctccctaattcttttgtttcttttgcagaattaagaatatttccttgtttattagatacatcactgctttatgaagcaaggaagatatacatgaaaaaatttaaatacatatcgctgactccattgaatggacatcctgtataagcactgagaaagcaaaaacaataacactaaaattttaggcactcttaaaccatctgcctctaaaagcattggatgtagcattgcgcaattaggttgttccttatttgctttgttgtactacctgtgtatatagtttttatcttttactctgtagcacataaacgttagggatgggagggcagggtggggctgaggagtcagcatgggggtgaagaacttgcttcaatttgtagcaaggagaaaaatatttgacttgcataaagagaagcaacctgggtgggggtgggggggggaagggtttgaattcctttctttaaagatgtagtgtccctttcggtaagaatggatcctttatttttaaaataatcaaaatttgaataattgctacacatggttgctatttatttctacatgaagcttattctcacttggaggttctgaagattctgttatagagcaagaaatggcttaattttttttttaaattggaatttaccagtttattgtttagcagtaattaccccaggtaacactgggcaaaaatctggggtgcataatagggaattctgaattcttagatttgattatcccagatcatttttgctaagaaaaattcttatttctttttttcacagtgaacataatcctaaatccttggatatttttagaagtctgtaactttacacaaataatgaaataatttttaattcaaagtttctcaccctacttgttaatttgcccccaaggaaagttgtttttttttttttttttttttaaggaaaaaaggacacttgtagagtaagtgaaatggatactacatctttaaacagcgtttcttcattgcctgtgtatgagaaaaacttggaagtgtgcctgtgtatataactctgtaaagacactgaaaattatactaacttatttatgttaaaaagagattttttttttaatctagacaatatacaagccaaagtggcatgttttgtgcatttgtaaatgctgtattggatagactaggccccccccccccgcctttgttaaatagtatggctgggcttaaaaggttgcatactgagccaagtataatttttgtaatgtgtgaaaaagatgccaattattgttacacatcaagcaatcaataaagaaaacttccgtagttatttattgagtgcaactgtcctgtgctttactgagcctgagctagtcagcctggcatgccccagatacaatgggaaggcaaacatctacatttaggcctacatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatcacacatctgcagtactgaaaatgaaagtgatggaacgacttttctagattttctatttacacttttgaagtggcaatgaaaatcaatgtccttacttcccaccctaccagccctgtccacagtagcccaacacacaaatccttaagaaccaagttttttccatactcgtaggttaaatgaaattggtcatacataaattcttcaaattttgaatatttatattatagttaaattcatccgaaaaataagttaaaatactaaaacagagtcttgtgtcttcatatctgctcagcagagatgcataatttttttttttttttttacttaaaaaaatacagaaatggagcatttttaaagccaggttgatcagaaataattctctaaataacactcttattttaaaaatgtggttaaggtagaaagtaaattataagaaattttatgggtaaattgtgaaaaatccaaatttgggtttaaattattcactgaaatactaccatttatatcaccatacccaaaggggattataaacaaggtagttctagcattttttactagggtttttatttgttcttttgttttctttctttttttaaaataaagcaagagttggtttttcttcctgtgcgggatgggaaaatggatcttttggtcgctgggccaagtccttcaagtaggtattattttaattaaagactaaaggtgtttttgtggttctgtttaaaacataatataaagggtggcttgcaggaggaccaagagtcagaaagtcaatccaagttgggaaaacaccaacacctctgttgctgcacaaacctcattttcctttcatagcttttttttttttttttttttttttaatacgaattttgagagattgcattttaggaatggtggaccgggaagaggtggatgctctctgcgccaggcacgtccacaggaacgcatcccccccgcccaagtcactgtgccctccatcctccgaacgcctgtgtcaagcctccacatacaatctggtggttcaaatggtccttttcccggaacctggactcctgcgcccgccgcgaacgtccctttgcgggtttgcggccgccggcgtcagctacccgctaccccactaccctggtcacggcccggtagtctccccaactgtcccgcagccccgatcccgcccgctcactgtggcaactgctggtcgggctggctggcgcctcaagaccaaaagtctttaatgtcgccggctacttgcaagtcccgcactgccagggtggctgcgcgcagttcccgcgccccgggcgcccgcaggccgcaaaaaagcggccgcgcctctatccgcgcagccgggctgggttacttcttagaaacctttcttcctcaccatcgatcctccagacgaagaaaatcactatggaaggcccacgacccttcccagaggacaccccgccgctcactgagttctgggggacttgcccgaagggaccaatttcccggagttcgtggaccctccagggcagcagcccgctcccacccctaccgcagggctccaatgatccgcagccccgcggatttcgaaagccttcccggctcgctggcggctaagcgaccgtcaccaaagcgcgcctaactgtggagaaccactgccgctttcggggatcagccctgcccttcaccctgcttgcaaagtgccccccacctttgcatccttggctgtccagaaccgcagacctgggcaaggaagaactgggggaaataaggatttggggagtgggctgtgatgggttagattgggggactatggacattcactagtgggagggagcaagcagtcggcctttcaagccactgtgtgcccaccaccctggctgcaccgagcgacctttcctgggagccagagaactgccttcgccattacaccatcatcaccagaaaacacgattgctcgtctagcgctttgaactaaaaggtgttttgtttagaagtccacttaggatccctgatctgtttttcagagcatggattctttttcatttgccatctttcacctgagccacaccctactcctgcccccccccccctttcctggctttaaaaaataataaaattaaagcaaaaaagaaaccttgcaaacgacactgaggggtaaaaaggccatggatcctacttagaaacctatggggtcgtctccctgatttcactcgcgtggggttgtaatagggtggggtcagccacaggcggatcccggagaaccgaaagtgcacttatttccacgtacactcaagtctcaagtccctcgggcctccatccaagtcacagacttatcatgcataaggactcagcagaggtaggaaccagaaattaggaaatcttaaaaaataaaacaaaagaaaaaccccttatccatgctttgggcgcgaaacctcgacgcgcctctaaaaggaacgttaagaaaaaggccgggagaagggcgcgcggttcgggcgccggccgggggattgcatcatttgcggctccccctccagaacccggactgagaaccgcagccaccatcatggcgctcgggtcgggacgcgggaagcgcgtccaggccgcggccagcgagcttagaagcgtttgcaaacttgttacttggcggcggagcgccggtctctggccccctccttccctttgtgtgcgtgtgcatgtgcgtgcgtacgtgtgtttgcgtgtgcgcgtgtgtgatgtgtgcatacgaagcgagaagttgaagtttctccctctggccttccccaaacccccccctccctcgtcccgagctggtggttgtaaacttgattggcattggctgcgcccactgacccctgcaccgagtccactgaagatttaaggtggatctgcgaggctgcagctgcaggcggagcctcgcgcttaactgagttttggaagaaaaaaaaaaaaaagcctaaaccgtgcgcctgctgcgttttacgaatccttcggtccacaggtccgcgggtccccgcccagcccgccgcgcttcccccgcccaccttcccctgcttccccattggctcgcgcctgcagtttgaattttttcttttggatgcttgttttcttgttaaaaaaaaaaattaccgtacggtagatcatgtgatgagacttagttggggagtctgaggtggggtgttttagctggtttgattgcaggtagtagggagtaggatgggtggagctttctgttccaaaagttgccccccccccgccccgcccgcaagtgccgttgacagaatgcaggcgggaagcttcagtttgggtagagatgtagcatcaaacattcacggatgtccagggagcacgggcacacaggctgctggccagaggtactaggaaggtacaggcgggagttcgacgaggacgcaccttcccctgtcttggaaaggtagacttggggagggcgggagcgggtaggtatcctagaaatgaatattacccgtcataggaataaaccaaccaaatacaaggtgtggctatagactctatatagagcaaaagaggtgttatttctgtggttagagtgtcaaaatccatcaggacaaaggcactcggtgtcattttcttcctttttaaccttaaagggggggggggggggggacctgtctgttttccaggttttggttccccaccccccccttgtgaggatgagnnnnnnnnnnnnnnnnnnnnatgagaaggggacataaagtccccttttgatttctgggtcaggaaactcattggaaagagtttgttaagatctaggaggattcaattagtagaacaggtctaatacaagtgatggcttttattaattaggatccaactatgtttttctttgcagtgaagcttttaaaacgtcataataattaaacagtagtcctagatcagtctttctctttatcagggacatctcatatgtatacctttcttcgcctttgccttttttttttcttccctttttctttccttaaaataatttctcctgatatctcctttcagtctgttttagccagaagcccagccttagcctccattggcccctgaaccagtatgccatgttcttagttttttagctgtctagttctgaccttacctctcccagtccactaagctccttgaccccgtccataaaccaacatgtttgagctgctctccaggctgtattcgtggactccgttagaggctcagtgcttacctctgcctttcagaggacacatccgatcagaatgagcagtccatgaggaaaaccacatccctggaaggaggaagctagtctcagaaacaggtcttcatcttgagtgtgagccaagcagggatttggatggtccccggacaggggtgtcatagataaagattcagatagcacgtgactgtgaaaacaggcttggaaacttgggcttggcatggtggagcacacctgtaatctgagcacttgggagctggaggcaggaggatcaggagttcaaggcctgcttaggatactgagagactttgcagtcagcctgggctgcatataaccctccctacctcgaataaaccaacaagcgtacaaacaaaggaggtcataaataaaaccccactggacatggtggtgtacagctttaatcccagtactcgtgaggcagaggcagatggatctctatgagtcctaggtcaaaaataaatgcattactactaataatggctcccctccctccttctccctccctctacttcttgctggtcttgaacttgatgtgtctgacgtaatctcttaaccagatgggactgtaggcacgtgctactgtatccaccctaacttttcatactaaagtgaagcctttacatttaggctctggaacagctaaatagaaatctatggacatctaggtcttgggggtggggagggggaggttaagtgttttccgtgtgagcatgacgacccgggtttggattcccggaacttatataaaaagccagcaatggcagcgcacgtttttaatcccagggctggtgagtggagagagaaaaagtagattcctggattctagtggccagccattctaactaaaaaatggagggccataagagatgccagtgaggacccccgcctccacataggtacaccccatgcatgacacatgcgtgcacacaaaagaaatctactagctaaggtaacctttaactaggtgggagccaaataattggggtatgtactgctgacggtggtcccagacacagaacagagcagaaaaagttctgcatattgaaatatcatagcactgtgcactgtccacacgtttgcggcgttcctggcgcagacaagccaagggtgctgtcaactgtgtaagagtacagccatccaattatgtacaatactcgataataataaattaactctaaaagagttcttttctggtctctgatccttcagagtcatcaaaggagagagcaattctatgcatgtcactgcccctaacttttaccttccggggaagacaggatacaaggtagatgtcgttgtactgtttttgttttccactgcctggctagaagccagagccttgtgcatggtaggtgagcatactaaaattgagtgaatcttaggctagccttgaatataaggtgtaactacacctacaacttcaagtagtcttccttcttctgccatccctccccccaggagcttgaattacagttgtacaccaccacacctggctcaggtaataatcagctagatcccactaggctaatacataggtttggaactttgttttgaacagtaacaaaaattattttttaaagtaaataacacagaagggatggggctatagctcagttgggagagtgcttgcctagcatgaacaggccccagttgtgatccccatctctacaaaaacctggtgcatgcctataatcccagtactcagaaggcagaggcagaggcagaggcagaggcagaggcagaggcagaggcagaggcagaggcagaggcagaggcagaggcagaggcagaggaggcagaggcagaggaggcagaggcagaggaggcagaggcagaggaggcagaggcagaggaggcagaggcagaggaggcagaggcagaggaggcagaggcagaggaggcagaggcagaggaggcagaggcagaggaggcagaggcagaggaggcagaggcagaggacagaggcagaggcagaggcagaggcagaggcagaggcagaggcagaggcagaggcagaggcagaggcagaggcagaggcaggaggatcagaaattcaaggtcatcttcagctacacagcaaactaagaggccagactgtcctataggagactatcccaaaacgaaacaaaacagtaaccaaacaacaaacaaaaaaatgatctcacagattaagcccataaggaaaataatttaaaaatatttgtacaatgtgttttaagttagatgttattacaagtgttttttttgtctttgttttgctttgttttaaaggcaagcatagtttgcatgccggtaatcctagcactagaagtactaggtgaagctaaatgccattcttggctgcacagtaagtgtgagggcagcctgggttacgtagcaaaaataaaaaagtaaaaaaaacaaaaaaacaaaaaaaccaatgttatattaaaaaaaaactcagtatattgtagaaattaatttattatctaagaaaaaaaattgtttaaaatagatgatgtttggcccagttggccactgtagaaagtccacagtgatgtgtggcactggtctccacatattcctttctgttactcattgattaccccagggcaactctcagacatgcatgttctagtctgaggacgagtcgtatgcagctacaccagtttatatctgtgtttgtttattttgagacagctgagtgacgctcagacttactatgtagttgagaggccttaaacttggtcttcctgtctgcctctcgagtcctggcattacaggcagacacggccactccagtttccgttttgtttctattctgctatgtttttattcttattttacacactcggtaagctattttatgcaatatttttacttttctgagcttagatgtttggatacacgtatcttattgttacaatcacttaaagtatccaatctagaagaagctgttcagaatgcaggctaggagctgcaacctcccctgtcctgaagcctagctgtgcaggggggctctaccgcctgcagtcagtttctcagtgttcacacacaacgaaaacaacacattggtcagaaggtgtccctgtgatcagcaacacatgactgcaagtctgatgaaaccagacttgatccccatggctctcctgttctgtgaggagagacagggaagtccagtatattaggaataattaaagaaacaaactctgaaactcgaacaggccacatttactaatgcaatttaagggacgggagggtggtgggaagatgtgaaatcctctttctagggtagagtctccagtaggtgacctggacagatgaaaaagggaagtgttttctaggacaggaacattcaccatgaaaaatatgataactcccatcaatgcctttacaatttcctcctgataaactttggttaccttgtatcctccccaccatccccagaagctaggaatccaatctagagtcttgtacatgctaggcaagtgctctgccaccaagccatgtcccccaacctccactttcattgttcctcctttcatccctcccccaactccctcaatcctttagtctccgatgcacccagggccatattatttttaaaaatgcagactatggtttcatttctggtgaggcaaatcctccgatgaattattttgctctgtttcttcccactttccagaattttcccagcttcttttgtcctctatggatttaaaatttctgatttttaattgttgttggctttaaagaaataacaggagtggccagatgtgtgccacacaccggaggttctagcaccacagaggcagagccaggaggataagaagttcaaggtcaccttcagctttgcagtgagtctgaggctagcccaggctacatgatagctacatgtgttttgaaaatgagagagagacagagagagagggagagagggagggaggggtggagagagggagagagcgatgggggcgggtggggggacgcccagtagtaatggcagaatgattgtcaattgtcagtatgcacagggctctctctgggtttggtatctagcaccaaataacaacaataatataatgggatccttatttcgtatttttcactgggataaattcttgaagaattagaaagactgtagtagaggggtgggtaaaatagctgaacaggtaaagatacttgctgagcccaaagccaagttc

SEQ ID NO: 1160 - DNA, 889 bp, Mus musculus
ctgcgcctctcttccccagacctgcgcgctactgcggctcgggcggtcgctcgcctggctctgctccatttgactgtctgtgtgcagtcgcagaacttcgaagagggttttgcgctccatccgtggcgtttcgcttttgttcggttttgttgtttatttcatttttttttttccggagagaggcgaggcggtggtccacacccgcccgaggaggaagatgtcaaacgtgagagtgtctaacgggagcccgagcctggagcggatggacgccagacaagcggatcaccccaagccttccgcctgcagaaatctcttcggcccggtcaatcatgaagaactaacccgggacttggagaagcactgccgggatatggaagaagcgagtcagcgcaagtggaatttcgactttcagaatcataagcccctggagggcagatacgaatggcaggaggtggagaggggcagcttgcccgagttctactacaggcccccgcgcccccccaagagcgcctgcaaggtgctggcgcaggagagccaggatgtcagcgggagccgccaggcggtgcctttaattgggtctcaggcaaactctgaggaccggcatttggtggaccaaatgcctgactcgtcagacaatcaggctgggttagcggagcagtgtccagggatgaggaagcgacctgctgcagaagattcttcttcgcaaaacaaaagggccaacagaacagaagaaaatgtttcagacggttccccgaacgctggcactgtggagcagacgcccaagaagcccggccttcgacgccagacgtaaacagctccgaattaagaatatttccttgtttattagatacatcactgctttatgaagcaaggaagatatacatgaaaa

SEQ ID NO: 1161 - protein, 245 aa, Mus musculus
LSVCSRRTSKRVLRSIRGVSLLFGFVVYFIFFFPERGEAVVHTRPRRKMSNVRVSNGSPSLERMDARQADHPKPSACRNLFGPVNHEELTRDLEKHCRDMEEASQRKWNFDFQNHKPLEGRYEWQEVERGSLPEFYYRPPRPPKSACKVLAQESQDVSGSRQAVPLIGSQANSEDRHLVDQMPDSSDNQAGLAEQCPGMRKRPAAEDSSSQNKRANRTEENVSDGSPNAGTVEQTPKKPGLRRQT

SEQ ID NO: 1162 - DNA, 27310 bp, Homo sapiens
acaccatcattacagcattgggaaaggctttttgtcaagaataaatagaaatgcatcttttttttttttttttgagacggagtcttgctctctaacccaggctggagtgcagtggtgcgatcttggcccatgcctgtaatcccagctactcgggaggttgaggcaggagaatcacttgaacttgggaggcggaggttacagtgagctgagatcgtggtattgcactccagcctggtcaacaagagcgaaactccatctcagaaaaaaaaaattgctgagaatttataataaagccatacactgtttatctggttaataagatagtctattatggtgggaacagaagatgctgttctacagtgattttctaagcagaacatttgccagttgaaatgagagactcacaagcaaagctaattatttgctaattctcttagcatatcctgcaaaaatggttacttttaaagataaggtcatttgtcagcatggcaatttttttttttttgagacaggatctcgctctgttgcccaggctgaaaagtgcagtggcatgtttacagctcactgcagccttgaactcctgggttcaagagatcctctcacctcagcctccccagtagctgggactacaggcatacaccaccacacacccagctgatttttgtgttttttgtagacacagggtttcactatgttgcccaggctggtcttgaactcctgggctcaagtgattcttcagcctccacctcccaaattgctgggattagaaacatgagccaccaagcctggccagtatgataatttttttatgacagttaagaaaagatattgaaggaaacagtgtaaaaccaggcaatgaaagagtagagaaaggcagtcaatatatggcaccattttaatatgcttgcttccccgtcagccagccctcacccctggccacagcctggcctgttgccagactggtttcctgatcagaacccatctaccctctgcttagactaggagtgtgtgtgcataatttattcatgtgggtacacagcatgcataacatgactttctctttttaactcacaccagtcaggctttcacatctttaccaagactcctcttatcaagtcatcagtgaacttgatggccaaatgcaatggtcagttttcagtgtttatcttacttgacctatcagtggcattggaatcatttgatcatgctttcctccttggaacactctctttacttgatccctgggtcacctctctcttggctctcctccactctactaagggctttttccctatctcctttatctagatacttctcatcttgatttctaaacgttgtagtaccctaaggctaactgcctagctcttttctacatctaaacccactcccttggtgttcttatctagtctcatagctttaatatcatctgaatgccaaacatttccaaatgtgtatctccagcacagacccttctgccctgaattccaaactcacatatccatctgcttactcgacatctccatttggatgtctatggacatctcaaacttaacatgacccaaacaaaatctgttcatctctcaatcaaccctatctcagcaactggtcatacctttcttcagttgcttggagtcatcatgaactctttctcacacacacagaccatttccaaatcttcagcaaatcccattggctgtatcttcaaaaaacacactatcaactctctacccttcttttcatgtacactgctaccaccctggtctgaggcccatgacctcttatctggattagtgtatagtctactataatacatggtctccctacttctctcttgcctctttgaaatacttcttactcagcaaagtgacaaaagttacccgaagtcaggtaaaaaaactctatgctcaaggatgatgcacttcaattggcataaaatccagcctttaccatggcttataaagtttacatgattggggtctctacttccttcttctctgacttcatctcctactccccagcccccactcaccatgtttccagcttactagttcccttattgtccctcaactatcccagacacattcctacctcagagcctctggatttgctatttcctgtgcctgcaacacaaaattacatggtccatgctctcattccattcaggattctactcaaatatcactttattgaaaagtccttccttgttcatacagcatctgccttcattaccctccgtactcttaattagttgatttgtcgtgttagcacttacagcaacatgacatattatgcttatttatttgtccattgtctgtcttccacacttgagtgtaagttctgtttcatgacagcagggactttggctatctttgttctctgctgtgtcctcagagagtctggcatctggtgagggttcattaaaaatttaatgaatgaagaaatgaacaaatattaatgtggataattattcagagagttggtcaagaacagcaagtgggtaggttccagttttgttttacatggaagtttgtataaactgaagactaagatcagaatcagggaaaatgttctcctttatgtcttctcaatgtaaaaaatagaatgtagttgaatgtggtggattggtaataaatatgtttattgttccaaattccatattttatttatttatttttttagggacagggtctcgctctgtcgcccaggctggagtgcagtggtgccatcatagctcactgcggggtcaaactcctggcctcaagcgatcttcccaccttggcctctcgaagtgctggcattacaggcatgagtcactgcgccgagcccaaattctgtattttagtagtagaagttgtccacttatgttttaaccatggaaattaaattatgtgtgtgatcatgaatccaaattttgctatttatttcctattcttttttttttttttttttttttttttttgagatacggcctagctctgtcgcccaggctggagtgcagtggcgtgatcacagctcactacagcctcaacctccctggctcaagcgatactcccacctcagcctcctgagtagctgagactccaagcatgtgccaccatgcccagctaatttttaaattttttgtagagatggggtctcgctatttgcccaggctggtctcaaacttctgggctcaaaccatcctcccacctcggcctatttcctatccttatggtcctggcaatgctggtaaacttgcattagttcattacattttacttggaaatgaaaattttcatctaagtaaaatgcctgatgcattttttttctttaaattctgaccccactagattagttttaaacccttcttgaatctaattttttcaaagatgccatttttccaggcatttgaatcccattttccccagagcctttgttttgtgaatagtgcattctaagtaaattaaaccaatgaagccttagtgatataattgcaaacctatccagtcactgcatcttctacaatggattctggactcagcttaagtaggactaataagtacactagtcctagtgccttctctgctctcttttgtggctttggaacactcagttctctatttcagagcttcatctgcaagagtggataatagcatttgcctcacaattgtggtcttatgaggatcaaatgtgatgacaccagggaacctgctttaaagtatttaaagtggctgggcacggtggctcacgcctgtaatcccagcactttgggaagccaaggctggtggatcacgaggttaggagttcaagaccagcctggccaagatggtgaaaccccatctctactaagaatacaaaaattagctgggcgtggtggcacacacctgtaatcccagctacttgggagactgaggcagagaactgcttgaacccaggagagggagaagttgcagtgagccgagatcacgccactgcactccagactgggtgacagagcaagactccgtctaaaaaaaaaaaaaaaaattaaagtattatgttaattagggatgacttgggttcaaccaacagaaactcataacaagctagcttggagcaaagggggggaaattactttataaacacagtgctatagaacgtaaatgtagggagtagtacctcatgaactaatagaacgtaaatgtagggagtagcacctcatgagctaatagaacgtaaatatagggagtagtacctcatgagcttcaggatccggaaactgaagagtctttggttgctcggggctgtctgtcttcctaaaactatgtggtctctcttctctgccccctttgcacatttttttctttcttctgacactctgcagacagacattatctgcatcttcatcacacatgggctgaagatagtgtccttttgtttttgagacagggtctcactctgttgcccaagctggagtgcagtggcatgaacagggctcactgcagcttcgatctcctgggctcaagggatcctccacctccacctgtcgtgtagctgggatcacaggcacatgccaccacacctggttaactttttaaattttttgtagagacggatcttactttgttgcccaggctggtcttgaactctaggatcaagcagtcctcccacctcaacctcccaaagtgttgggattatgggcatgagccaccgtaccccactgaagacagtgttcttaaaagggtactttcaatctcaagtctacattacctcattagtctctgccttacaatttactaattgaagtttctcagacttgattccaaattttcgggagaaaaaatttggctagccaagtttaggtcaaacaaccacctcctctccccttgtctgatcaacttcggtaagggaatgggaacagggtttcataatctgctgtccccccagcagaggttatgggaacagagtctgagaagggagtacaggacaacagagaaacaatgagtgttgcacacctcaagtgtgatgtgaaagaattaagaataccacatgcagccaggtgcggtggctcacacctgtaatcccagcaactggggaggccgaggtgggtggatcacctgaggtcaggagttcgagaccagcctggctaacatggtgaaacctcgtttctactaaaaatacaaaaaattagctgggcctggtggcgcgcacctctaatcccagctacttgggaggctgaggcaggagaatcgtttgaacctgggaggtggaggttgcagtgagccaagatcgtgccattacactccagcttgggcaacaagaatggagctccatctccaaaaaaaaaaaaaaaaataccacatgcatccttattcctgtacccgtgtaactgttaatctactcaggatccaacctggccatatgattaatggcacattcgtaaatatggataggtgtcagagagccccaccaatcataacatcccttcacattttgtgtcagatgcttgtctccagtattgtctcttttgccctctttttattttcgttacagacagagtctccctctgttgcccaggctggagtgcagtggtacactataacattgaactcctgggctcaaatggtccttctgtctcagccccccaagtagctgggactacaagtgcacaacactgtgcccagctgttttttaaaaaatttttttgtagagacagggtcttgctatgtaggccaggctggtcttgaattcctggcctcaagtaatcctcctgactcaacctaccaaagtgaggggattacaaacatgagccactgtgcctggccttctgtagccctcttaagggacataccttttcattctttcttttccctggggattaagttaatttcaatgctcatactgaccattgagtgataaaccaaattcttcaccttccctattccctatctcccaaactgttccatatgcattagttaggagtgactgtaaaatgctataaaaagtgggccggtgtggtagctcatgcctgtaatcccagcactttgggaggctgaggcaggcagatcaggatattgagaccatcctggccaacatggtgaaacctcgtctctactgaaaatacaaacattagctgggtgtggtggcacgtgcctgcaatcccagctactcgggaggctgaggcaggagaattacttgaacctgggaggtggaggttgcagtgagctgagatcacgccattgcactccagcctggcgacagaatgagactccatcaaaaaaaaaaaaaaaaaagaccccaaaatgaaaacttatttcttctcccaaatcaggtcagggacccaagttgaaggtggctctgtcatcttcaacatgtggcttccaaggttgctctagtattcacctttccagcccatgagaaaggggaaagagagtggcgggttctgagggggtcacatgacaggttctatgcactaggcctggaagacacataccacctttgcttacattctattggaaaatacttcatcataaagccacacctaattgcaaaggagacaggggaatttcatgttgctgggcagttgtatgctcagttataattctgctactgggaaagaaggcaacaatggattttgatggactggatccatcagtcgcttgagagactgaggcaggaggataacttgagcccaagagttcaaggttatagtctctcctacattctccttttctgttacctctcttagttaatggcattattctctcaaatacccaagcttgagtccttaaattcgtcctccctttctccatctctctcaatcctcttatatgttccagctacctaagtaaccaccctgcatttgttccttgctttccatttcctctatagcatgacttaaatccattgtatctgttgattgaataactcatcatcctccaaaattacctccgtgtcagtctctccaggctcatcacacccatcctttactctgccgtcagacactacttccaaacacaaagatctgcttgtccaagacagcctgggcccattaacaggcacctccccactcacagtcaaggctggaagcaccatataaaaagcatctgcagctacacctttgcggctcaggagattatggcagactgcctcctttctctgccaagccctgtcctcctgggctcagggttctctgtctcacacttgaactctgcccatctccccacatcccactggatgaacaccacagtgggactgtctgcccagcttttcatttagccctgtccctagacactgtctgtcatatcaccctcagccccatctcacaaatccaaactccagagctccaacccaggcccagggcccaggcttgcttttgttcaggagacaagtttggacgctgatcattctcttcacttaaagctccatcagttcgcagtacttacggagcaacagattttttagcatgccatccatggccaaccactgtctgatcccatccccacttaccacccctaccaattcatcctcataatcatcttgacattttcttattcttcaagatctgactcatatatcacttcttccatgaggccttcctctttctccttgctttgtacttcatagcatcatgtttttctatgtattgctttctacctctagtttatttatttgagacaatgtcttgctctatcacccaggctggagtgcaatggcatgatcatagctcactgcagcctcgacctgggctcaagtgatcctcccacctctgctttctgagttgctggggctacaggtgcaggccaccaggcctggttccaacctctagtttttgtgcacatggtatatactccccacaggcaaggactctgacaaatatttcttcacttcccacattgctgagaataatgccttggacaataccttacacatggtattgatcactgcttaaaacctcctaatgccccaatggctttccatatcgccaggccaataataaaagccctacctatgcctacctggtcctatctgatctgatgcgctttttttttttttttttttttttaagacagagtctcactctgtctctcccgggctggagtgcagtggcacgatcttggctcactataacctccgcctcccaggttcaagcaattctcctgcctcagccttccgactagctgggatcacaggcgtgtgccaccatgtccagctaatttttgtattattagtagagacagggtttcaccatgttggccaggctggtcttgaactcctgacctcaagtgatccacccaccttggccttccaaagtgctaggattataggcgtgagcaccgtgcccagccctgatgctcctgttaccactccccacttgctccgccctatccaccatgggcccccctgctgttccttgaacacattaggcaagatcccacctcagagacacttcatttgctctttccccagatagctgtatggctgctctctcatgtcttcagggcttctctcaaaggccaccttttttgtgtgtgtgagatggagtctcactctgtcttccaggctggtgtgcagtggcaagatcttggctcactgcaacctccgcctcctgtgttcaagtcattatcctgcctcagcctcctgagtagctgggattacaggcctgcactaccatgcccagctaatgtttgtatttgtagtagagatgagtttcatcatgttggccaggctggtcttgaactcctgacatcaagtgatccacctgcctctgcctcccaaagtgctgggattacaggtgtgagccactgcacctggcctcaaaggccactttctccatgaggccttccctgaccacttattcacattgtgatccttgaaacactcccttttccctctccgcttattgtttctccatagcatttttcacctccttacatagtatgtacttctttaatgtgctgtgttcattttctgtctcctctcccctttttggaatgtcagcatcattctagtttaaatctgtttgtttacttctgtgttcccagagcctaaggataatgtctggcatagaggaggcactcaataaatatttgttgaaagaaagaaggaataagcaaattaatagaaggtgctccgtaaatatttgtgaaattgaattaaaagtgtcagaaggagatgactgtgaaattcccaaagtctaaaaatatgtgagcttagaagaatggtggagttgagtgctgcctcattataaacatcctcgaggaaggactgaaactgtgtgcttgcggtgggaggggcagctgggcaaggaaccgtgaaccttcgcagaaacatttggggctgcagaacttgggtgagagcgctgcatctgggagctggcgacgctggcggcttgctcattcaccccatctgaacacttgtctatgacacaggtgttttctcttaagttattttggtctttgcctctctcctcaggttgtgaagattacagaaatctgggatggcttatgggacgcttctcagccctaagtacgaaaacagcagtgaaaatggcaaccaaaacatcacgcaggactgggggttttggggaaacagctcactttagagcagtgcagtgtagagctttccgtcttctaccagggtccacctttaacactgtttatctgaaaattttccccctggcttactcgcttgcagctgcccactttgcagaaggatggcgctctgatctctacgctccctgttccttcagggactccatagtattttttttcacgcgtcgtcgctactacagcagacgcctgcgttctcattatttgctgtacagatctccggtgccttgactgtaaacaaaacactttagatcattgtgaggtcgatgtaagcacagcctttctgctggcagccagacttcttaaggtggtgtgactgtgacttgcttacttttcgagatcaacaacaacaaagcgacaaaatggtgctcctacatattagttgaaagattcagcatgtgaaggggatcgaagtgtttattttccacttccatataagacatgaattccatgagtaaaatcaaacttctgtggcaaggtgaactactctagaatgtctccatttacatacatgtggtagtttgggtgtttatgcatatggatagatgcacatatatagagttcctgtgttgtctagcaattgttttaaaatttggacaattatctaatttctagggtaaggtataaattatggtagggaggcctaccctaattttcctgttccttttcccccagtctgcagtccaataaattgacagccttaaaagtagaaaaactaaagaggatgagacctcttgcttgatcctaggtgaattcttttctgtcagttaggtaggaagtcctgacttgaaaactagttctgggcactgccccctttactgttctctgggtatcaacccctgtccttcaattttagttgaactagtggatggtgataccacaggctcaagacagctgcatttaaatatcagtgaccacaggccacatcaaggaaacatctgcaggcaacccagggcctgggaaggagccattttcagtcacttgtaagacagcaggacctgcagactacagcacaatcaaactcagacaaaaccctgaaccagtgagaaccattaggaaggaaaggaacagaaaatgaaccaacctgagtgttaggagacttgcatctagtcctgactccggtaccaaccgaatgcatgtccctggacaggaaacctctctgagtctcgatttcctccgtggtaaaaaggagagggttaaaccacagggtcccgagggtcccttccagctgtcacattctggagcgtatgagatgaggtaggcacacaaagtggacaagatgtggctaagaaaacaagctacacatcaagctcatctgtagcataggtgcttaagaaaactttgctgctgtgtaatattagaacggaaggttggtttccagtaaaatgcattaactttggctcaaaccaagatgatgggtaccgggcatgggggtggggaggcagttgaagatccactgagctttgtctcagggcagccctgctcatcgtcctactttaccttccaccacggtgctcaagcccacactgagagagaaatttccagctgcaaaagggagaagagaaacgctggaatactagtatcggacgttaggacatggttgtggtgttttaaaaatcatttcatcatctggagtttgaccccgaggggagtattttcacccttcagccctctgaaagcattcactagcatctgaatattgttctgagtttgttggagcagtgaaatctggtgagagagaagggtggaggaaggaaggagctgttgtatttggcggctggactcaggtagaggaaactgctacaatcccgggaaagaacagaaaagtagaaagggacgagttcccacacgcagccaatgtccatggccttaactgtgcttgggaaggaagatcctgggccaggggtgtaccctcgtttttcaaaactaaacgtgtctgagacagctacaaagtttattaagggacttgagagactagagttttttgtttttttttttttaatcttgagttcctttcttattttcattgagggagagcttgagttcatgataagtgccgcgtctactcctggctaatttctaaaagaaagacgttcgctttggcttcttccctaggcccccagcctccccagggatggcagaaacttctgggttaaggctgagcgaaccattgcccactgcctccaccagcccccagcaaaggcacgccggcgggggggcgcccagctcccccagcaaacgctccgcggcctcccccgcagaccacgaggtgggggccgctggggagggccgagctgggggcagctcgccaccccggctcctagcgagctgccggcgaccttcgcggtcctctggtccaggtcccggcttcccgggcgaggagcgggagggaggtcggggcttaggcgccgcggcgaacccgccaacgcagcgccgggccccgaacctcaggccccgccccaggttcccggccgtttggctagtttgtttgtcttaattttaatttctccgaggccagccagagcaggtttgttggcagcagtacccctccagcagtcacgcgaccagccaatctcccggcggcgctcggggaggcggcgcgctcgggaacgaggggaggtggcggaaccgcgccggggccaccttaaggccgcgctcgccagcctcggcggggcggctcccgccgccgcaaccaatggatctcctcctctgtttaaatagactcgccgtgtcaatcattttcttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacggtaatgaccctttcccaaccatagaatgtgtttggggccccgctttgcctgctggagggtgttaaccttagcttgcttttcggcgtattctgatttagctttgggagagctaactttattggtcttaggtgttcagtgctacctggcccactgcttgtctgtttgtgacttttaagtcagaaactggagatggtaagatccgataatttccctaacttaatacatcgcggtccctctcactagcaactcctaggtatgtgacaaagttgggatgtttatcaacggtccgcctcctggctagggaaagagctctggggcggagaatgcactttctgttttttgaaaacaacctcattttgtgcccttaaaagccactggggatgacggatccaggattgtgggtggaggtagtgggtttttcatcccctgactatggggccaacttctgccagccattgttttttctaataaagattgtgtgttctttttaaaaatttcccctgcgcttagattcttctactcaaaacaaaagagccaacagaacagaagaaaatgtttcagacggttccccaaatgccggttctgtggagcagacgcccaagaagcctggcctcagaagacgtcaaacgtaaacagctcggtgggttgatcactaaaggagcacgcactggaacccggggccttcagacctcacgatacctgatcttactggttgctggcaaattaaaagcttatggggttttgttttgtttatacttcgtgaggtcaaaaaagtagcaatggggaaggctggggatacggtaattcctcagagtttctatgcccagagatactttctcttcaaactgttgaccagagcagctacttgtaacccaggccccatcgggtaggaaggtcgtttccctgtgagtcccactaaaacgtgttgggagcaataggttctttgcccatccgaacaagaactagggtactccctcagtccgaattaatgagaattaatttcctagaggttcagcttgagtcggtaacagattttgagccatacatggaaaaatggcaaatacatgattaagtttcaattttgagggggaatgtttggtagaaattgctcatctttggttatgcaagggattagagatgtgaataggatggtatgttgtgttctttgacattttaataaactgtcactttccctgttgtctcctaagtttggagagagaaggaaccagtatttgcaaaaaccaaatggaaagataaaaaagttactaaagtttctacagaatttctggtaacactgaagttgcaaagcagaagttaaattaactcttgtcagtaagcaatccaggaacacgtcagccagtgtatgctaattgtgccgtaacagggtgatttggatatttgtaggggaaatgggtagtaaatatcaagactggtgaccgtaggtcagcccagcacaaaggaagtggagatttttccatgcacaagaatctgatcactgtaaatagctaatttgaataattcagtccccagataaccaacatgggttggttattcataataaactacatattttaatagtttattagcttcctttagaccaagactgtgacctctttattttctaaagcacacacgtagtttagcatatgaggcgataaaatattgatgttaactttttaaatccccagttataaaaattttaaaataacagggattaaggtgagattcaggtttgttgtgtctttaaattgtatatgtgacttcacatatctttttcagcgcttatacaaaacggcactatagaacctccattttacagcaccatatgaagtgggaaaattaggtgaaaattttcctgaagcaaccttaacatgcgcagcccttgttggtttgtgacttgtggcctagctcatcagatgagccacgagaatcagacctggattttgatctggccctgttctgacatgcaatgaggcatttgtaggatttagtaatattgctagttcaaagaatactagaaatattagtaagaacctattcaaaagtattcatgagtattttctgcatatgaatcaggaattagaatattttgaaaatgatgttaataaaattttcctctggaaggcctttataatttttattcccaatcatttttcaaatttagaaagtttaatctgtcacaggagaaaaaaaattaaaaattttcaaaaatttagaaaatttttacccgtaagtattacagtttcctaattatcctatttatttcccacttgcctttgacctagattatttagagtagggtttctcagcctctgcactaatgacattttgggccgaataattctgttgtaggaggctgtcctgtgtgttttagattgtttggaattatccctggcctctcacactagatgccagcagtatcctcctcccccagtgtgacaacctaaaatgtctccagacattgccaaatgttccctgtggggcgggggcaacattgcccactgttaagaactactgctctagaccaaagaacacagcacagaggaaaggaaaaaaaaatccagttaagagaatgttaggtggagatgactatagtcatcaaacttttttccccatcaagtatttccaagctaacatagtgacaaaataattcctgtactctactggtaacgttaatctagtgctcttcctttaattcttccgttttgttttcttttgcagaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatagctattcattgagtcaaattgtaatgtgctttaccaaacaaggtatttgacctggcattctagtcatatttacacaaatgtaaatgtgaagtggcaaatacctaggtaattcaggcccacaactcagatgatgttttatgtagtccgaatgtagttagcagttactattttccacttagctctgtgtgggaggacaaaactttagaaggtgaaaatggaaaagctacattttcatatgaataaggttgtcaaaagtctgcattagtaaaaatatttatgtcttctaggatatgaatgtgtcaaaaccaaagaatccttacataagtgtacactgacacatttgcaggattgaaaatgaaagtaacatggtgacttctctaaattctgtatttacacatgagaagtgtgaggaattaaagcaattgtttggaccatctaatgtataaatcttgtttaaaatattcaaacatatgggcccttaagaaattggtgtgcactctacgtagctatttttgaaatttaactggtcatacaaaaattctttcaatttctatatttagaaacggggtatttccttgttataatctacacaaccaaaaactggctaatgtaagtaaccaaatctgaggattttgagtctccatagccatacagcagatatacagtttttacctaaggaaaaaagtataagacaagacattttaaagtcagattactaaaatgattcctgtaattccacattctcaagaaaaaatgtgtttaaggtgtaatagtaaattcttataggacttattctagtaagtgggtaaatcgtaaaaatctaaatttgggttaaattttttcgctcaaatacctacatttcctttatcgtaccccaaaaggagctctcaaagagtagtttgaacagtttttgacccgaagatttttttttttttttttttttttttgagcaggttggactcttcggcttcctggaagggaaaaataggtcctttagtggctgggctacatctttcaagtaggtattattttaatgaaagactagaggtgttttgtgattttgtttgaaactcgcatccaagagtgtttttcgaaaacagactgaaggagcaagaaaaacaattcgaaataggaaggagaggagggtcagaaaataatgaaattaaagttcctctgagtaaaaaaagataattcagaaagtgtctctaacagaataaaaaatatcgcctggattgctgcaggcaccccagtctcctttcctaaagaggtctctttaaacagaattttgagagattgcgttttagttatgcgggccagggagaagtggatgctcgccgcgccaggcacgtccacaggaacgcagccccgagtcaccgtgtccttcgtcctttacccgcctgtgtcaagcctcccaaaatgacccgcagttcagctcgtccttcgccgtgaacgtccctttgcggggttgcggccgccgtcgcccgccaccccttgccccactacccaagccactgcgccgtcgtctccccaaactgccccgcagttccgcgcccgcccgccgcggcagttgcggggtcgggctggctggtgcctcgggacgagaaggccatcaagtgttgctccctcatctgtaacgtgcagccccccgcactgtcgccgtcgtcgcgcgcagttcccgcgcccgggcggccgcgcctccgccgcgcagccgggctgggcggtttctcagaaactttcctccctcctcctctcctctgcgctgagaaagcagcgaaagctcccactcctctccgcaaacggactctccacctgagtaaccggccgcctccccggccgtggggatatcggagctaaggggagagccttcccgagttcgccgaccctccggcgctgcagcccgctcccacccctaccctgggctccaatgatccgcagccccgcgcatttcgaaagcccgcccggctcgccggcgcctggggagggccacggcggcgcgcagcccgggccccgcaccacggccgcccgcgtgggtcccctctgccctcacccccgctcggcaacgtgcccccatcgcaaccccggccgcccggcgcgggggcctgggacggggaagaactggggaaatgtgggtttgggggcgtgtttgggggactccgggagcgtgggcttcacaggcgaggagcggggcgagaggcctctcaggccggggtgcgcccaccgccccggcctcagggagcgactttcccggaggccgggggacgctgccttcgccatttcatcttcatcatcacagcgcccacacttgctcttctctcaagctctttgcacagaaaaagtgattctaaatctcctctaggatctcctgtctggtgttcagagtatgaatttcttttcaaaacttgctgtgtctttcacctgggccacaccctacgcccacccaccccctctcagccaaaagggaggtaaaaaatcctgcgggcccagctgggggtggggaaggggcccacagtcccgctggaaaacctcagcggccacctcccggatccgggctggcctggggactggggtgggatggggtggggtccgcctcaggccgaccccgcagaaccgaaagtgccgagttgacacgtaaggcccagcccctctgcggccgcccgcgcgcccggcctgtcacgcgtggggacactgagcagcaggcatcggagcgagcagtacaaaaagaaatcaaggcgttgggcgcgaaacctcgacgcgcctctaaaggaacgttgagaaaaggcagggagcagggcgcgcggccgggggattgcatcattgcggctccccctccagaaaacgggccccgaaccgcggcgaccatcatggcgctcgcgccgggctgcgctccccgcgcgcctgccccgcgctccggccgcggccccggagcctcggacgcgcatttcacaaacattctcgccctctcccgagcgcccgcccccaccccctccttctttctgtgtgtgtgtgcgtacgtgtgtgcgtgtgtgcgcgcgcgtatttgtgtgtagggagaacttgcagatgattttttttttccctcccgtgctgctggttgtaaacttgattggcattggctgcgcccactgaccccgacgctgagtccgctgaagatttaaggtggatccgagaagctgcagcttcaggcggagtctcgcgctctagtcggttttgggaagagaaaaaaaaaaaaaaaagccccgaaccgggcgcccgccgcgtttgccgaatctcccgcggccccagcccccgcgcccgcccggggcccctccccgcctcgcgcgccgcgcgcggcctccgcccacctcccacttcttccccattggccggcgcgtgcagtttgaatttttttttttttttgatgcttgttttcttgtaaaaaatacagtcccccagatcgtgtgacgaaacctgcttcggcggcccgaggtgggggttttgagtcggttagtggaggcagtgggagcaggatgggcggagcttctgttccaaaaatttcccctaagtgcggttgacagtgtgcaggcaggcgggggtgcgcggggcggtcagcgatctgcagcttcgcggggacagagatgtaacccaactcgttcacggatgttccgcgcgccgtgtcaccggctgcgggccaggggtactcggaaggcgcgggcaggagcctggcgaggatgcaccttcccctgccttggaaaggtagaactggggagtgcgggagggtgaaggtggcccggaaaagaacacctcttcgcaaccaaaaaaaaaaaaaaaaaaaaaaaaagaggaaatagaggaaaaatgtgttatttcaaccgccactcagaacccatcataattcagccagtcggtgtcatttttattgaattaaattttaaaaaagttttctttgatttccagagcgtttttgcgggaggaatatgttaaaacaaactcaagatacgaaatgagacttttgaagtgcctttgatttctgggtacggaaattcttttgataaagcgtgtgtacgttaagatttaggatgactttttttttcttttttgtaatacaggtctaatggaaatgacattctttatgaattagaacccaattatgttttaaagtttataataagtcaaatgattctctcagtccctatgtccgtattagtgaaattctatctccatattagcgaaatttgcatagatacacacctttttctttttgtcttttagtcttgctgcagtgtatcggacgagtttaaccagatatccagcactagccttctaacagtttctaactcagtggtgacattttttagttcttaactcccccaatccttcttagcctaacaaacctcttaattaaggtccatgaaagaccataaaccaacctgattatgcctttagcaaggctgtgttcacttaatctctaatcccatatcataaaagtccgctagtcactcctgacctccaggaacccacctaaccagggtggacactataagaaaacatgtgttttaatggaatgagaacttttttgagttgaagacacgctagcctcaggaagcagtgagctcaccatccctggagtgtgagtcaagcactagtcttggatgaccccttgataggaacgttgtagacaagattcaaatatcaaatagtatttggactagtgatttcaaagtctattccagacccctgtgaaactgtatttccaaccttggcatttctggatttccactaaattaagccactttccttgctcattagcatcttgtagagctgtgtggctatttgagcgcttgaatgtggctagtccaaattgagatgtgctatatgagataaacaccacgtttccaagaattagtatgaagagaaaatgttaaatatttcattaataattttaatattgattacctattgaaataatattttgtcatattgggctaaataaaatatattattaaaatgaatttcatctattccattttacttttttagtggagttactagacaatttacagatgtgtctcaaattatatttctattggacattactgttcaagactatcacctgtggtaacttgaggccccatctttaaaagtggtgactattaatactgaggagtaggtggtaacttctagctgccatcctaacttctcaaattaaagtgagacccaaactcagcctctgaaagctttattatttatttatttatttattcttcttcttattttttttaaaagatagagtctccctgtcatccaggctggagtgcagtggtgtggtcatgtctcactgcaacctccaactcctgggctcatgcaatcctcccaactcagcctccagaatcactgcaattacatgtgtgctctgaaaccttttttttttttttttttaactttgtagagagtcttgctgcgttgcccaggctggtcttgaacttctggcctcaaatgattctcctgccttggcctcccaaagtgctgagatgacaggcatgagccaccatacctagcatctctgaaacctttaaatagaattctgccaacatctaacacctactgtttaatctttaattaattaattaattaatttttcttttaaagacaggtctcactctgtcacacaggctggagtgcagtgggcatgagcatggctcactgcagcctcaagctcctgggctcaggagatcctctacttcagcctcccatgtagctggactacagatgtgtgccaccacatccagcagttttttttttacttttgtagagatggggtcttgctatgttgaccaggctggtattgaatgcctgacttcaaggaatcctcacaccttggcctcccaaagtggtgggattacaggtgtgagccactgagcccagcctgtttaatacttaatgtagggttcaagcccagactatgggaatatagtatagatatgtctgatgaactcagacttggtcaccacagcttttcacattatggcaataggaagactggaggccggacacattggcttacacctgtaatccgcacactttgggaggctgaggcgggcagatcgcttgaactcaggagttctggaccagcctgggcaacatggtgaaaccccgtttctacaaaaaacaaaaaaaaatttaaccaggtgtggtggtgctgcctgtagtcccagctactcaggaagctgaggtgggaggattgcttgagcctggaaggctgaggttgcagtgagccgagatcatgccactgcatgctggcctgggcaacagtgagaccctgtctcaaaaaaaaaaaaaaaaaaaaaaaaaaaaaaaaagagagagaaagaaaagaaagaaagagaaagattggaaactccaatatgttagttgtgactctgccaaaaaaaactatttagaccccacacaaaacctgcacaggcagagcctcactgcgactcttcaggagataggaagaaagtggggagacagagcagtatgctcattctaagattgggtctctagcagaagcctgcacaatgaaaaagtataccatattcttggatgggaacacccaacatgacaaagatggcagtcctccctaattcatctgcacctctttacactaaattctgataataggttctgatcatcctgtttcgttcctttgttgtagcagtctgtccactcaggaccataatataattactgtaaatttggaatatgtttgaattgctggtgggccgagtcctccacatctcgatgggtccctttactcctttttttcccccagaatgttcctgttttcttttgcttgccattttccccatgtggatttaaaatgaatttgtctagttttaaatataattctgtcggcattaaaaaaaaaaataaagtgggattcttatctcacacatcaggataaattcctgaagaattaaagaggatgaagtagaaagaaatgaaaccatagacatgcaaggagaaacctcaaaggatttttaaaaaaatctcagagttggggaaagactttctgagtacgacaataaacatagaattcataagatgtaatttttttttctttttggtagagacaggatctctctacgttgcctaggctggtcttgaacgcctggcctcaagtgatactcctgccttggtctccaaaagtgttgagattacagttgtgagccactgtgctcagctgggaggagctcttgaggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcgtgccattgtgctccagcctgggggacgagattgagacttcctctaaaaaaaaaaaaaaaaaagaaagaaagaaaaaagtttttttttttttgtctatataatgaggatgcttataactctcatagggtattaaaagtattcgatggaataatgtatgtgttgtatttagcccaatacatggtatataataatgaccattacatatttgtaaacaatcaaattggccaggcacagtggctcacgcctgtaatcccagcactttgggaggccgaggcaggcggatcacaaggtcaggagatcgagaccatcttggctaacacggtgaaaccccgtctctactaaaaataaaaaaaattagccgggcgtggtggcgggcgcctgtagtcccagctactcgggaggctgaggcaggagaatggcgtgaacccgggaggcggagcttgcagtgggccgagatcgcaccactgcactccagcctgggcgacagagcaagacgccatctcaaaaaaacaaacaaacaaacaaacaaaaaatcaaattaatggggatatccagtttttattttgtcttctcccagtaaccacagccagtactatgttaaccttgtcaatatgtcttattatttttaattactgctgatactaccattaagaaaaacaaatattttaaattggcatttaataaagagaattagatatgcaaaaacagttaaaatggtaaattttatgtatttttaccacaataaaatctttttaaggcacttgttgaatttagtgtcacttccaatgatttctgaaaggacttggtatagatttatttgtggtaataaatcagtagcacatacacccacatacatatgcaatgacaaattgggaaaaatgtttgcaacccacatatcacagggttaatttccccaataaataaagagtttctacaaatccatgaagaaaacacaaaccagtagaaaaataagcaaaggatatgaacacagttatcggaaaagaaaatatgaaaggcttttaataaatgaaaacatgctcaattgtagactattgggatataaaccatatacagaatatataaatatagggaaattgaggcactcagatacaaagacggccattattctttcttgacagtttaatccttgcttccctcctttctacctaagggttagtgatatttttccagcttcattggtgaccaaagaagcaaagagtttgcatgcgtggaagccacgaccgtctttcaggttcagtgtaaaatccctcccatccaaataatgttatctttagcttagtggcatctccttactttgtacatagaaatcccccgaatcagcctcttaaggccagcacaactataagtatgtaagaggctgatgctctcaacacatccccatccattcctgcttttaagtttaatgcctgtacgttgctggtgataccagtctctccaaaaccatcaccttattctggcttttcgttcaagctctctattctcttttaaaagcctcatgaagagttgattacatgataaacataaattgtctaattagtagagagaaactatgctatgcaataaatggtgttaggttacagctaaccgtttggagaaaaatattaaatctcccttacatacacacacattttatatactgcgcatttaaaatgtatgtacttttcagctgggcgccgtgattgttaattactgctgttatt

SEQ ID NO: 1163 - DNA, 2357 bp, Homo sapiens
ggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtcttttggctccgagggcagtcgctgggcttccgagaggggttcgggccgcgtaggggcgctttgttttgttcggttttgtttttttgagagtgcgagagaggcggtcgtgcagacccgggagaaagatgtcaaacgtgcgagtgtctaacgggagccctagcctggagcggatggacgccaggcaggcggagcaccccaagccctcggcctgcaggaacctcttcggcccggtggaccacgaagagttaacccgggacttggagaagcactgcagagacatggaagaggcgagccagcgcaagtggaatttcgattttcagaatcacaaacccctagagggcaagtacgagtggcaagaggtggagaagggcagcttgcccgagttctactacagacccccgcggccccccaaaggtgcctgcaaggtgccggcgcaggagagccaggatgtcagcgggagccgcccggcggcgcctttaattggggctccggctaactctgaggacacgcatttggtggacccaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcctggcctcagaagacgtcaaacgtaaacagctcgaattaagaatatgtttccttgtttatcagatacatcactgcttgatgaagcaaggaagatatacatgaaaattttaaaaatacatatcgctgacttcatggaatggacatcctgtataagcactgaaaaacaacaacacaataacactaaaattttaggcactcttaaatgatctgcctctaaaagcgttggatgtagcattatgcaattaggtttttccttatttgcttcattgtactacctgtgtatatagtttttaccttttatgtagcacataaactttggggaagggagggcagggtggggctgaggaactgacgtggagcggggtatgaagagcttgctttgatttacagcaagtagataaatatttgacttgcatgaagagaagcaattttggggaagggtttgaattgttttctttaaagatgtaatgtccctttcagagacagctgatacttcatttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtagtttggggcaaaaatccgaggtgcttgggagttttgaatgttaagaattgaccatctgcttttattaaatttgttgacaaaattttctcattttcttttcacttcgggctgtgtaaacacagtcaaaataattctaaatccctcgatatttttaaagatctgtaagtaacttcacattaaaaaatgaaatattttttaatttaaagcttactctgtccatttatccacaggaaagtgttatttttcaaggaaggttcatgtagagaaaagcacacttgtaggataagtgaaatggatactacatctttaaacagtatttcattgcctgtgtatggaaaaaccatttgaagtgtacctgtgtacataactctgtaaaaacactgaaaaattatactaacttatttatgttaaaagattttttttaatctagacaatatacaagccaaagtggcatgttttgtgcatttgtaaatgctgtgttgggtagaataggttttcccctcttttgttaaataatatggctatgcttaaaaggttgcatactgagccaagtataattttttgtaatgtgtgaaaaagatgccaattattgttacacattaagtaatcaataaagaaaacttccatag

SEQ ID NO: 1164 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 1165 - DNA, 100554 bp, Mus musculus
  misc_feature (1)...(100554): n = A,T,C or G
ggcgacctggaagacatttaagccaaaagaaaaagacatgaaacagcagatctcaacagttctgccatgtttacaacgacggtaaaacggatacccttggggatattggtgttccaccaaacagagagagctggcactacattgtgtcttcagtgaagcctgtatcctcctggggttaatcactgcagctaaggtattaattatcaacggtacacagtaagattctgcagaccacatagtcttaggagattcataacaactccaaaatatgttaatacaggcttcttgaaaacaccacagttgtggatttgagactatcctttcaggcataaatattagtgaaatgaaattatgagtaaattgaaatcatttcaaacctactcattaaaactcttgctctgctttctaaaagaattaaagtgatttttagtgttcaatcaagtacaccaggcagacagacagacagacagacactagggcaggctgtgggtggctcaggtttccaactgagagtgcagtccctgggtcttgcaggaacatgccaattgatggctcagctctctctcaatctgctcctcgctcaggacacctgcaaatagcaactggttcctgactcagatggcaaagatctcagagatcaggaaccggccctgtgtgcttaaggagtctcaatactttaccacaaaccataaaacggactcgtacaataccgtgtcttgtgttgtacacctttctgcccagcgtgtaaatctatcccttcacattgttgttaagacatcaacctaagaaaggtgaggacactatgggaacaggacagaggagaggacatgtgtgaccagaaaaatgaacacaatgtttctgctatctctattttgccaccgtccttagggtacacaagaattttgaataaataatgagttcaattttaatacacacacagctctgtctggtgtctagaagaatcaataataggatagggaaaaatgatgtgacatggaagacgtcacggagaagcacagaccgaagtctacttgattcccagagaagagttcaaactaacacacacaaatcaccttttcgcatgacgtagttaaagaactgcatgatggaaattcgtccatatgaatctgtatgaaggagtttggcaaagacttttgcagtaaaaaattgcctaaaaacaggaaataaagattaaattccctaccaacatagtataaaaatgatgtctgtaagaattacccaatagggtaggggagtgggggggagggtacaggggattttggatagcattggaaatgtaaatgaagaaaacacctaattaaaaaaaaagaaatctaaaaaaaatgtaaaaaaaaaaaagaattacctaataacatgaatacaactaaaaatcaaagtaagagactataaagactcttcacagctcaacatttgaaacaagttataaatacttacatttcctttacattcttccaagaatgaaagacctaggtgcatgcatgctgtcgccttttggagcctggccttagctgcctgttgtgacccctgacctagcctccgtaagaggcaggaccctctgcaaagctggcttcgggtgtcattgtgcagagagtacaattttcctaagttgtaggaggaaaattagtagggttgctggagacttatccatcataccttagggatggtggacaatggaatcagagcagtattctagcctgtttctgtgtataaaggtgatatgggacaagtactgctctatgcctgcagaatctggacacagcagctccaatggctttgctcttactgtgtgaattagctggttttgtgtgtcaacttgacacaagcgagagtcatcagagaagaaggagctcagttgaggaaatgcctccatgagatccagttgttaaggcattttctcaattagtgattgatggaggagttcccagcccatggtgagtggtgctatctctgggctggtggtcttgggtcctataagaaagcaggctgagaggctggagagatggctcatcatttaagagcactgactgctctttcagagctcctgagttcaatacccagctactacatggtggctcacaaccatttgtaatgtgatgcacttctggcatacaggtgtacacataaatagaacactcatacattaaataaataaattaaataagaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattttttctgtattattttcttcagaagaggactccagggattcctcagcccttcacctgtcacagcatttccgttgtccctgtcacattaacctttaaccttggaccgagccacaggttctttaatatggcttggtactacttgagcaaactgcaaaattttgcaaataagatgggaattgaaaaggaccaatgaattatctgtctagaggccactgatgattcttcacaagcaagaatgagagacaagcacagttgtagcctcagagtcatcagggaaaaaacagtaaggcagagctaggggaaggggaccacacagggagctgctgttgtttgtcttgggtttgcctttactcttttggagacaaggtgagatcagtagccctggcttggaactcacaattttacagactagcctaacttgctgatcttccggcttctgcctctggagtaatgggattacaggtatgtacctggcctaaaaaggtttctcaactgggaaaataccagctttttatatgctcatgataataattaagaaaatctgataatacaggtaaagggctatccttaagaatatatccttgggtatgcgtaaaataattagcacataggatctactacattgatggcagtagccgtaagaagaagctattaatattaaccatacaatctaggtaatttgctatacattcatggtctagttgaggtattcctattaaaggtgaagagaaatgtagcaaactttggcggggggaccggagagttgactcagtaggttaagagcacttgcttctcttatttatgtaggaggctccagtttgcttcccagcacccacatggcagctcataaccacgtgtaactcctgctccaggagctccaataccttctctggcctttgcaggtgtcaggtctcaaagaaacctgggacaaagagctgaggtgcctactaacatatcagggcagaagcaggagcccagcattacctaatacctatagcttctcccagctcttctcaccccagctcctaccctaaaccactctccagtgggctcagcttcccttccttcagcttctgaccctacagaactcaggcatgttggctactcactcccttgactcagctcttggttcccatgtgctctcttggtccacccccacccccttccatgctctccccaccgctcccctctatgcccgtctatactgctggtcagattcagtctggacctttctagtctgaactctccctcatatctacaataaaggcttcccctcaaccctaggtaagccctgacctcatttacattcgacaggcaacacacaaaaatggtacacgcgcatacatgcaggctgttacatgtttgttagtggcaatggaaatgatggaggagaaaaggcaaagtaaacaatgtaagagagaggagaacacagaagagaagccatcgagtatatgaaaaggaatgcaatccagtgagggacttcagggactcaagtccaatacacagttcttaatagagacagggtttctctgtgtagccctggctgttctgaaactccctgtagaccacactggtctccaactcagagatccacctgcctctgcctctcaagagctggggttaaagccacgtgccaccactacctggtgacaatacattctaaaggtgaaggttggttgtaaggatatatacctaagacctgagtgaaatggtaactggaaacagttgaggctctcctttataaactgcctctacttcctctttaagatatatatatttgaaaaatatgctcatcgatttaaggtgaacagtggagggcagactggaggtttgggaagatgagcggaattaagtgtagaaaagcaaacgctcttcttgcagatgccaccaaaacagacacttcaccttagaactcaccatggtttgggtgttcttctttgtttgagtctagcctttaatggctgagccatgcctacaaccaggttctgtttttctttagccaatcgcagctgcctgggtgctggtgtggagctggaaggattttaccagactggaaagcaagtgtgaaggaccaaggaacgagcaatgtaaaacggattcatgaaatttaaaatggagggttaagtgaaagagagttaaaaggtggcagggactcgggaggcaggaacaaaaagggtcaataagtcaagtctagcctcggctagatgataaaacgctatttctagggaaggaaaaaaacctataaggatgaattataggtcttgaaaagattgaaggtttgaaccaaggttcgtaagtctggttcgtaagtctaagatcgtggaaaactgaggtcaccgttatgctctcattcctagcagggcatttaccagggaagtttgggtcaccccttggtagatctccaaagcacattccactctgactcctttgtcagagaagtttaacagacaaaagtacagctctcactagctcctccaccctatccaccctgtccgccacttctagcctggggcgggctatctagagggcggtccctctcaaactcactctttggatccgtgttgggcgacgctaaccgccggcgaagcacgtctttccagtccatggttgactcccgctcagaggaccctacatttgcagtttgttaagagctccacccactgccagccgcgacgtcagacttcgccaagacaggtggaagttaattaggacgcctggacgccatcttgggcacgggcggaagccttggctacaaaggaaaaaaagaaaaaaggaaaggaaagatgctgtagctattccggatacggcgatcacgctagcatggacgaaaatcagacatgaagtagatgaaaaaattatccttcttacggaggtgtcgcagctcaccaagccggatttctaaaggccagaagaagcctgcgtgacttcttcgcttgggcatttagcgcgtgcgcgccacaggttacgggactccattgccatttccgaattgagaaaagcattttcgtcacattttgttctttctctggaaaccttaaccgttcctacgatgtaatagacgcagcggtatccagccctctcggatactaaaagtttcaaaattatcctggtttgtttatcttctcagtactcaacagaaccctggaattcaagcgctccaggccccagcaccacgttcagcgcggtgcgttgtgggtattgtagttttcaccgcgtttatggttcctttaagcatgagtggcgtggtgagttgtttaatgaagtgaacttcgtttgtcgaccctccgtacagttaagtctgagctctttctggacctcacttccttccctatgatgtttatgctgcatttccatggcccctcttctccgaagagttttgcggcccggagagagttgtgaagagcaagggaccctagactggcttttcttgctactgctggggctgcgattggtggttcctgttcgttgttatttatttccctgttctagctcctttggtatcccgcccctcttcgggaccatcataatccacacgagtcaaactgggagtccatgtgctttttcctcagattcgaaaattggaaggtaacaggcacttcaggattcccgttccgccttctggtttagggattgctactggtgttggacgtctttggatccttatttaataaatagaacacgtgtgctttccttaccattacatcgctccaaacacatagtcttgatttgtttgtaacggagaaacaaaaaaagtctcactttcaagaactgcgcttccatatcctcgggcccccaataccttaattttacgtagtggagtgaaactgttttatttttaagtttcattcaactcactgcagcatgaccttctatttgtctggttttcggagcatcccgaaactttggaagagcaacccttactttgagctaggccctgcgacctcttctacccccttctttctctgtgccatcgggaaccaacaaagatggttttctgttaaacctactacccctccaaatagcaaagcactcaatctactggataccaaagctaggacacacaggaaagggaatgacaacaatgggcaggtttcttctgatcctcattacttcgctgctggagcagctaagaagaggtcccacataggtgctaaccctcagaatcaaggtcatgccttgcccgtgagaagctctgtccaacttccaactaaacctttgaattccgcagagtgggataaacttaaagaagatttcaaaggaaaggccagttttgaagacttcatcatttcacagatggcacgcaactgttgttcagtagatgtggccaagtctctcctggcttgggtagcagcaaagaacaatggcatcgtgggctataatctactcgtcaagtatttatatctctgtgtctttcataagcagacgtcagaagttattgatgtctatgaaatcatgaaagccaagtacaagagtttagaatctgggggttatacccttctcatccggggattgatccactcagacagatggagagagtccttgttgctgttagaagacattaaaaaagtcatggtcccttccaaaaagaactatggtgactgtatacaaggagccctccttcatcaagatgtgaacacagcttggaatttgtatcaggaattgataggtcataatctcatccctccgttggaaactctaaaagccttctttgattatggcaaagacataaatgatgatcactattcagacaaactcctggacatacttttgtatctaaggaataatcagctgtatcctggagagtcatttgcacacagtataaaaacgtggtttgaaaggtaattttgattttgtgtatgtgttgtttattagttgctgagactgactttattcagcttataccttttcccatcttgagataatcgttatttctcctttaaaacacaatattctcctaagaaagtaataggaataatttgtgtcactcgctacttgtcacataaaaggaaattatagcgcaccttctgtttttatataaacagatctcttccttttagaactatattttattttctgaggcatctaacatgaataacgggcaacattatagcaagtaaaggttctgtgtctctgtgtgggcatatgcacatagcaacaatagaggttgattttaggtttttgtttttcgggagttttttgtttgtttgttttgtttttttgagacagggtttctctgtatagccctggctgtcctggaactcactttgtagaccaggctagcctctaactcagaaatctgcctgcctctgcctccagagtgctgggattaaaggtgtacgccaccacacccggctttgtttgtttgttttttgtttttaatcaaattccaacttttgagacttttgagacaagaggctcttactgagcctggagctcagcattttgtctaaactcacaggtaaggaagctgcctgtcttcacacccatattgctggggttacaggttcaggctgctctgccaggcttagacatgggttctggggatctaacctcagaacttgcttatgcagcaagtactttaccggatgatcatatccttcttttcaaaggataactgaaataatgtgcagtaggtaggctgtagttcctgtgtttcatcacttacagtgattagaatggatggggcagttcctgatactcaagcattagatggagaaccagccttccatttcattttgcgccttgtcttgtttgtctattgctttgactattaaccacataaatatctactgcttctctctctctctctttctctctctctttctctctctctctctctctctctctctctctctctctctctctctctgtgtgtgtgtgtgtgtgtatttccaagaagccctgcctgtcctggacatggtttgtagaccaggctggctttaaactcagagattggcctgcctctgcctcctaagtgctaagattaaaggcgtatgccaccattgcctggctgcttcagtcttttagtctgttttcttgacccttattttatttcaggtcatttgctaaatgttctttcttttctctctttttatcatatatcatgtttacagaacatgtttgattatcttaacatacttgttgaaagaatgtgaaagctatcatagaaagtattctgaacttctcctattcttccttacagaatgtctgtacagtgaccatctgtctttaggttcagcaggaatttttaacttgtggataatttggttttgtaattttttttttggtagtatccctggaagacaatggaaaggacagttcaccacaattcagaaaaggtaaagacttttatttgtttctaatatgtttgattctgatatagtaagttctgttggcattgacttaaaaataggaaaggctggagagatgatgccgaggttaaagctgttttactcttccataggatgtggttcagttcctagcgctcatctggtggctcacaactgcctgcagttctagttttagggatcttctgccctcttctggcctctgcctgtacctgcactcacacgcatgtacccatacacactcacataaacatataattagaaaaataaatcttaaagccaggtgctggtggtggtacaggtggcgctggtgatggtggtgctggtgctggtgctggtggtatggtatacctcttgaatcccaacactcagaaggcatcagacagattatgagtttgaggccagccttgtctcaaactgtctcaaaggagaaacctgtctcaaaaatcaaaaacaacaacaaactctcctctacaccccatcccccaaataaaaacttcaaaggggaggggagcttccagtaatttaaaaaaaaaatgtttaagaacatcttaaggataggataatcaagaatttataattaaatttcctgagaggtaagccatcactgttgttgttttgagagtcttgatttatagcccaggctgtttcaaacatacaaaaagccttaacctttaaagtgttgggattacagtcatgtaggcagagactttggggtgctcagaacatttttcctggtttgtgttacagcttaatggtgtttgcccttaaactgcagaccagttgtgttctgagaattactttaaaagtttcatctggcgcctgccatcaccacagtggtgtgtgtgagttcatcttggctgatgctctcaagagctctgacagtgctggaaggctgggggggggggtaaacacaggtcctcatcaggctgctcttgagttgtcagattctaactgtgacagagctgggaaaattgttgggaaccttacaggcatgtggcgtgatcgttctcagatctaaaacacagaaaaatagcagactattccactcccaccccgtcagtttccgctcccaccccgtcagtttccgctcccaccccgtcagtttgttcattgttttagcaacctcgattggcatcatgaagaaagaagacaaagacgaaaggagagaaagccctaagactttttctttaaaaaacaaaaacaaaacgaaaaaaactccagactttagattttcactttattctgtgtgaaggtcagtggacagctttcaggaagtcggttctgtccttccaccatgtccatcactgggattgaaataaggctgccaggctcgacagctgtattcatgatatgttaatccactttaacatatcctccaatggtgctcacgcctcctctacacccgcccaattgttttggattcatgaatgaaagacacacacacacatacacacacacacagccttatttttaatatgacgtaagcagctcaatgccagccaacacactctctcctatattcttctgttgttactttctaaagtgtatacttcatttctgctgccccagacccgatgaggatcgagtgggccactcgaccccgattcctacctagtgtgtgctgtctctcctgcagctctcaggcttgatctttctgcttccctgtcgtcgtggcgatgctccaaactcttcttccctctactcccttgcccaggaaacctgaagtcccacctttgtctccctgctcagccattggccgctggcaactttatttcaccaatcaaagccgactggagctagggaccctcagcatcttacaggtggacgtgtggttcccatgtaattttgggagcagaattaacacaaaaagcgttagaaccaatccacaacaactgtagacacctttacccactgagccatttttgaagcccctatggttctcccaagagtgtaaagcatgcatatatatatatatatacatatacatttacatatacatatacatatacatttatatatatataaatgtgtgtatatgtatatgtacataaaatgcctttgtagaaaaaaaatttttgttttttatctagatgcctagagatcctctctcttgagttttctggcatactgatagatgatatcttcaggtttataaaaaaaatcaaataaatgtgattacaaaggttttcatttatatatatatatatatatatatatatatgtatatgtatatatataacgtttccattttcttgtgctttggaattactcattttaggaaaaaaattattttctaagacattatttaatagaaaacattgcaattacagtggccagtgctcaggctgtggcagaactatagagcctattcatctgagtccagaagagtatgagtttctgaaggaaaaaatcatgagggatgtgatagatggcggcgaccagtataagaagacgacacctcaggtgagtctgactgacggctccactgtgcccttagattgcttttctggagtggacaaaagccaaagggcaaatatctggggctctgcgagccatgcaagtctcttgtaacgttttggtttcgttatagttaaactagcagtggacggtatatagatgactgattgtgaccgttccattaaaactattcaagaggactgggaagatggctcagtgggtgaagtgctttctatgccagcttgaggaccagagtgtaggtgcctaacactcaaggttcagtgagagggcctgtctcaagatttaaagtggagagtgaggaaggaagactccacgagctttcctctagcctctacacgtgcttacatgggcacacacactctacacacacacacacacaccctgcccctgcagtaggctagacagtaggctagatttagcccagggttataatcgtgtcttccacaggttaattttagagttttgtagaataaactaaaatatattacaatctatcgaagccaatctgattctatctaactataatttctgtgtccaaatagttgggtgtgggtcactgggactcggggagactgcacctttttttcttaaggcttatttatttatttatttatttaatgtatatgagtacactagctgtcttcagacacagcagattccattacagatggttgtgagccaccatgtggttgctgggaattgaactcaggacctctggaagagcagtcggtgcccttaaccactaagccatctctccagccccatgcttcaccctgttacaaggcacggctgcttgggaggtgaaacatggggggcttcactgtgcttatcccgagccaccacagctaggcggtgctgggcttcaggtaagcaggctgaggacaacagctaaccctgagtgggggcggggggaggggccagctgaagcttagctcagcggtgattgtccttagcttggctgcagttgtgggctggaagcacagggcggccttctggggggggcggcttaggctggagcatggtagtcagtcgaagaccccctccatgctgcccttagcgaatcttgatgaaagagacagtgcatggttctaaactgtttattgtggaaaatggatgcataccattctcagggtgggcctgggattaaataccttttgcagggaggaatttccgggaagggaagcttattggctaaatcctcagggcctctaggtacctcattaccatggagaactctgttctggacctgtgtgaccacaggtcacatttccttatgtgggaagtgtggccagggatttgtcagggagcagggaggtgcctacagtcccaggtgtgagtttccagggtctcaacctgttctacccaccaagcttcccggcctggttcaccatcccactgttgggtgcttacttttttctctgagtactattttcagcaaattctacagggtttctctgtgtagctctggctgccctggaactcactgtagaccaggctggcctcgaactcacagaaacctgcctgcctttccccatttctggttagtgagtaacctgtgaggtagcgtcccgagaccctgctgatagctcgtcacctattaattaaccttttaccaagtgttcagcattgtggaaaggatgacattgttgacattgcagagagaggcttttgtccttattccacatctagtaactaacgctatgttgtatgaaatattttccctcttcttttttttgtcaccagtgcaaatgcataaggactctcatcccccccacccctctttctctctctctgttaggacccattgctatcattatgttgattttccctgacttggctagtgggagccccttcaagccagttcctgtctcttctgacccctgtccatccctatcctatccccccccaggtgctcctaccccagctgtggaactcctctcattggattctttggtttaacaccaccagtggctccacagtgctagcattcattttgttaaatacttacttattctaaacgaatagaaggaagagttgttcatttttttgtgctgatttgaactcaaatgaaatcttccccttggatactgttagctccagattccaggcagtgcggcagatagcaaaaggatttgatgtacttaatcagcccaactcacagagcagctgattctattcatagatgttggggacaattctttccttggctatttattggtatctttcccccttgcgtcctaattcttgtagtataagagaattacactattaaaaggtaatagctaccatatttaacaattactgtcaatgaaaaaaatgcagctctcatcttaaagggaatgttgtagtttactctggaatcaattatgagtgaccttggctcggaatgtagattcatgtgggacaaaaaatggggtcccatgtctgctgggagctagggtcactgggattcggggagtctgcaccacagaccccatggaactgctggacaggcactggactgtgagtagccgtgggataccactccgggggtgaggaaagggcacagtctagggtccccacggaactgccggagtctggctccgactctcaggtaccacagaccactgggtaccacagaagagccagttctggggtccctgggccacacggaggccaggaatgacaggttctcgctcttggacatcccagacgcatggtatgtttcagaagagctgagcacagagtgcggaccctctggtggactctggcctgggggctgaaggaaaaaaggcaggaaggagaggtctgacaggttaccgcagggaggagagagtctggctagctcatgtggctagcttggcagaaggcttgagttggtggcagccttgactggagcacagggaggctttccggcgggaggttagacgtgcggcttgttagagggaaacctgttccattgctccagcacggatccgatgaaaagagatagtccatggttttaaggcatttattgtggaaaggcaaagagtagaaaaggtcacatggagagaagagggaagggaggggaagacggagggagagaggctagagtaagagcaagagagtaagaggtaagagagccaggaaggggcaagcagctccttttatagtgggctgggctaccttgctgttgccaggtaactgtgggggtggagtccagatagcctatgtgactgatggccacagaattgtggagcctagtgtcagggagcatggcaaacgggccttctgtcccttgcagattaatctgctgcgtctccagggtttaaacctagctcgaccagagaacgggctgcctttcacggtcccacagactcagttgccccgaattccatgttccaatgtggtaacagtttcattacacttttgtaggaacaaaacaaaaagtcctaagtcaagatacttaaaaaattctatggtggcaatatcacacaggcaggctatggtgaagtggggagatttctgttcaaggcctcagatgccctgatgacattcttagcctttgggctgctggaagctaagtgtttgtttccaaaagtatttacctaatggtcacaaggatgttaggtcacacacagaagtgggtaatacatggctaattagaggcttaatataacccaagataattttaccctggaccttcaacattcttactttccataatcattggagatccaatcagtcagtcgaccatttagaatgttggatgtcggtacagcttttttttttttttcttggaacttcatcataactctcagccccgttatagccacaaaccccaaaaaacctcacaaggatactagcatttcgaagtcaagaagctcaggataaaaatagctgtggtttggatacatgtattgattcgggatttgatttctgcaggataggtaaggcaggagtgggtttaaagcacttctgtggaatgagtgaaaccaactcgttttgagcccaaagggaggaattaaaggtgatgggtaagctgggtggatagatgagataaagaacttggtgcttttgttcagacttctagtttctctgaagtgcaggaagcaaatggctcatttaaagggaagaaaaatgacggtggccttagggaacttgaagagttaacgtcctggaagtttgggctatttgtgaaatgatgcatcagagtatggctctggtgccccagcaggggctggagggcatgtaactaacggcatcgatctgtcacaaaaaagccattgtggggctggtgagatggctcagtgggtaagagcacccgactgctcttccgaaggtccagagttcgaatcccagcaaccacatggtggctcacaaccacccataacaagatctgactccctcttctggtgtgtctgaagatagctacagtgtacttactataataataaataaaaaatctttaaaaaaaaaaaaaaaaaaaaaaaaaagccattgtgaagtcctggaccatctagctatgggaacagaaaagacaggtgaatatgatggtgtgagcagagagtggggatgggggtggtcaccggtggccacaggaatagcaggttaggctgtaccatcagggccaagttcagccttgaaccgcagcataatgaacacattgagtataaatctgcttttgaaatgctttcttaaaaataagaaagagatgagttgttcatggctagagagtgctaggggctcagtacttaagagcacagactgcttttccagaggtcctgagttcaattcccagcaaccacatggtggctcacagctatctgtaataggatctgatgccctcttctggcgtgtctgaagacagcgaaattgtactcatacataaaataaatgatgatggtgccctctgacccctacaagcacctgaaatagacattattgaagctgttttggacttatgtgtttccctcaaatagtactttttgttcaaaataatataaatgttcaaaacaaaataaaggagctggactttctactgaagtttctgttctccctagttctggttcaaacagtgcaggagtgtcttaaacattactgatatttgagcccccgcccccaggacatttctatttttaattcatttatgaaggtttatttttatttttgctcacttgtatgcctgtgcgtgtggtcgagctgggatgttgtgcatatgtgactgctgggcccacagaggccagaagagggcatcgcatcccctggagctgaagtaaggcagttgtggatgctcgcttatctgatgagccccctctccagctccagacttttatgttttaagtataactttactagactatgtctggcacagaagaaactgcacatagagtgtttagcatggtgagtttggacatatgtgcttgctatgcaagccagacaacctgagtccaagacctaaacctacagtggaagaggaaaacaaattctgaaagttgtcctccagtttcacacccgtgtgtggcatgcacctgcctgcactcatgtatgtacacacacacacacacacacacacacacacacacacacagagataatatataaaataaaagttcccgttatgtaaatttcccatgactgcccattgactttggactgatgacttaagatgacagagattattgtcgcacagattggacactagaagcgtgaaatcaaggtattgccaggctgcatctgaagactccaggcaggattccctcaggccccgggttccagcttcagacaccgtccactcctaaacactctgtattctcccctccatctcctccctgccctaacgatcctaatttaaccccctggcttggaggctccaggttcttggttttccagagctcccagctgactttcaagtgcagctcgggaagggaaccatcgatcgtagtgcaagattttgataaaccttactgcatagcagctttctatgggggaaaggaaacatctccaaagacgagcaaagaaggcaacttttcagtttttctgtttttagttaactcattgtgagacacagcaatattctgttttgtttgtttattgttgttatatttatttctttatccatccaagcaaggttttactatgcagccctggctatcctggaactcactgtatagactaaaactggctttgaactcagagatctacttgtctctgcctccctagttctgagactaaaggcatttaccaacccaccccaacccccagttgggttggttttgttgttgttgttgtttgtttgcttgcttattttaagacaaggtctcggcatagccttggctgtcctggaactcactgtgtagagcaggctggcttcgaactcacagagattcatcattccctccctaacccccaagtgctgcgattaaaggtgtgcaccacttcattgagcacaaatttgatccttagctcgggttgcctaatattaactattagcccagtctggctttgaactcatggcaggctgccagcctcacctctccaacaggcagaattttaagtgtgagccacttcctgttttaaacattcgtttgtagttcttagacaatatggccaccaggtggcaatagagtaccgtataaattccagggtaagtcaatcctgttgaaaagatttgcaagtttctcaaactgacaggtgactgccattttgttttcagttaaggagtattgatattctttttttgtttttgtttttgtttttcgagacagggtttctctgtatagccctggctgtcctggaactcactttgtagaccaggctgacctcaaactcagaaatctgcctgcctctgcctcccgagtgctgggattaaaggcgtgagccaccactgccggcaatagaccactttttaaaatagcaaaacaatttatatttagaagtcgccagctggacttaatgtacttgattccagttttgttggtaatgtccacagctgctattagacgtgagatgagcagaaatctctccagtgttctcatcttggcctcctccttgtcagttcaatgagatgtgacctgtccaagtgtggtgctcctaattagccagaattcgatgttggcgtaagtacagtggtccagattgtttctcctcgggcattcctcgtggatactggcacttccttgggagctgaacgtcttgagaagtataaaatacagaggtggggtggtgaggttttaaattttctcgtttgttgttaaagataggttgtcaacgctcatgttagcttcacattcacagtgtagtccaagctggccttgaactcaccattgtcttgccttctgatgctggaagtacaggtattctccaccattcccagcgcaggctatgcctttttagctttgaatttggctgttcgagagatgtgggtttctgcgctttccaatatcacctttatttattcatttttaatatatatgtgagtgtatgtctgtgcactgcttgcatgcctggtgtctgcagacgacagaggagggcatcagatcacctgaaactggagttacaggaggttgagatccatctcatggataccaggagctgaactcatctctttttttttttttttttttaacaaaatctcaattgtttgattttatcaatgaagacctgggagccagatgctggggtgaagccagcgagctcagagaggtagagaaagcactcagctgaccttcctcctcagccagtgacccataaggaattcccttctcttatgcctctcaaaaacccttctaaccgaatgtccctcccttctacttcctgtgtctgtctgtccttctgactccctcttagtctctatgactttttcttatgttcacttcctgtcagctggttgcctcttgacctgtggctcactttacttaaccctgtttacaatattcaggcggaaaccttggattaaaggtgtgtgctaaggctgagccacatcacaatggtttggtttttttttttttttcctaccagtaaataacacaatcttggggttcacaatgtgattaaatatcctgcaacacctctgccagagcaactaataccgttttaatgaaagagttgacagccagctctggctgagctgaaactcttatatagaccagggtggctttaaagatttatttattttatgtatgtgagtacactgaagctgtacagatggttgtgagccttcacatggttgttgggaattgaatttaggacctctgatgctccagtcaacccaggttgctccagtcagctccacttgctcaggcccaaatatttatttattattataagtaagtacactgtagctgacttcagacatcagaagagggtgtcagatctcattacaggtggttgtgagccaccatgtggttgctgggaattgaactcaggaccttcagaagagcagtcagtgctcttaacagctgagccatctcaaaagcccagtgggttacttttaattgttttaagttacaggacagagatcccagctggacactgtagatgatctaaattcaactcctcatcagtctctaaaactttctcttttgcgtttaaagatctttctgtttctattgatttttattagatattttctttatatacatttcaaatgctatcccgaaatttctctacaccctccctccgcccttcttccctacccacccactcttgcttcttggccctgacgttcccttgtactgaggcatataaagtttacaagaccaatgggcctctcttcccaaagatggccgactaggccatcttctgctacatatgcagctacagacacgagctctgggggtactggttagttcatattgttgttcctcctatagggttgtagaacccttcagctccttgggtactttctctagcttctccattgggggccctgtgttccatcttatagatgactgtgaatctttctgtttttaaattaagtcatgtggttcccagatttttttaaaaagaaaaatgtgataaattctaagtgtatggtgtatgatgcccatgcatgggtgacttggtttttttgtttgtttgttttgttttgtttttatgtataggagtacaccatagttgtcttcagacacaccagaagagggcatcggatcccattacagatggttgtgagccaccatgtggttgctgggaattgaactcaggacctctggaagagcagtcagtgctcttaaccgctgagccatctctccagcccgacttgtttttaataactaaaagacattttgcgccgtgcacctgtgacagtcattcactgaacttatccactttctttcttcttccactcacaactgaaaacctgaaggtagacacgtgatccctgggtatccaagtgtgtcatggaaaggagtgtgattagaaaggtggagtgacagggaagattagtgaatacaggcaggctgaaaacttagaggagaacagtcactgcttgtggtggcagccttcactccgatgcattcacggaaacactctcgtatgagcattccttgtgaaggcctgcttgctgcctgcctgcttgctgcctgcctgggaattccttccctaattctgcactcctcctccttttcctcctcctcttcttcttttttttttttttttttttttttttttttttgagacagggtttctctgtgtagccctggctgtcctagaactcactttatagaccaggctggcctccaactcagaaatccacctgcctctgcctcccaagtgctgggattaaaggcgtgtgccaccacgcccggcttgctcttcatttttttctcatttggttttcactgggtttttgaaggtttttattttatgttatacatgtatgtctgtgcaccacatagaggacactggattccctgggctacagatacttatcagcctctgtgtgggtactgggaattgaacctgggtcgtctagacaacagctggtgctctgagccactgagccatttccccagcccccttttctggaatttcaccaactagagtccaacctcttttatgagattcaatttgaaacagtgcacttttttgtaccttctttttaatgcacccctgaattctgctttacagggtcaggagtgtgcttggctcttttagagttacattggtggtttttagatatggagaatgttttaggggcagatctgagaggagtgctggactagaaggtacgtggatggaatgccaaaagccaagggataaagtcatgtttaggcgttactgcattgctaaagaatttaataagatattttctttatttaatacatgttaactatgcactgtatttctggcaatttccacattggattatctttgctttaagagattaagatttaataaaaagtctggtggctcatgcactttggaatcctagcactttggaaataaaggcaggagttcaaggtcatcctccactacacagtgagctcaaagccaggctggcctacaggagatcctgccttacagacactgatgagtgaatgaacaaatgaacaggtaaatgagtaaatgaaggagcattttggaaatatcagcttatttaacaaatttttttaaatgtaaataatgtgtatgtctgtgggaatctgaacacaagtgcaggtgtcagaagaggcagaggtgtcgtctccctgctggagctacaggtgttgttcagaatcaaaaagagtcttctaggagaactcttaatcatgccaccgccgccaccacctccgccaccgcctctgcctctgcctctccaaccccagattctctataatcacggaaaagctaccttgctcctctcatttctgcattcctgatctttaaatagagaagactggcccagggaccagagaggtccctttggagctgttggatgttaaggtttcctgttgccaggaagcttctttgtctagtaagaagacactacagccagctcccccatggagcagagttgcagttagaacatgggaagttgtgatttgggtgtgtgcagttgcagtcaggttgcaagacaagaaaggcacagcagatcctcaggatgtgtccgctgtacaaagctctattgaagacctttggccttcctttaggaaatgtgaagtttttacatacagagcagagtatgtgatgcctcagacttcagctttagctgtaggtgattgttctgaaggacttgaagagaattaagaattagagagaaagagagacagaggagacaaggagagagttgagtaaggtattgtggtgtttcacaggcgtactcctagcacacaaaaggctaaggcaagaggattgatcatgggttgaagagcagcctgagctacatagtgagtctcaggtcagtctaggctacatgaccttgcttcaataaataagtaaataaagaaaataagctgaaaataattgatggagtagatggggttatatacaacacaaagtcggcgtgcattctcaggtcaagtgagtttataggctcatgggaatttattattctctctcttgtatatgatttggattgccattacaattttttttttaattttttttacaattttgcggtctgaagccctgagttcagttccatggcaccatgcagatgctgaacagaggcacacatctgtaatcccagttctagggagggggagacaggtggatcccaggagctcactgggcggccagcagagctgagcctgagagctccaggtgcagccacagaccctgcctcaaaaaccgaggcggtgggtttactcctgaggacctacatggtgaagagaccacctcccaaacttgtcttctcagcgctacacacacactatgatacttaagcatgtgaatacacacactgaatacacaaccacacacacacaataaataaatcaataaaaaatgtagtgatattaaaataataataaagtaggaaatgattgagaaagagacgtccactggcaacatctggcctctacatggtggtgcacatacatatcacacacacacacacacacacacacacacacacacacacatccatacgtcctgcacacagagacagaggaagaactgctgtcttaaacaaatgcacatgcacttgcaggtaaaagttatggagggaggttttaaaacagtgcattcctcgcagagcaacatccttctatagcatcttcccttagttaaaactgtatacttacattcattgtaagctgaaaacaatttgggtcatcactgaagagagaaagtctcctttaagcaaatatttagaaaatactgaaatttgctgggtgtggctgcaaatgctttcaatcccagaggcagaggcaggtggatctctgtgagttccaggctagccagagtcacatagtaagactgtgtctcaaccaaggcatccccaaacctagcaaagtgtcatgtcaccgaacagtggtagtgtgttcctttttcttttttctttcttttttttgttttttgttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggtttctctgtgtagctctggctgtcctggaactcactctgtagaccgggctggcctcgaactcagaaatccgcctgcctctgcctcccaagtgctgggatgaaaggcatgcgccaccaccgcccggccctttttgtttttaaaacagtgagattccatttctgagtgggtagagtagtacagctcacctagctccaagtgggccctaggcaggtttcctattgcatcgcattgcttttgactgacaaaagttattaacctaaaaagcaaccataaaaaaccaataacctgcaggtgtgactccatggtaccgtgaaacggatagctagcgcagcgatccggacatcggtaatcccgcagctgctctgccgtggtttttgcgctggtgtgagctgcagagtggctctgggtggggaggcttccatgcagggaaatggagcctgagagcctctgccctaacggtactaattgggaagtgtgaggtgcgggggatttccatcctttgttaataaggtctccaggctcatttcctctaggctcttgcgtgggcctgagctgtgggacagctgcagggaagtgaaatgtgatttccggccctcaggagccctggcttttcatttggagattttataattgcaagagtggaatgtgcaaagctgacttgtgtggctggttaagcagtaggtttatttggttgttacagaattacgtttatgccagtcgtagctgtgcacagatgatttgaatctacagagagttgaagttgttgcagcaaccagcacttaatggcccactgctgtaatgtaagcctctgtttgctgctttggacctagaatggaacaatctcatcctgacaggttaacaaaagtgctggcctggccttcctttgcaggtccccgttgtctaaatgcttgtgctttgttgagctgaatgtttttcagagtctctgcaatgagaaaagctggcagggatgtatttcagggaaaacgtaaggccctgactaggtagagtggccaggggcagtcggaggagctgagaatgacgtgtacacaggaactatctgactcaagctgaagggtctagtcagagttaataccttcctgacagtctctgccaatatcttgaggcacatttgttcatttttccaaaaatatgttttggatgctgggatggtagcgtactctctaatctcagcttgctgttcaaaagatgaggcagggggatgaagaggtcaaggtcaacttggactagagaggctgaccctcagtaaataaacaaacaggttctcctggtactgccagtgcctgctgttttcttgcctagtaaaggaatgtatctttttctattctaagaagaagaaaaaaaaaatccacaaaatatatttaggagcccttgctgcctctaaacataggccagacctttgcagatagaaaattgtgatgatttcttcccaagtcacctgccattttgtttttgacattggcctccacagctgctgtcagagagacttcacatagttggaaaagagctggtgattattaagtgccagaatcgcctggtaggtcacctgtgaacctctggttacagagctggtgattacatcctcctgtcagctgtgtggtcaataaaactataaacaagtgttcaagtacaaattttgtttctattgtattagaataaaatttttttaaagatttatttattattattatatctaagtacactgtagctgtcttcagatgcaccagaagagggcttcagatctcattacagatggttgtgagccaccatgtggttgctgggatttgaacttcagaccttcagaagagcagttggtgctcttaaccactgagccatctctccagcccctaggataaaacttttaattgcatttatttaatggtgtgtgcaggtgtgcatgctcgtgtgtgctagtgtttgggcacacacatgggagcacacacacacagaagctcagaggacaaattccaggagtcttttctgtctttttaccacacgggtcctagggactgaattctggttatctgttttggcagcaatcacctctacacattgagctgtgttactgccctgatcctattttaaacaccaggtaactgtagctatatgtttaattatgaactcaactttcaaaaaatgaatgcttgctgggcatggccgtatgtgactttaatcctagcattgtaaggcagagaaaggcagatctctgtgagctcaagggtctacatgggagacataggccaaggtaagttacatggcaagactatcagacaaataagcaagcaagcagaaccaagtgctttgtaaatgcttcctcctctgtagttctcaagcctcctttggctttccttagttattccctccttatctgcattactggaccaaaaggattaaggctaattttgtctcctttctaaatcttgactttgtcactaatgtgatttttgcatcgtttctcacactggctctcctgttgcacttgcacgagctctgtctaggcctttagtgtcagctcagtatgcatcccacttcctgtctcacttgtgtatatggtccccttctaacatcttttttccccttctattgccatattggtctttctactgccatattggactgacttaatcatatcatcctttgtccaaaaatcttttgcagtttctcacacctatgctaaaggaaacctttcctagcttagcctatgtttcaggttctgactcttaacctctcctctccaaacacctgcttcagccagcacctagcagctctgggctacttcttagtgtcccaacccctccccaaatgtgttcttagctccaaatctttgaggctttcttaagtgccttttctgtcttttttcttgatttttttaaactaatatttttattaattatttgagaaatttgcacaatgtattttgaacagatccaccccctagctcctccttgatccactgcaccatgaaatccaatttatgttacccaactacttttgggtatggggtctgtgaaccaggtatcatacaattaaaggaaactgacccttctcccaacagctaccaagtgctagtatctcctcggtggggtggaacttcattcccactgaactgcgagggtccgtgtgtgctgtcacagtcattgtgagttcagatgcacaactacccgctgtgtctggaaaacagttatagtcacgcatcacctctgatgcctgcagtctttccaccctctcttccacaaagattcctgagatgtgaggggaggggaatgagatgtcccatttagagatgagcacgctatctaaagtctcctattctctgcgagttgaccaggtgcaggtctctgtcttagttgacatacactgaaagaagcttagtgagctgtgagctggtctctgtgtatagcaataagtcattagaatcatgatagtgctgtgtccatttagcacaattatagtaaagggctcttcccaagggcgtatgactatttatcctctggttcttggcctccttaacagttctatcttaatgggttctatctcatggtgttgtccttaaatccagtcagaaagtggttgctgtcactattctacaagtaggcacatcacaggcaggttgttattgcagtttgaagggttcagagttgagcgaaattaatggttactttttcacgcactaacatgcgtgctaccttccacctacctctacaaaagctagccagtagagagctcaggtcagcacccacttggtttcttcatgcttatgactcaagttagtggtctctgctacaatagtgtcttagaagaaattttggagggtaactaagagcaatagcaacatcctgtaatgtttgggggtctatgggaccactttggctaacaacacacaaaagaaagtgatccattcttattactggggcttttatataaaagcctgtggtatctagtctattttccccgttatggggtaactccacttatatatattccatgaagtttctacagtattgggtttccatatagcttttccagaggctcttttgtgttagttttccctccctatatcccctcctctcccctaccctcctaaccccgccccatctaaccccctttataactgtattctatctctgctcccatatctttctagacgtctgaagtctttacttgcttccttattagtcctgtgacaagaactctgttcttgttgttgagtttgtagtttttcatgtcagtatttgttcttgcttcaatgatactagaaactcctcaagggagtcgcacctcctgtagtctcctgaatacttggaactttgtaggtataccacaaatactgttactcatacagcacataagcagtgttagacttggtcaaagctactgttcatttagctgtgtcatgttagtaacagctttctagaagtatttcctttacagggagggaaaccgaggttcagaaaggttactcattcaccaacatcctacagtctaagcggtgaaggcagcattcaaacctagatctgctccctacactgtgttattttggggttagaaaagtattgctagccgggcatggtggcacacgcctttcatcccagcacttgggaggcagaggcagaggcaggcagatttctgagtttgaggccagcctggtctacagagtgagttccaggacagccagagctacacagagaaaccctgtctcgaaaaaactaaacaaacaaacaaaaacaaaacaaagaaaagtattgcttagcttgcatatttgcttaattatggcagaggaatagttatgtaatgagagttagtaatttttgtcaggaataatgaaatcaatttcagctctgtcagaggtcacagggacatagaatttcccttaccgtcatcagttactactgggccgactgactcacctttcggctcctggtcggtctgtcttttagttgttcatttgtttgtataagcaagacatgccggggaaccactgctgaggtgtgcaagcttagcattgagctaacagtgttcccgggaagccccgaccttatcgcttccatccgctctttctttttcacccagtccctttttatttttattttttaattttgtgctttttgttttttaagagaggatctcactgtgtaactcagttggatctcaaattcagaatcctcctgccttggtgtccagctgtgtgacttgcatatgccactaggcctggccttagatctactatgtaattattttaacaggttaaacttagtgttgtttctctgatacattcttccttcttgggtttttactcacacacacacctttttttttttcctatacctgccccctttttttggtatgtgcattttcattaaaggagaacaaaaaaaaacccaaaaaaccaggcatgggtatggtgataatctcagtcctcagaacacaggcaggagaattcctttcttttcttttaaaattaggactaaacgaaattagatgttaattgtttcatttgtatgagagcatctaaaactaaatggcctttgaagacacaactgtcttcaaaattacactttataaacaaagagctcacgtagctcaatgaagccggaaataaactggaaactgggagtgaagcttgtgtgccttggtaagaagaaaggagactagaaaggttgtctgtatggaggacagaagggaaattcggagtgagcacgcgcttaaatataacggagaagctgggtgtggttgcgcgtgcacatgcacccagggccagaagcaagatttctgctaattcaaggccagcttgatctacataggaagttccaggttagccatggatgtatagagaagcaggcacccatctactcctgtatacacaaaggagctcagttatcagcaggaaacaagaagtagggagaggtgttttaatagcctgtgttaaaagagagcaaataagtactgttggcaagcagttatttgaagcaattgaacgggccttttgtagcataaactttctgtcatgaagtcattctacttgtgtgtgtgtgtgtgtgtgtgtgtgtgtgtgtgtgtgtgtgtgtgtgttcgtgtgcgcatgctgcatgtatatgtgtatgtgttcatgtgcctttgctctatatatgtggaagtcacaataggatgtctggtatcctgctttaccactccctatgtcttattctcttgcaacagggtgtcttattgaacctgaaactaggctgacagccagcaagccccagcaatcctgtccgtaccccacctccatccccagcccctgagaagctctggagctacaggattgcatgtggttgttgtgtctgagtgcttttgagtgctggggatcttagctcgagacctcaagtttatgcagcaggtcctcttcttccccactgagccagctccctggctgcagctttattgcaccttcatgccagtgaaagatcctgacagaatgtaaaaggtcacagaagccctgaaattggcaaaatagatttcattgttagtagaactagcttcactgatttagaaaaatagaggtgcacaatgctcttgccgattctcgaacctgtgtgtctgccaatgttctgaccatgtgtgtgcccattgctgcgcctcactgccaggtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccttcattagactccttccttgtttccctcccatacccatttcttgaggcatcaatcattttagaatagatattgtttagatctggaaatcccctactaccccccttctccttttccccttaaggacctataaaaactgagaccccttttccctcgaggtcgtctcctctacccctgtgtgggatacgagttgtcctcagagctctggctttgagttgtccccagagctctggctttccctgaataaagcctcgtgtggtttgcatcaagcttggtctctcgtgagttcttgggggtctgctattatcccaaggcctgagcgaggggctcctctcggagtctttcaccagctctttgaggcgggcattaatagtcctgttttacaccagaggagctggagacctaaaaaagtgaggtgattggccaaggttgtatatgagagcagacagtccagctgatgcaaacctagataggcttgtttctaatgtagtttttttttttaagatttatttatttattatatgtaagtacactgtagctgtcttcagacaccccagaagagggcatcagatctcattacggatggttgtgagccaccatgtggttgctgggacttgaactcaggacctctggaagagcagacagtgcttttaaccgctgagccatctctccagcccctctaatgtagtctttttcagtcttaatagcttctctaacaactaatcatgtgcctgaccaaggtgataattttataatatccagttatttggagggtacagggaagatgactcaatcaatcaaatgcctgccatgaaggcctgggacttgagtttgggtcctcgggatttttgtggaagcccgctgtggtggcacatatcaataaccccaggatgggtgaggcacaggagcaggtggctctttagagctcattgagtggacaagccaaattgatgagctccatgctcaatgagagagcccatctcaaattaagatggacagtgctccaagaagacatgtgacattaacttctgacctccacatgcatgtgcagatatgtgcatgcattcacacactgtacatattggcacagacagctagaacacattcatatatcacatactatgtaaagtgcatatgcgcccgcgcgcgcgcgcgcacacacacacacacacacacacacacacacacacacacacatatacccacatacactttcatagaagaaatgaaaatgctgattttggccagtttttttcagaacaaatgagaaatctctaaagagtattaaaaagaaccttgatagccacatatatgattgcttttctttggaaattaaaaacttcatatgtgtatgtgtgtgtgtgtgtacatatatgtaatgtgtactaggtacacatagtggtcatgagccctggcatgcatgtacagatctgaggatgacttttggaagacaattctcttctttcactgtgtgagctctggggatggaaatcagctcatcacacttggtggcaagctcctttgcccgctgagatgtgtctcagactcttctctgtgaattctttttggatgttgttaggtagtgtttatctgtgtgtagcgaggcagtgatgtctatggacagtgccttgagttacagcagttgaaagctgtcatatgcttgctgttttcctatagttctttatctcttgcctaaaaaatctctgctgatggtaaagtaactggtttgttgttgttgttgttgctgtttgtttttgtttttccagacaaggtttctcagtatagctgtggctgtcctggaactcattctgtagaccaggctggcctcgaactcagaaatccacctgcttctgccttccaggtgctaggattaaaggtgtgcgccaccacacccggctccattttctgtcttcttacaagtaagcttttctaattttaattttgtttaatttgggggcagggatgctgggatccaacccagggcctgtatatgtcaggcaagtgctctaccactgagctacacctcagaatcggtttatttgagtcagggtctcaccatagccaaggttggcctcaaattaaacacctcccagcttgctggggtcccatgtatgtgctaccgacacctgactacaaaaatctgggagggtgtttatggcaggacattttgcttttttttttccttatcttactgaaatcagtaaactcagataggattacaaggtctcatggttacagaagggctcggttggcctgagttccatctcctcagcctatgtaaaaatgctggatgtagccgtgtgcatctgcattatcagcactgggaggcagacaggatgacccccaccccaggcctgtttacttggtgagcttcaggccagtgaaggacctgtctcaggtgggttgtattcctgagaatgatgcccaagcttgtcctctggccttcacatgtgtgtacatgcatacacatttgcacacatggagctgcacatgcatgacaatagacacataaaaatttttatttataggtccaagaggctatcacactgtagtagttgcagctaatgaagcaactgtgggaaattaaagtatctcttgcaacttcctattacatcgtaagtctgagctttctaaactttctactttgataaggtttgaggaaggcttaagttctccggcctctgttttaactgtcaagctctaatggtactttccagatatgtggtttattttcttatctacactaaggcagttgtgctgttttttatagaagttttccccaattcttgtcttactgaagggactaatccagcttacagacgagccacgatgcagatgctcttctagtaagccagggtcttccgagaacgcaggccttcatggtgaacatgtgttatcagtttggagactgtcctgctcctgagtttctgctgtggccgaatgagcctcaggtacagctgcaagatgtaagccgcagcatcaggagctgtagctaccaagagatgcacctgcaacttccgtgcttacctcatgtctagctcctcttgtacctgtctcagtgttagggattatctgggaaccatgtctgaaagaagtcacataaggtaggcatcaggtgggaagatattttttattgatgttcccatgttaggaacgctgcttgtgtccagaatggctggtgttcccctgcgtcttcatgtccaggatgactaaagccagttgcttcagtgtccccttccttcttctcttaaacaatgctgtgcctgcagcacattgatacatgttaagatcgatggtctcagccggtcatggtggcccacgcctttaatcccagcactcgggaggcagaggcaggcggatttctgagttcaaggccagcctggtctacggagtgagttccagaacagccagggctacacagagaaaccttgtctcgaaacaaaacaaaacaaaaaacaaaacaaaacaaaacaaatacaaaacaaaaaatcgttggtctccattcaggaggcagaagcaggcaaatctctgtgagtttgaggccagtctggtttacagagtgagattcaggacggcctgggctacattgagagaccctgtccaaagaatacaaaaacaaaaacaaaaacctggtctttttctgttgtgaagtttgggatatgttgattggtgtatcttcttatacccacgttgcccttctagaatatggcactagctagacaattagagaaatttgtatcagaatttaagaacagaagtaaaccatggattatcatcctaaattgaagagaaagcttgtcatgggggctgaggcatggctcagcagttgtgagcacttttagagggcttgggttcagtcctcagcacccacatggtggctcacaaccatctataactccagtcccagaagatccagtgcccactagaagaaagaaaaaagaaaaagagaaaagagagcttataatttatttctttatttccttgtttgctgcttttaagacagggttacactctgtagctcaggctgacctaaaattaactacattccccaggctatcatagaacacaccatagccaatccagtactggcttataggcctaagactagaacatttgtttattaagaattttaccatctccacctaccaagaaaagtcactcactcaacgtgttggtttcccctcacataataccaggagaactgtaaccagagtcaggttctgccttgcggggcttaaggcgctcttgttatgaatggactctttcctttgttctggagctcatgtgtccgttttaaactcctgtttcttgcttgcatgccttagtctgcctttactgttacttacaacggcaacagtacagctgttctgccccattgtctcatgtgaattgggtaaaaaattcaaaacctcttattgttttagagtttattttacattttgtattcttccaatcttatagtaatgagcaagagtttctcttttttttcttaatttaaactcaagagatgcatacacgttttgagggtacagggtgtcacatagctaaggctgcctcagattcactgtgtagtagatggccttgaacttctggtctcccaaatgctaaggttataggctgtatgtctttatacccagctttttatttttctaagaaaaactttaatcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaaaacccgaaaagatctcatgtcttcagactatacatatggatgaccttacatctgtgatcttcaccttccacctgcacagtgctgaaattacaggtgtacactaccactcccattttatgttttgtttttgagacagggtctcactacatagcctgaaacccacataaacctgtcctttgcctcccaagttctaggatcaaaagccatgtcctaaaacgttatctgttaacaactatgcatgcgcatgcttgtgaacacttgtgagtgagtgttggttctcttttccaccctgtggattctggaactttaaccccaatggtcagggtaggcagcaagcaagcacccttacccaatgaaccatctggccagccctgtacattttcttatttataaccagtgttagtactgattttacctgcctgatttctgcccaaatttgtgttaacagcctctgtaaatcatatttacaaatcctttatggttatattttaaattaagttttaaggcataagatgagtaaaggcagtagaagttctgatggtgatgctttcctgtaatcccagtacccaggaggttaagagaaggggattgtgagatgcagcttaggatatagaaaaaacaaacaacaacaaaactaccaccaacaaccaaaagaaccaaccaaattaaaaagcaaaacaaaaaacaatatgttgcaaaaaggaaaagctgctcgtatgtcggtgaatacatgcaatgtttcacatcagtatagccaagagcgtgatcatcatacagacatctgcattggtgagaatgtggagcaattggaaccctatgttacagttagaaagtaaaataggacagccactttggacatagtctggaacaggactagcgtgctatctgacagattgactcctaggtactccagaagcaatgaaagtgaacatccgtgcagagctgcacacccgtggtcacagcgaaatcgtttctcagtagcccaaggcagaaccagcttgctccccagctgatgatgggtaggcagcatgatagacatgacgtggacttctgtgtggcaggaaagagtcaaagtgttgacttatgctgcatatgaataagcgttgaaaataccattctccatgaaagcagtcacttactaaaatctctgtatgtatgattcagaataggaaaattagggagacagaaactaggttactggttgggggctggttataggaggctgggggcagggaattgattgccaatgagtatgggttagtttttttttttttttttttctcctagcaaggacaaatagtttaaaagtagattatggtgttattgcaaaccctgtaaattgtatcttcaaatggataaatgtcatggtatattaattatatctcaaactatttttttaagatttatttatttattttacttttttgtatgggtatacagtatctgtcttcagacacaccagaagagggcgccagatcctattataaatggttgagagccaccatgtggttgctgggaattgaactcaggacctctggaagagcagtcggtgctcttaaccgctgagacatctctccaacacctcattaaactttttttttaaaaaaatagtgccagccaataaataaaggattaataaatatatgggtagacttttttcatatcctagatcattggccaatgtacatttaagtataaacccaatatagacatagaaagaaataatcaattattctttgatttttgttggtttattgggtattttgttttgttttgttttgttttgaatagggtcttgtgtagcccaggctgccccaaactccgtgtgtacttaagcatgaccttgatcttctaatcctccaactccaagtgctgggactgactgcaggcaacaccgacaaacacattctgctctggtttcagatcagctcccttgagagctgccgctgccgagcttgcaggcttgtagtgctctgtgctgtctttggtgtgtgctatgtcaacagagcggccatttctttctttgccacgccttatctgcactagctacctagtggcttttgaattcattaaatgtatttcacaggcttaaactctcaggacagcctgatctacatacatagcaagttccaagacagctagagctacataatcaaagacaccgccccccaccccccccaccccccccacacacacacactcttagtatattgttgcaatacatctccaacccaaatatgccctggcaatgaaaacacaactcaatatgaatccatgctgtgtgcctagattgggcagatctaccactacactaccatcttccacatctatgagaccccttagaacttgcggtttctccaggccatgtgcttctgctccacttttcttcttcctcctcctcttcatcctctcccttttctattttctctctctctctcttttttttttttttcctgagacatggtttctctgtgtagccctcctggaactcactctgtagcccaggctgtccttgaactcagaaatccgcctgcctctgcctctcaactactgggccaccactgccaggcccattttctccttctctttctcccccttccactccaccttccttttatctgcccaatcttcagctctcctttattttaagattaaggtgggaagcaggtttacaggaaattacctgagtgctgactcattccttattcacagccacactctggagaatggaattaacatcaaatataattagccccagggctatccacaacacttccccctttctgtccaagtagaagactattttatctcagatataattgaacataactattattattttgtaatttataaagtacaagagacctaacacccagtccatcatctttgttaattaaacagaacctctgtcatctatccttacttaaaagactatagttctgcacctggctatgtcttggctttagattgaatgccatctgaaaaccatcctctcaaaggaaaaagcctgggtcagctaggagactacgttgtttttcaaccccatcagaaatccaataacaactgatagtaactgaaaatatataggaagcctaacacagcttccaaaacgtagccaatttttagagaccgctgagcacttggacagttccttacttcaacagtgtatctcactcagcctaagctaagcttcagggcacctacctatgaggatgcttccctgggtcgctaactagtgtatatctgctgggtgagaacaagaaaactcagtatcctagatctctttctctaagtagaaaacatggaccagaaggataatctttggatgaggattttatgacacatccagagagttgcctttctaatatacctgtctcaggcataccttttccagtctgtagttttaaggactttccagctactgtgaacataatatcagaacaggaaggggagtttgtaagttatgcaatctaatattaatttttcagagacacattttgctgtctctgtttgttattactactgagatgaatacattgtgctactaaacacaacaccaaaacggtaattaacagtctaatggaaatttgttccctgctgattattaatggaactttcttttttttttttttttttttttttttgagacaagctggcctggacctcattgtctggccctagagtggccttagactcttactaatcttctgatttaacctctcaagtaataatttgtcagatataacctctttaaaaaacttattcatgttagcaatttaatgcatttgccttgtttcgtttgatttatttagctttatatggacacaaacaaacaaaacaaattatattgtgtagaaacttttaattttccttgatatttttacttttatttataaaaattagtatttctattccaaccaatatttagttggttttgttacaaaatggaagtttacttatttgtttaaggacttgggtttttttttttttttttttctgtttagctagtgctaacaactacttttttgtttgttttgtcttgttttgttttgttttgctttggatagttggctttccaagacagggtttctctatgtagccctggctgtcccaggactttctctgtagaccaggctggcttcgaactcaagagagccacctgcctctgcctctccagtacagggattaaagattttgtaccaccaccacctagctggatttgtttatttttatgttgctttggtgttttgcatgcatacatatctatataaggtgccgggttcccctgcaactggtgttgcagacagttgtgagtgctaggaattgaacctaggtcctctggaagaaaagccatcgctcttaaccactgggccgtctctccagcccgagaagttttactttactttattattttatgtgtatggagttttgcctgaatgcaccactgtgtgcctgatgcccaagggagtgagaagagggcattgagtcacctggagtaggagttacagacggtcatgagctatataggtgggagctgtaaattgtatctgagccccctgtgagagcagcctgtgctctcaaccactgattcatctcttccaccttctatgatccattttaaagtcattctgtacacaatgttaaatagggagtaaggacagttttcccacattcaatttattttgaggtaagaaagggataaaagaggatggggttgggggcaaggtgggtgaagagatggctcagtgagtggttaagagcactagctgctcttccagaggacctgggttcaattaccagcacctacatggcaattcgtaactccagttttaggggatctgacaccttcacacagacaaaaatgcagataaaacataaatacacataaaattttaaaaggaaggatgaaaaggggaagaaaaaaatatatacatatacatatatgcacatacatataaatatatatgaaattgtgaaagaataaactcattttaaaattattttgacttttgttcctttttatctcatttccttccatattgtgttcttctatagtatcttagtcttttgactaataaccaagcataaattttctgctagctttgttaactttttattagcattaaaaaaaaaataggtttgaactttcatacacgtgtgtcattgtatctgatcttattcatccacctcctatcctgtaccctctccattgttaatcgccttcctctcccaaagtagctttcctgccacaaatattccactgtactcttcttgtccctgcccccttatccccccaccccaccccacccccatagttctctccgatttcagggatgaggtatcactaccatgccagctgttttttggggggagggggagtgttaccatagcattttttaaacatatgggtttgggtttttttggttgtcctggaactcactttgtagaccaggctggcctcaaacttacagagatccggctgcctctgcctcccatttgctgggatttaaaggcagcacaggtcagcctagagcacatagtgagtttgaaaccagcttgggctgtatagaaagaccttgtttcaaaatacaaaattcaaggaaaaagaaattttttttttttttttagtcagtctcacggtataaccctagctggctcgaaatgtccacgtgtagcccaggctggactcaaactcacagatctaactgtatctaccttcagaatgcttgggttaagggtttgtgccgccaaaaaattataaataaataaaaataaaaaaggatagatccttgttctttcaccacagttgccaggtaactgtgttcccttctcttggcctacagaacaggacttaaaatttcagtatgtatgtgtgtagtagggaagtggggtttctatgggaagaatattttcagttatcaaaataatactaaattgcctcagcatgcttacagtgaggtcctggtctagttctctggtgtagttcttttgagatccatgtgttctgaggcagggtcttctctgtctcgggctgacctaagttccctgtgtaactgaggatggacttgaaccttggctcctcctgccttcacgtctcagggtggaatggcagacctactctatagagtgcagggatcaaacccaagcgttttcaggcagaatagacaagtgctgaactacatagcctcagcccctaaactctcaggtagagtagatgagggctgacctacatccccggcccctaactcccgctaatgtttcctctcactttgcctttttaggaactgaagagattcgagagctttgtgaactcctgtcctccttttgatatcgttattgatggcctcaatgttgcaaaaatgtttcctaagggtcgtgaatctcaaaatgtaagtatgttttattttgtctttccctctgtagaaataattcctgtaaagaaccagctgccttctgtgtacagcgtcggctcgctcctctcctcacctctccttctgtgtacagcctaggctctctcctctcctgacctctcctgacctctctttctgtgtacagcctcggctctctcctctcctaacctctccttctgtgtacagcctcggctctctcctctcctgacctctcctttctccttggagtcactgtttagctccggatcacagctgtctaatttgaaaatgaatacagcagatataatactgagatactaggtaatcattattccatgttttcctatacatggtagattcacagattaacctgtgcagttgttttctctctgggtgatccttggttttttatcaacttgtagtaggttcaaagaaagctaccaggatttttcattcctttttcctttttttttttttttttttttttttttttttaaagatttatttatttattatatgtaagtacactgtagctgtcttcagacactccagaagagggcgtcagatcttgttacagatggttgtgagccaccatgtggttgctgggatttgaactctagacctttggaagaacagtcgggtgctcttacccactgagccatctcaccagccccttttcattcctttttcattcattctttttcttctgttctttttgaggcggtctctctgtgtagacccacactggcctgaactcacagagatccttctgcctctgcctcctctgcctctgcctctgcctctgcctcctctgcctctgcctcctctgcctctgcctcctctgcctctgcctcctctgcctctgcctcctctgcctctgcctcctctgcctctgcctcctctgcctctgcctcctctgcctctgcctcctctgcctctgcctcctctgcctctgcctcctctgcctctgcctcctctgcctccgcctctgcctccgcctccgcctcctctgcctccgcctccgcctcccaagtgttcccctctgtgaccatgattttttcatagcatcaaagcgattagaaaattaaagttaaatgtgcacaataaatcccttgaaaacaaccagaatttaagattagattatagagagtgcctggatttcagcttgcggctcgttcagcttggtgccgtgctgcagttggacgccctgtctaacagatgctgccaacataagcaaagccttttctctgaggtgcagctccctcagctcagccatttatgctttctttatttgcaaaagacatgaggggatttgtgtgttctgatgttgtctttttttaattggttggttggttttgtttgtttagtatgtgcctgtgtctggccttgaactcctgagcttcctgccatgagaggagtttgaaagtatctttgtctcttgacaaaggcaaggcagaaaatgaagaatgcagttctgagccatcaggcttggaagagttgtttttgatggactcatttgggaaagtccccatctaatccgtaaaataagtttagtgttcacttatcttttatttggttttcagctttccacaaagccctaaaaattagtttgccagatatcggctaaattggactgagttttttggggggaagtaggatatcaaggctgggtggtgggtatgtccactagcctgtcataaggaaatctgtagatgagtgattctgtcacacttttggagaaggagacggagaacagacagccaaaccagtctcccgaaagtcctccgggcacatctgggttgtcagaagtggtttcctagtttctctaagtagcctgtaaatggcatcttggtttaaggatagatgtcctgtgctggagatgacgctcacttggtagcacagcctcccaagaatgcacagagtctgggatcccatccccaggaccccataaaccagacgcagtggcacacacctgtagtcctaacacttaagaagtgggggcaggaagagcagaagttcaaagccatccttggctgttttccattctgtaaaatgggaatagatagttcctatctccagaaagtgtcatgaagattgaaggactctatgtgcaagccctccgtgcacgaacttcacaagtgtagctacggtcgtaattactgttccattgaactcccaaatggaacgataattcttgtttgtctgtaggcccttctctggtagcttaagttttttcctgtcattcatgacaatgaaaaatgctaaattctaggccaggcatggtaggtagtgtatgcctttaatgccagcattcaggaagcagagacaggtggatctctgaatttgaggccagcctggtctgctatatagagatctcctgtcttaaaaaaaagaaggaaaggaaatcctaaattctatcttgatattagactcagtctagaccagatagtcaaataatagctgattaagaattgcagtcagtaggaagaataacaatatcaaccaaccagaccccccccccccccagagctcccagggactaaaccaccaacaaaagagtatacatggagggatccatggctccagctgcatatgtagcagaggatggcctagtctggcatcaattgggagagagacccttggtcctgtggaggcttgatgatgacccagtgtggggcaatgctagggcaaggaggtgggaatggatgggtgggttggggagcaccctcatagaagtagggggaagaggatgggaatagggggtttctggagaggaaaccagaaaaggggataacatttgaaatgtaaagaaaatatccaataaaagaaaagaaaaggaaagaaaagagagagagctatttgcatcattctgtcctcagttgatagaatctctctcactctgctaagtagactaaacattaaagttgtcgtttgctctgtaaaaaagaaaaagaaaaagaaaaaaaacaaagaattgcagtcagcaccagaccctgaaccagaacagtggctcattgtgatgaacatttgcaagcaaagacgtgtggacacactgagatccactgcagcttccacgatttctacacaatctttacacgattttttgttttcttttgttttttatttacttttttttttttattttattggggtgggggtttgagaggacagagggcagatacagaggggtggggagaggagtggggttggggtttataatgtgaacttcacaaggtatcaatacaaagttaagaaataaagagatttttaaaacaaaaacaacaaaaatcatttatcactacaccatttttgctattgcttttgttatcgttcagctgtagctgctgttttcatcagtatagattagtcatggcaattgtgccttctgtgttcccttcaccactgaattctcctttgtgagtccacatcagggtcaggtcagttggataattgtttgtagagaaaaaaaaaaaaaagaattgaagtcagtactattaaaaacacatgataaaataaaatagtgtaaagaaactatgttttggagttggggccattgctcagtggacagaatttacccagcatgcatgaggcctggatttctatctcagctccacagaagaaaactcagacagacatagcttaagttggtgtgctagtgtaaacccagatttcaggaggcagagtcaggatgatctcgagttagaggccagcctggcctccatagttccgagacaccttgataccctatagtcaagcatgttaggattgtctccctttttggctactttttgttttgttttatagacaagagtcccaagtagcctgggctggccttgaactcactaggtaaccaacagtgaccttgaacttctgactatctgcctctacctccatacttttctgtcactagttcatcacgtatctgatatgctcgataagatggatattggggaaggacctggcgttcattatttagggagcttcactgtgatcacatagcttgaacttggagcttacatctttaagggtaatagaaattaaggaactgggctggtgagatggctcagtgggtaagagcacccgactactcttccgaaggtccgaagttcaaatcccagcaaccacattgtggctcacaaccacccgtaatgagatctgatgccctcttctggttcgtctgaagtcagctacagtgtacttacattaaataaataaataaataaataaataaataaataaataaaatcaaaatgttaaaaaaaaaaaaagaaattaaggaactaagagaacaagcttcggggccagaaagatggttcagtagttaagagcatatatcccgcttttgcaagggacccaagttctgtttctaacacccacatcaggtggctctcaactgcctgttaaaaataaaatagtggagccaggaggtggtaacacatgccttcagtctagcacttgggaggcagaagcaagtagatatctaaatttgaggccagcctggtctacagagcgagttcagtatgaatggagattctattctagaaaaacaaaacccaattctattagtgaagataagttaggttagactagctttaaaaaaaatagctactcatttaagccatctctgttattattatcatcatttcagaaccagagaaactggaatattaacagtgagacgacatgggagagaagtcgtgaaggctgtttgcttataacacttctgctctgatgtctcttgcgaagttgattattagcatgttcgtgtgtgtgtgtgtgtgtgtgtgtgtgtgtgtgtgtgtgctgaatatgtgcatgtgaacatgttgtggtgcccatggagaggtcaaaggacaactatgttgtcactctggagtctacctgggttatggttatgcagctgaactaaagttgacatagtttggcagcaagtgctttctcccactaagcccctctgctgtgttttatcagcagctaaagtagatatgtagattgcccagtcccgtgatgtcagcagggcaaggaaggcagttgtactggctggttttgtgtgtcatcttgacacagctggagttatcacagaaaaatgagcttcagttgaggaaatgcctccatgagctccaactgtaaggcattttctcaattagtgagcaagggggaaaggccccttgtgggtgggaccatccctgggctggtagtcttggttctataagagagcaggctgagcaagccaggggaggcaagccagtaaagaacattcctccatggcctctgcatcagctcctgcttcctgcttcctgccctgcttagttccagtcctgacttccttggtgataaacagcagtatagaagtgtaagctgaataaaccctttcctccccaacttgcttcttggtcatgatgtttgtgcaggaatagaaaccctgactaagacagcagcagtcttaccgtgtgctcagcagagtgagagtgtgtctgaccagcttctggctgccacactgagaacactgatgttacaatagtcaagctagaaatgagttttaaagtagccataacgtagcagtgtagactgtctgcttacattctgcttccccccacccacccccaaagtccaggtccttccttgcagttgtgtatgtgatacttttgttgattcttcttagaataacaggggagggaattctaagtctctatgactcattcttgacttatgttttcacaactttgatttgtaagaaatgagtttttttttcatagtcaccaagggttcattaatgcttagtgacgtgaggctgctttgcagagacaggagcaacatgcagcctttcactcgagaaacagaagaaatggaaaggttcttacgccacagcttctcccatgatcctctgtgccccactcgccgcgcagcatctgtcctaatgctcttgctccccgctcctgcagcctgcgcgttggatggcccgtgttcctaagcctctctaatagagggtgtgggggtgggggtggggtgcaccattttagttaatctcactagctgtttccaactctgcatcctatttctgcaacaagcggagaattggttaaaatggcttcagcagaatggaaatttataatgtaattcaaaagaattatgggcagacatcagcactaaatgctttcatgcctacagcttgcttgcgacagtgaatggaaagccatttgagtggaaatgctgcagaattcattctgattgccatctcttagttgcttttactacagtgagggaaaaatggaggcaaggtattagccattaaaggtcatttgctagagcgtttacttggcagtgacttctcatatttttttcttccacacaagttattttatttctctctattgatttacataagcttttgttaatgtttcagagccacgaagcagctaaggtccagtaagctgtgctcatggctcacagaaccttggccccctctctccaagctgtggtaatgcggaattgtcaccgactgagctcgaaaccggttcagtgctgggaatggagtgaggaagctccgctcctggcgcgttcacaacagcaaatgttaaatgccaaagcggactttgaaacactctgtggtgtaaccgtttctcctgcttcaccactgtcccgttaaccgaggctttcctgagagcctgccatgtttctccatccccagacttcaaggagcatatcgctctgtgtcagggatttccttttcctttgtttggagaaatgtttcagtactttttttctttttctatatcggaatctagagttggaaattgttgtttctagtttggtttgaagttttatgcgttacagaggactggaatgataggtcactggacatgagagctgaattttttttttttttttattttgatcagctgtttagcagtagatgtttcttcctgttagaatctgaaaggtagttgactttttttgtaattcgtgtgggtgttttgcctgtgtgtatatctgcacaccacgtttgtgggagaccagaaggtttcagatcccctggaactggagagggttgttactcatgcgtgggcattagggattgaacccgagtcctctggaagagcagccattttacctgatggtctccagttccctgacaatattttatttcttcactacaattcattcattcgttgggttttttggtggcatttgtttgtttgtttttgagactggttttcactatgtcgctctggctgtcctggaacttactgtagaccaggctggccttgaactcacagagatccgcctgcctctgcttgccaggtgccaggactaaagctgtgtgtcatcacacatgactcttttcttttccatcatcctgcctggcttccctggcaaaaatgtaaaggacagcagctgtcagttatttttaagttaaccctaatctgaaaagtttgtctgactcgctcagaatgaaccattttttttattaacatttctgatttcaagattcagagccatgtagtagatggaatgaactgactcccaggagctgttccctggcctgcacacacacatacacacacacacacacacacacacacacacacaaatgtacacacatgcatacacacaaatgcacacgcacacacacgcactaaatgaataaatgtattttaaaagagtggctggagagatggatcagcagttaggagcacttgctgttcttgcagaggacccaggttcagttcctagcaccgacatagtgtctcatagctatctgtaactccacttctaggggacccagtgcactttactgacctccataagcaccaggcatgcacatggtgcacatacatacattcagacaaaacactcacatataaagtaaaatgaataattctaataaaaacaataaaaagatttaactttaaattgtgtgtgatggcacttgccaagtaattctagaatttgaaaggcaattggatcagaagtgtgtgtgtgtgtgtgtgtgtgtgtgtgtgtgtgtgtatgtgtagtcatcctgaggaatgactcatgagattgtcctctgtcctccacacacatgcatgtacacaagtgtgtaaatatagtcatcctctgatatcctagacagcagattcacacatgctgaagacctttacgtaaagtagtaggggctagagagagggctcagtgatttagagctctgactgctcgcccagaggacccagattcaattcccagcacacacatctgtaactctagtctcagggaatctactttcttcttgtggcccccacagacaatgggcacacatgtggtacacagacatacatgtaggtaaaacaccgatacacataaaaatgagtaagcaaaataaagtggcatagtgtttccataggccctatcagcatccagctatactctcaaactggactgctagcttattataatccccaatacacttaaattatagtctagggaataatgacaaaaagaagagtctgtgtacacttccacatcacaatccatcactgaaggaagtcaggacagacactcaggcagggcaggaacctggtagcaggagctgaagcagaggccatggaggggtactgcttactggcttgctccccatggcttattcaacctgctttcttacagaacctagatcttagcagcccagggatggcaccacccacaatgggctgagcccttcgccatcaatcactggttaagaaaatgctctgtaggcttgcctacagcctgatcttgtgttttctcagtcgagggtccctcctctcagaaccgtagcttctgttaaaactggccagcggaggtggcttgtttgtttgtagtgttggtgaatcaaaaaaactgaggcctaggtagatgctttataatccagctacacattgccagcaagagtgatttaatctataaacccattgcatgctgggaaaataaagctaatccagacgccttaggtttacagtagttagcacctgggactggaaagatgactcagtgggtagagcatttgctgcgtttgcagaaggcccaggttcagttcctagcacccatacatcacggtgcctcacagccatctgtatctccagttccaggagatctgataccttcttctggccttaggtgccaggcactcatgtggtgagcatacacatgcaggcaagaaaaccctcatgcgcattaaataaatacatctaaaattttaaaaagttgcagttgggcgtagtagcaagagactaaggtcagagggtaattgtgcaaggccagccttggccacagagtaagaccttgtcttagaagaagcacaaaaattaaacgaataaaaggtaaaataggggctggagagatggcacagtggttaagagcactgactgctcttccagaggtcctgagtccaaatcccagcaaccacatggtggctcacaaccacctgcaatgagatcggatgccctcttcaggtgtgtctgaagatagctacagagtacttatatatgataaaataaataaatcttaaaaaaaaaaaggtaaactagttctgtctggttcctcacagcgaggctgagtggatgcccgtgcgagttgactgaggaacaggaggcatagtgcttggggttcccctgaccattcgtctttcatggcgtgggtacagggaagtcgggtcgccctaggctgaactctgtcgggctgactacagctctcagtcacctgccatgccacctactcctcgtgcttggcacacctgagttctctcttgccatgtgacggctagactagcctgcacctcttaggattattctgacagttaccagtttgtgcgtgaaggccaaccatcaaccaggtgagactgagcagagctatcaagggcgttaaatagaaagcaatatggagccaagcaaaacttctgcattgaacttggtctcctagtcctttctttccaaatttccagaaaggcacaccttgtgtaatagttaaaaagtccgggttgtgttaatcaggtgtcatgttttgttgtcaggttcctatgtctgttatctctctggcaacatcttaatgtctaattgagtttccatcttaatgtatctgtgtgataagcatttggggtgtggtaagactgactgtgaatcactatgctgtgtacctcgcttctatgacaatatattaaatcatcctccttgggaatgtcacaagtagaggccactatgccaatcactccaattttaacaacaacaacactttctgttgtcaggaagtagtgattccatcgttaccaataaatggattcctgttttggaagctatgtaaattattcttacttaattattagggtaataatgctccggtaattattagttctgtggtgacatttattttagaatagcgtttttcttttaaaataattggttgattcacacttctctctgttatgaaggctgagattgttctctcagccccaaatagtgaaagccagtcgactgaaggcatttcagttcttaaggttgtacttgtttagttttggttttatttgtttgctttctataattcagttttcttttctgggtagttttggaaagtaagtacatctaaacttttaaaacctgaagttgggcatagtaacaagagagtaaggttacaagaagatgacagtgcaaggcgggtgcttagagactgggaagtgtggagccacacccagttatgtctggtatatcttccaagcgatctaattctctaagagccattgatttgtaggagtcacaccattcatgagattaaacaggaataaattattgaaggaaagtattgttcctgtgtgaaaccaaagagcccttgtggctcaggccctgggacactctgtgtcattcataacactgttactaggttaagtgagtgggttgtgtgagaactgaccaaagggaagaatgtcctgtgttggaaggagaggctctgaaggggtctgacaagcctgggtacgtcagtgccgttaatgtcgctggcagttcataggaagcatagagttcatttagctttgcttatacgtagtgtccacggctgccacttaggactgggtagcctctgtggaatctagtccttctctgactgaccctctcttcctgtagctctttgtctagggactgtgtggagttcttgtccacgctggcctatgatctggtgtgggaccgtgctggtcttgttcatattactgagcgttcacagtttagttaatgtccatcctctaaccccactcttcctggcagtttattgtatgcagggaaactcttgagcttctgatctgttcagaagagagagaataggcaggttggaaaacacatgggaacaacagtgcctcttctaataaaccaaaataaccccatataatatgcataatgttttaagagtttcaatcttggggctggtgagatggctcagtggttaagagcgccaactgctcttccgaaggtcccgagttcaaatcccagcaaccacatggtggctcacaaccatccgtaacgaaatctgatgccctcttctggagtatctgaggacagctacagtgtacttatatataataaataaatctttaaaaaaaaaaaaaagagttccaatcttttaccaaaataacttgagtaaaaaccctaaagccatacatcggttccatggttgtaaaacatgagcacaccgaagtctccgctactttccagtatttattttggccattttatttcaatgtctgttacctggttatccctgtgtcgtgggattgcagtgaaagcatctgctaacatgtggctctttattgttccacttgtaatttaatcctggcctatatgaattacttggtgagaggatgccaggctgtattcatcagccaggtcatcctccaccacctgtgcacactcccacatcctgtagtatctttaaacactagtccttatcatggtttatcttgtgtatagctttagtattagccatagagataagaaccaaaaaattcagtaccacagcagggtgcagctcacacactttggatgttaactacatatatacaaacacatacattcccacatatacatatctgtgatgtgtgtgtttcgtttttctgagaccttgcttactaggtagcccaggttggcctggaactgtttaacccaggatgtcctcctgctctgcctccaatgtgttgagattacagatgtgtaccatcatgcctggcttaataaatatatgtttggggggctgccaagttggctgagtgggtagagcacttgtcactaaggctgatgacctgagtttgatacctggaaccacaacggtaaaagagaaaaccactctagcaagctcctctaacgtccacatgtgcactgcggcaaattcaaatccacacgtggttgtgtttggtgtggtttgtttacatttgagatggtgtcccagtgtagcccacactgctgccaagggtgactcagcctcctgctccacctcccgagtgctgagattgcaggcatgcaccattaaatatcttttttatgtaaaagcatactattggaagctaaggatttcttcatccacatttcagaagctaaggtctaggccaattcttgatgttgttgagactttttaaagttttttaatttataaaagaaatatatgaaaaaacaaaaataatctcaccacatatagccaacatttccatttctttttatgggtctgcttttgagtatgtgtaggtgagtgtgggtcccctcagaagacagaggcgctggagctagagtttacagacagttgggagccagggtgctgggatctgaactcaggccctatggagttgcagcaagtgtttctgacccctgagccatctctccatcctgtatttccgctttgtttgtcttttagataaaatctcgaatagctttggttgaccccaaattcagaatatacctgagatgactttgaactcctgatcctcctgcctctgatacctaagcgctgggacccccatctctggtccacttctttttccctttgagatggaggctacaggatgcattatgcctgccttctcactctccattagacaatatatatctaaacatacagcttggtttagttttggttttgtctttcatctgataaggtctcttctacagaattaaatattttggaaaccatcctgaatgagtaagaactgcttccctactgtccaaaatttaggttgcccctgtttgtttgtttttttttttttttaatagtaaggcagtggcatggggctgcagatgtcgctcagcagagggcttgccaagcaagcaccatataaactgggtgtggtagtacaagcttgtcatcccagcactggaggtggaagaagaatcaggagttcaaagtcacgctctgctatgtgagtttaaggccagcgtgggatatatgtgagaccgaaagtaatggagccgtctgacaacgtagactccacctctgaatctctcggcattgcatgaagcctgtgttccacttgctttgtagtggagaaggcatgcttctgcaggtcagagcacatcagacagtagatgaccgccttaaccctcaacttacacacacacacacacacacacacacacacacacacacacacacacacgtttctgtgtgcctgggtagaagcgaaaccctagaagccagtgctttatccactgagcatctagctcgtcagccccttctgtaactgagtggagctcagtgtcctggtgaggccatcagcagatgtgtgtgtagcacatgaagttctagtgccaagctgcctagggtcctattatggcaaggggctgtgtctgtggcatactcttggtgatggttcaactccctagccctctgtggtctgagctgatgttctcatactcaagagccatatgtccctcttctttgagaactgcagctatgtttatgtatcttctgactcccattctcccttttttaaggactgcatgattgtatgtgtgagtccccaggctcagagaagttcactaaggaatagaaaagtgtgttccattgaagccccctttccccttaccaaaaatacagtattttgttagttacttagttgttagttagttggttagttatggtttggatttggttttttgagtcaggatctcatgtagctcaaattgtccttgaactcactaagtggatgaggctggccttgaacttctgacattcctgtctccacctagtgagtactggcataagcatgtaccaccataccaagttgttatgtgatgctgagcatgaagcccaagggctacatgcatgctaggcaggcattctccaactaagccccacccccagccttggtttgtttgtttagatttaggtgagtaggggaaagtaggaaggtctttaaaaagtatttgtgagttactattttatgtgtatgggtgtttgcctgcgtgtatgtctgtgcactatgtgcgtgcctggtacccatggaggccagaagaaggcatcagatctcctgggactggaggtacagatggttgtgaggagttaccatgtggtactgggaatggaacctgggtcatatacaagagcagcaagtgctcttcactctccaactccctacttttatatttaatgcttcattttccatctgttttgagtttctgggaataacaaattacacttatccccaggctattaagacggctcagcaggtaaagtcatttgctgccaagccggatgacctgagctctgaccccaggtcctacctagtggaagaagagcactgactctctacagtcggactctgaccttcacatgcacaccgatggccacacacacacacacacacacacacacacacacacataccgctccacatacatgcatgcatatgtagaaaaatgaacaaatgtgatagcttacaagatcttaaagttaaaacaaattgtgcacaaattgtctttgagtactgtgaaacctatcctgttgggtctaggattctccattaccacagtcccttcctttactgttgcaaaggccaaactaacaaacacacttgatttaaagctctattgttcctcagcacctccagtttcctccgtcagtcctgacgtcctctgagcagactttctctttgttgtttgagcagctttctgagaaatgaaattgccgatatggtatcagtttaccaggtgcttggcttttaccggaatgaaagctctccctggtgctgggagaggggctgtttcctcccccacggtatactgtgtgtatctatctgttctgcaatctgtattaggaaatctacatcattagaatagaacatcactctccagtgtcatgagtatcggtgacatttgcccccttgtataaactttgcaagtttactttccttattaagcctgtttgttgtagagcctgttgaactgggaacgaagccagaggcctgtacaggtgcagtattagaagactccaccgtgttcattattgagtatacttcttgtctctgtggagggaagctctttcttatttatttattgattgattgattgattgagataatgttagactttggcacctacgtcatcagtgtttactgtcatacatataatgtaggtagtgagacagcccctcttgcctctcatttccacaaaggctgagcaaatttggagaaatttagcacgtaaggaacctaagcaagcagactgtccccaggtgcagggattgtaaccagcactgtgcaggcagagttagaaatcctggggaggacagaccagagctccttaggaaacaggaaaatgtaaacgctacatgctattctcacaccgtgtgcatccatccagacaccttcaaagtactgagttgacttttgtctgattttgttttgtttttaaatggaggctcagtctcagctcagaccttccgtaaactctcagcaagctgtctcccttggcctgttgaggatctaggtgtgagccaacagcctaggaaagatgtgccttaaataaacacttgaactatggcgggtagatcttgtttaacaaattttaagaagtcattgtaatggattcctcttagttatgcatcagacagtgtatagcagtttaacacactggtatggggtatccttgggagcgtgacgctgcctgagacctggggtgttcttacaggttcctgcagtgtgcacctgggagccaagcatgtctgtgagcttcaggctcttcctccttctctgtcctctctccctgagcagcagggcccctttatacttcccccagcttctcattgcctggcacaacttaggactctaaatgctgcctttgcactagttctgtttactgatagtaaccagtctgttctatcaaggcctttccttgctgagggtaagtagacacagtgtaaccttgaatacttttgttcagattttggctttggggtttttgtatgtttttagagtcaaggccttgtgttcttctagctggcacgaaactcatagtaatagaccaggctggccttagagcacagcagacttgttgcctctgccgccagtgtgctggaattacaggaaagttgggggttggtttggtttgggttttgagatggtcttacaatgtagcccaggctagcctctaaatgtaggtatttttaaacaagtataaaagacaaaggcaggaggatcagatgtcctgagctatatagtaatgccccctggggggggggacagaaaaataaatactgttaagataagttagtaaatgaccatgaggacttcaggctgtcatatgccagctttccatttcacaccctcccacactgtacactgtacccgagcatcctaattcctgcgtgtcctgtaggtggcagtacatgtataaaaaaatatcagttcatgtgcgatttgaggatggtcagtggttgggttccttagggagtaaggttcatttgaaatactctctcggttaatttccctggatcctctagatatattaaacacaaagcttcttactaaatcaaatttccactccagtctcttcagccatgatctgacctcctgcctagttgtaataaagaccatggcaatatgcaactatggagaaaagggtttatttgacttacatatcacagtccactgagagaagccaagacaggaacctggaggcaggaactgaagcagaaaccattgagtaatgctgcctaatggtttattctgcatggcctgttcagtttgctttcctgcgcacccaggaccacacacccagggtggtactgcccacagtggtactgtccagggtggtactgtccagggtggtactgcccagggtggtactgcccttggtggtactgtccagggtggtactgtccacggtggtactgcccacggtggtactgcccacggtggtactgcccacggtggtactgcccacggtggtactgtccagggtggtactgcccatggtggtactgtccagggtggtactgcccatggtggtactgtccagggtggtactgcccacggtggtctgggccctcccacgtcagtcatcaattaggaagaggcttcactggcttgccagtctaataaaggcctttcctccattgaggtcccctcatctcagatgactgtagcttgtgtcaagttgacaaaaacaaaccaacacccctcccaaaccctctttccccccagaaatcacattacatgctcattttctctttggaatgcaataactgaaacaaatcctatgtaaagttgttgttctatttttctcatggagattgactctctgaggacatcattaattgtgatgtagacagggtaaccagtgtcgtaggtctcagataactctatagttgtggggccaatcaggtaaacactgacatgtaggaaggggctcattagaagtgtgagcagcttgtttggcttgtctgcttactgtggatttgtttgtttgtttatggggatggagcatgccacaacacgtatgtagccagaagtcaactcatagaaaccagttttgtctttccaccacgtgagtcctgggtctcaaacccagatcatcagacttggatggaaacacctttagcttctgagccatcacattggcccctgttatatttctttgagaaaggcccagactatcccatattctactgtatagccaggtagccttaaattcctgggtaatcttcctgcctcagcctctgtgcctcactgataatctgttctgttctctttaaacatttggggttttgctgtagggttcattcactaaatattgagtacttattgaataccagttgtgtgccaagtaggtgccccgagtcatacttatgaaaggacatgcgtggtacctacctcttctcaagttaggggattcctgtaagacagcagtggaaggtacagtaagaataggaattgattgctgtagaataattataaatctgtttacctcaaactcttccacagttcttaagaaagttggaaaataagctgggcactggtggcacacgcctttaatcccagcactcgggaggcagaggcaggtggatttctgagttcaaggccaacctggtctacaaagtgagttccagtacagccagggctacacagagaaaccctgtctccaaaaaccaaaaaaaaaaaaaaaaaaaaaaagatagttggaaagtttagtcaaggaagatctctaagaagaaacatttcctaaccatggcggagtgggacaggtgcccgagagtctatgtagaagaggcacacagagtgctaccattgtgtaaagaaaacacatacccctgcccccagccagcatgcacatgcttgtacacatcttgctagccgctgcctgggagatggagaagtgccttttgcctttgaggtaaggagctgggggtctagagatggagaaacgttttatctgtttggtgttttttgtttgtttgttttgtttgtttgtttgtttgttttagatttttgaaccctataaattaattactcatacaaaaattaaagttgtacttccttggatcatcctataaccacagctgaggagaatatataccagcctctttcatttggtagattgcataagtacaatcctgaaggtacacctgacaaaaagtatcaccaaggatcatgtaagtgtgtgatgcattttgttttggttacagggaactttccacttttattttcatgcctttcaactcgtatatcctgataaacacccagtggttgagagtgggtgtggttcctcccagagatgctaactgcagaggttttttttttttttttaatacatcaaagagccacatggttttgtctctgtttggttttgttgtgttgtgtttaggggaaattacacatgaagtatgccagataatcctggaagaagacagattaaaaggaaaaatatgatttagtgagtccattggtgttgtccctttgtgcggtgaattgcttttaggatgctgttggaggaggcataggagatacgcagaacagagcagggcttattgcgaaaccccagccactggagtggtggcatcaggagaatctaggtggtcaacctagaccacacagcaaatcccatctcaagacgaagcaaacatatgtaaaagaaatcccatggggtacagactcagccatatgtgagtcccaaggaatcctattagtatatatgtttaagaatcgtgtaaggagatagagggttataaacaatttaattttttaacatgtatttattgtgagcacagtatatgtgcaggaaaaaaaggggttcttggattccagcccaagtcaacaggcttggtgtcaagtgcctttaccttttaaagcttggcagggtagtactgaccagtggtcacaacccttgggaggtagaggcagggagatcaggagttggggctattgttggctgcataggggagttagaagtcagccgggctatataacaagatcatcgcctatatctcaagcttcatccccaccccataatcatccccgaagcctcccaaaaatccaggagagtatgcagtgtgcggagaaaccacccttgtctttccgcagataacttatgctaagctgctttaaaattcacttacaatttatcttcagcaggcttaaaggttttttcccctgtgtcctgtcattccttagacactacgcagctttttgttttccttcacagtgatcacaacacgattttccccctgattatgcaatagttcctcatcttgatttatagccagtaaacatgaagttatacctggcattttattttgagaaagaaacaagtttgaggctgacaagatggctcaggaggtaaaagcacttgcctttcagcctattgacatgagtttgatccctagggaagagagaactgactcccccaaattggcctctgacctccacaggcacactgtggcacagtgcaagagtgtgtgtgtgtcgatgttgtacaaagagagcagtaggcatggcaggaaggacagcttgacaccagatgtagacctgcgctcctgtgtcccacccttgggaagtagaggcagaaggcactggaaacaaaatcacccctagatacttaatgagtttaaggctagccttcatgaccatgtctcaaaagttcccataccccttcaaaacaagaaaaagaagcctgcctgtctgtactggttttgttagggaaagaaatgtggaaagtggaccattgggttccctaccagtaagaggtttggaaagtagacctttggattctgctaaccccaatggctgctcagctctcttaaattccttaaagttcagatttcccttgtggctaaagcacctgttaacagttcttactcacacagccaatttagaaaataactgaattcatctaagaaagctttgatgttggtttggtactcattattagaaggcaacaagtattgaaagatagcaacccttcatgcagacaaggttggaaaagttgagaagtatgtttacttgcatgttgttacagttaaactcagatggaaaggtttagagttgtgtaattatggaatattttctagccacaaactccctagctgcgcatttcacattcattagcaattaggcccaaggatatttggattcaaatctgctttggaaactaatttttccaaatactttgtttcctagatcctactaaagtgatatatgacgtcacctattcaactccatcagcaactttcttctgtgagatagctttgccttttccttgctcttccctagtcccctcatccccaccctaatactgagcattgaactagagcctcgctcctgctaggcaagtctctagcattaagcaatatccccaggtctctcttactttaattttgaacaggtctctctaatttgccatagccattcttggaatcactctgctgcccaggcagccttgaacttgtaatccccctgcttcagcctccccagttgctaggtttgcagactgtagcaataccaaattaagctactaagttgatcctggcagcgccgctcctcactacccgccccaaggttctgggtttccgaataaaagccacatacacacacactttatttttttgacatgtctaaaacagctcaatggctgggccacttcctcacctccacgtggctgatgctcacccctccgatgttgctgaaatctatatcccgcctttgcttccctaggcccagtcgtgctgccctctggggctgtgtccccccagctcctacatggcgactatgctctctgtcctgcatttctcaagcatggcatcttggttctccgtctcccagcatggcagatcgcgctctcccttcctccctcttctgtcccttgcccaggaaatcctaaaagtctggcctctgtctccctgaccagccagtggccaccagcaactttatttaccaatcaaaaccaactggggcagggtttccttagtgtcttatgtggagccatgtggagtctcgtgcaattaacatagtacaaacagcattagaccaaactcacaacaacaggcctcacctaccagttgggcttttggtgagcatcttagaacttatccctgttgccaatcttatctgacagttcagtgaaagagctctattttacatcactgttggccatctgctaatcacacgtgaagtgtgaaagccccattccggcctcggtttctctgacttcatccttttaagctcttctcgaactggagtaatgaaacagtaaccttgcaaggttcatacaaggaggcaggtgacattggaaagcgatgctctggtgacagagaggtagtcagggcacagtgaagatttcctaatcctgattacagagcaccttcctctgcctccccgtgctggaattaaaggtatgcaccactgtgctgcttacctattttttaacttattctgctgtgcatggatgttggtactgattcgaagaatgggtttgagggttagaattttgtaggtttgaagctcacccctgctgtttactgccctgtggttttgatctagttgtctaaccttgccgagccttagcttccccgtataaagaggtagtatggggaggcaacataccaattcataggatgtctgtgggagtcaatgatgatatgtgtaggaacgctaacttttaaagtgttttgggcatgccataattgcccaggacctcataataaagtaaaggattcttccttttgtctagatgcctatgaaaagactctcagcatctcctagtgggaacccactcatcccaccttggtcagagaagcatggggatcatgcttgccttgtgtatactctagttcctcctgccagcgtctccctccctcaaatcacatccgcattattgcttcctgtcgcttcccgtgcctgcgtccccatttctgctgagaaaagcagaagtgagggagatggacaggtttggggatttctaaagactgttcttcagtctgccctgttatgttaagccatatttatatgaatatagtgactgttaaatcttttctctgggaaacataaaggaacttccctattaaagactgtaatgtgttaaccttttagaatgcaaatgttattttcttcatgtacagtataatagttatacaaccacaagagcttaattaaagctagcattgaagacagaagtttctgctccctattttaattctacgctttgcatacggggaaacctaggctgttaatttgtctcaaggtcacaaggtacactactgagcatatgaacttgtggattttaattttttgttttgctatattcatctatctacctgtcttctgcctgtctgtctactaattaaagggtctcactttgtagctctggatagccaggaactcactatgtagagcaagcctcaaattcacagagatctgcctctgcatcctgagtgctgggatttaaaacatgtgccaccatgccctgcaatagatagacctagatattagaaatctatatagaaaaaaattagaagtaacaattctccagaattttggagacagttcttcaagcttctagggttactcttttcttattgggggaggtgtgtgagcataggcagggccataccgtggcacatgtggagcgcagaacagctttggttgggattcagtcctcggttgtcccctgagatccaggatgggactcagcaggggcctctacccactgagccatcacaccagcccttccagaattactcttcgacagtctcacttctagatttcttgttgtttcttatttccgttatttaggttttggtctggggattttgtttgttgttagtctggtttgggaagttgtttcagtactggagattgaacccaatgccttctacatattaagcaagtgctcttactagtgagctaaatccccagcaccccctttaactattaaggatttattttttaattgtatgtgggtaatcatatgtgggtttgcacacatgaatgccaggtgctcatggaagccagaggagcccagtgctcccggagctggagttacaggcaactgtaaaccacctgatgtgggggctgagaaccaaactcaggtcctctacaggggactgctgttaaccactgaagcatctctgcagtcttcacttcctaaatccagcccttatcttattttccatttagagcagggtcttacccagactgacctggaactccctctataacccaagcagaccttgatcttacaatcctcctgcctcagtctcttcagcagctaagattacaggcctgtgtccctgggctcagcctatgacttctgatctgcaatgaggtctgctttattccctctgaaggcttttggagccttcctttgcctccttgacgttaacactttacaaaaaggtgactggtgtgatgttgttgcatccattgagttggccaggtaacagacgctttcattctgggaactctttgtctactggactgattattggttattttgttggtgatgccatatctggaactcctgccccctccccaaaataatgggcccttaggcttccatctctcgcctcaggagtataaatttgagttgtccggttctttgttaagccacatgtctccagccagcctcatttctttgcttccaactctggggtctcttgggagattgtgttgacccttagctacttctgtgcagatttgacttagtcacatctgcaaggtaagctccccttgtacccttgctctccagcttccaaaactaggttacttttttctctaaagtctgtgagtttgtcggtttcaaacgtttttattatagttttaagggaattccaagtaggatgaaaattagatgtatgtttgccttcttaacctagaaatgtgtgttctactctaaaccagtattgccagattggcactaatgcccccacccccaccccaggcaaaataactggttaagaggtagaggggggcataagaaagaaccctttcattcctctggttctgattcatgtcccttactgcctgacaccaagacattttggcataatagactagacctcctgccaaagaactgtactcttctctggagaaagaccgagcggtgagttttagaatggcctagaaactatgtgctaagtgagacctctttgtgatttccacgtaggtcgggatccctctgccctgtgttcttagtactactagcactcccgtctccactgtaagctacacactgttcctaataagtctcctctccaaggacagacacaatcctttcacacctcagggctggagagatggctcagctgccaggagcactgactgcttttccagaagacccaggttcaattcccagcatccacatggtggatcacaactcccattccagaggattcagcaccttctcccagcctccgtgggaaccgcacagacatgaggtacatacgtacatgtaggcaaatatccatacacacaaaataaaatcaaagtatgccagcacatacatacttaatctaaaagccattaagtagcttcatacacagacacactgagggtcatcctctcctagtgcctccacctgactgtttgtgagtgtctttactcatcagtaagctcaccagttgtgacttgttctgtgttcacaatcaagatccaggtggttctgagtagaggcttgagagggactccaggacacacaggccatggcattgggttacatttctttgttttattctttttttttttctttttattagaagaaggagtttaatctatctaaatccaccgagttagacagtattaatgagagttaacatttatgggctaattttccatatgtttttatatctatatgcattatacagtagtactcatgataaacaagtattattttcaccttaccaataatgaggcagagacacaaaaaaacaaatgaagctttcccatttgataaagtttgaatatcatggaaccagaatttgaacccagcttgtgtctccagcactattgtcacgttattaaagagtagtttccaagtggaaagggcgctttcgtgtctgttccgtctcactaaccgcttcagcccttctgtgggcgttaagttggaatagtaactggagtgagctttatgtagttgggtttttcatacatttgaatagaccaagactgtaactatcttgtgctctcttggaaggctttgtaattaggccaaagctttgtccaccagtgctgctggggaggctacacagatttttcaaatcgtctctttagtcattagtgtctatgaacctgcaagtgtccgtgtgctttaccagagtgggaaaaggattcccatatcttgggttggatgtagaatagtgtggaaagctttttattttattttgagtcagagctactcactgtgtggctctggctgttccagaactcacattgtagaccagttaactggccttagttcacagagatctgtctgtctcttacctcccgaatgctgtggctaaaggtctgctccactaaatctgactgcttattttatgtgcatgcgtgtatgtatgtatgtgcacatgtgcatgtctgatacccacagagcactgcaactggaactatagttgttgtgagctgccatgtggctgctaggaattgagccgagatcctcgaaagagtggtcagttctcctaacttctgagcgacttctccagcccttgtgggaaattttataagcctcttgagggtgagatttgaatgcatcagaataagtaggctcaatatttttaaaattagctttcattattcaaaatactaccctgtcttgccttaaacaacaaaggagacacagataccttgtagagacaaagaatgtgcataaatattcagagaaaagtcacactgtgaggcatgaggcagatctgtcatctaggcagctctcacatgctagctagctgggaagacagtgcttgctcgctctgctagctgggatccacccagggccacagtttgatcattttctgaaaggttagattgctgtgtgggtgctggtggcttcagagcagacaggggtgtccaggaaacacatcccacaccaagcaggatgtgcccaaggcaggaatggcatttctcttcctcaatagaattgtttcattaacagaggacaagatgaggtcattgaaatctccctaaaataccagagaccgacaaacacaggatataggatgagtctcaaagcagtgggatcattatgacatcagaatgaggtaatacgacacagtgtatatctattttcccaaggcatttaaagaccttcccagagttggtctctgggtaactaagtttgtacatagagatggaggtaggcctctgcctctttagcctcagcctctccccactgaaactcccccagccagcatgtgagcttgtgggatgtgactatacccactgaagccttccaccttcctgctcgccccaggttctgcttctcagcttccaacacccccatcatcatcaggcactaatctctctctacaatggcatataaagtttgaaaagtttcgacaaaactttttttcttatatgagtacactgttagtgccctcttcagacacatcacaagagagtagcagatcccattacagatggttgtgagccaccgtgtagttgctgggaattgaactcagtactcataactgctgggaattgaactcagtactcataactccaacccaacaaaactattattaatctccttacaaaaacaaaaacataatatgactggagagatggctcagccattaagagcactgctcttccagaggacacaagttctattcccaacactcacacggtttctcacaactggctataactccaattgtaggggatctgactccctcttctgatgtcagcgagcaccaggcactcacaaggcatacacagacaaacatgctagcaaaacacacacacagcatcagctgaacagcaggcaaataaaaacatgaatgaatatttgaacccagaccccgcaatccacaattttaaaaggtttcccacaccctttccatgcagtattttcagcagtatgcggaaaaatgtttaagatcgcagtcacttgagaaatacagagtccagcattgtctcaagcattctcttcccaagacttagctccatagtaaaacaagacgaaccaaggcagggcaatgaaagtcagtaatgtacagagggcaataggatcacagacacaagtagcaaacactgcatactagtgtgagttacatacaacttcccttgcttttctgctgtgagcaacatggagagcgcagagcatcaatcccaaccatgcttgtgaccttgtaccgcctccagagaggtcttcattttccattgtctctgaagtggcttcatgctctctttgtttgtgagaaacggttatcaaaatgaacaactgcacagtgaaagaatctgtttactttcatctcaagtccttggaatatcctgaagtgtaccctggtttgaatagaaacttgccccacctgatttctgccattgcccagtgccatcagccacctgagactgtgctagatgaagccgtcacagaaaatggagagccattcccttgcttttgtctcccgtacagccacgtaactgatagatgtttatgttggaagtatctgtggtaatttgtggttactttaagaacctctgttgtttgtggtgctttaaactcttcttaacactgggttctatttttagttagtttgtttgccctttacagcgcaagctctgaaccacaggctaaagaggaggcaggtaacagactccaccctccttggtgtacacactcttacggttttatctgaggaaaaaagtcgggggcttggggtggggggaggcgggggtcctggagagatggctcagcagttaagagcactggctgctcttccagaggtcctgaatttaattcccagcaactacatggtggctcacaaccaactgtaatgggatctgatgccctcttctggtgtgtctgaagacaactacagtgtacattaaataaataatatttaaaaaaaaaacaactcaggaataatctctccccccccaaaaaaaaggagggacagaacaataaatgatgccttgctccccaacactcagtcccaatttgcagaaataacagctgcaggccattttgagtgagaacagtttccacttaacccagcttcactttcaccccaagaaaagaagaggaaaatcaagttcaggagtctaagcttcccatgattttttttttaaataagttacttttattttattttattttattttattttattttatttgtatgagcacactgtagctgtcttcagacacaccagaagagggcattggattccattacagagggttataagccaccatgtggtagctgggaactgaactcaggacctctggaagagcaattagtttttgtttttgttttgttttgttttgttttgttttgttttgttttttggaaagtatagtataaagtttatttagggcatgaggaggggagttaagagagtgtagaggcagaaaaaggcagagagaaggagagagtagagaaggagaggctggccatgaccatgtggggggggggagggaatgggaagagagggggaccaaggggggcgagaggtaagnnnnnnnnnnnnnnnnnnnngggggcgagaggtaagaggaaggcaagagagcaggagagcacagttagtaatcttaactggtgagccatctctccagccccgattttgtgattcttaaagagccggttgcatgccttcatttcacacaggttatgacagtagcagacacttctagggaatgctactgaatgcattagccaagaaacactgggccctaacacgatgggtaggctcaggtgtgcctccagacatgaagtacagccttcccagcggccctctccctcaccaccaattcctaaagcagagaactcctaaaataacgttgtacagccatggcctccctgcaccgtgtcatcaaatactcgccagctgctttataaagccactaaaatgaggtgacattggcacagagagcttgccctgagagccagggagtttcttcctttaggtctggagagatggctcagcagctaagagcactggctgctcttgttaaggacctgggttgggtttccagtacccgtgtggcagctcataactgcctttaacaccagttacagggactccaacaccctcatctggcctccgtaagctcctgcaaggccatggtgcataagctcatgcagacacatgcatgcttaaagaatggtgagtaaaccaagaaacaaattaataatacaaaaagatccttcctctatgttgctgcatggaagcactctggataagtcccaaatttctctttacttcctcattcctaaatgagaaaacgctatagacttccctcataaactattataagaggtagtagaaaaaattatgaaagatttcatctctacatatgaagaaaccgtatgcaaataaagtaactttacatttttgttagtgatgatgtgataagtagcacagagtcgatggagagggagggaggcatgagtgggggtactttattcattttatatataaagagatctcaacaaataaataaaaagggaatttggaattcctggggccagaaccccaaagcatcagtcctgtgctgatgtcaatttagaactgtgtgctcagttgctcatattaaataagaagagtggtcatgggtaaatgatgcttcggttataattctactgaaagcgccttttcagcagacattagtgtggagccagaacctcgccaacctcatgaccacgttcccaataccttctgttcttacacagggaggatgcctgttggctataggcattgccggcacagaggcgtggcacaatccagaattttgccatctacagtgatagtctgttttaaatcctttcatcttccccactgctttcaggcaggaacagacccctgtggttgagacccgtgcatctgtccctctcatcctaggcatttgccatgtcatcctcccaaacctctgcctctcacggttcctaagtcaacgtgctgatgatcttaaaggagcatgctgctccttgtccatgaaaacccccatccgtgtctgcctcattcatctggaaactcagctgcaccaggtctcttgttttgtggagataggcctgacagccttcttctccttgagtgtgactgaagtggccgtctttgtgttccctcttagcagttattacactgtattagtcatttagcagcagtgccctgaggtatggagagagttgccttcgtatctgcgtccccaacagtttctgcctcggagcttactaagaaagttcccaatgctgttgagtgaactggctttcccccataacaagcacgctttgaaatacacagacacatgcagacgcacacatacatacaggcatgccacaaagtaaaatgctgtgcatccaaactggtctctccatccagctaccaatttatagaaatcatagcaggttggaggctgtagtatgtgataccagggggaaaaaatctgcaaagtctgaatgtgggaggattttgtgagacaagccatgtttctttaactgaaagagaaaaaggagctacacaggtgacgtctgtaatcccagctacttggaggctaaggcagaaagagcaaatcttcaagccttgcctaggatgaactcaaggctggcctgtgcagccgagaccatctcaagtagtttaagaagagccctaggtatatatgtcaatagtgcagaacttgccccatcacatgcacaagaacctagggacaaacaccagagaagagagttaccaagcagttgtatataagaagctttttttttttttagatcatagtttttattttgttttgaggcagaatcttcatatataagctaggctagttttaaactcactttgtagcacaggctagcctcaaatttgagatcctcctgtctcagtctcccaattgctgggattacaggcttatgccacctcaccttataaaatcctttaaaaaaaaagcaaggtaactcaggctagcctagagctcaaggtctttctgcctctacttatcaatgctgcgattacaagtgtgtatcacatgcctgactaataaatatatatgtgggatgtatgttgttatcttgctgagaatctgatgtaattttctgcagatatcacatcccaaaggctttagaggttttgaaggtcttcaatccttacaatccccagatataacagagggtgtaaagaggggtaggaggttaaaaagaagttctgggaggcttatacgatggctcagtgaggaagggcactcaccaaccaagcctgatgacctgcattcagtgtctgggacccacacagtggaaggagagagctcactcccaaaagttgtccccccaacatacacacacaaatcagatagaattattttttcttttgttttgttttgttttgttttgttttttaaggtaaggcttctctgtgcagccctggctgacctggagctcactctgtagaccaggctggcctcgaactcagagatcctcctgcctctaccttcggagtgatgggattaaaggcaagtgtcaccacagctcaacttagtaaatttattttttaaagacataaaagaannnnnnnnnnnnnnnnnnnnnnnnnnnnnntacacagagaaaccctgtctcgaaaaaccaaaaaccaaaccaaaccaacaataacaaaataacatggtcaggagttgcatttggcatttagtatacccagtttctttaccttcccgccccccccaacacacacacccagcccccactttctgttccttggcatcccgactcacagttgcctctacacaggaagccctgccagttgtattcctgcctgtagtcagaaactatttttaagcaatttcatgccaaaagtagttttgtgatttatgaggttttaaaaattagtatccatttctacaagaggaaaccaaatcaaggtggaagccaacctcagggatgcttgcactcaggctgttcttgccctcctgctgaattcaagacttacacctccagtgtgtatggaccacggtgacgtcgtagggaacatagaaaacaaaacctctttttgttcctttttagtaattgtaaaattgggttgttttgttttgtttttggaggcagaggcagacggatttctgagttcgaggccagcctggtctacaaagtaagttccaggacagccagggctatacaaaccctgtcttgaaaaaccaaaaaaaaaaggatagatagatagatagatagatagatagatagatagatagatagatagatagatatctttctatccatctatttagagtgtgtgtgtgagcatgcgcacacgcgtgcatgctttctcatatgagcacaggtacctggaggcactggatcccctaggtctggagttacagttgatgtgatccacctgtcatgggttctgggaacctaattcaggtcctcaggaaaagccgccagtgttctgagctgcctcaccatagaacctctccagccctcacagtcctttttcttaatttattcatcctagtaattatacagagtaatggttctctatgacatttttgtacaggtcattgtattttgctcatattcacccccccccccacagcctcctttttacacctcttcccctgcatcccttcctccccagatgctcccgtttctacttttgtgtcacttgtgtgtgcgtgccatgtccttcctcccagttggtttaggtttttatcttttgcccctcccctgactattacaatatagcctgtagataacaccatacacagctcaattcagctatgaatagtaattaattactatacgtggctacaactccagtcccaggttgatttggtttgtcttggttttctgtctgtgtagcccaggctggcccagaacgagccatactcaagcctgggctccttgagtacttggatcacaggctcacaccatcacacctagctcagtcttattcttggtcgaacataagattaaggtaacttctttttctttgctcttctgggtatgcccatgactgaaccagcccaataagtccagcttgcattttgcgtggaggcttttcatggccagttttcaggtgacctttattctacctagtcatctttaaaatacaaaaataagcaaataaatgccttctactttcataatattgtcatttagagacctctccaccacaagatggtgccccagagtaattaaagctatggtttttgtcttcttccttattaatctctaattttgtgaacttggggcagtttctcggagtcagggtatgactgtaaagatttggttgttttttttttttttttagactatgtcttcctggctacatggaaaattgaaaaacccagaatcaagcagtgtggggttgtgttgtttgattgtggtaccaaggcctgaaccacagagcttgtgatgctgcacaggtgctccaccgccaagccaacatgaccttgtgtcatattagacaggctctcactaagtttctcaagctggctggcctggaatttgagaaccccctgattcagtttctgaaatactgtggactattggtatgcagcaccattctgggcttacatgtgctttaacagtcttaatatttttgcaagaatttgtagtaattcttaatgcaaacttttagaagtgattgccatccctattaatgggtctaatttctactttgaatctgtgttcatagaaaataatgtataatttcagcatcagtttaaataaatggaagacccagaaaatgctacttacacctgagtacttgagttcaatacctgcaacccatatgggtggaaagagaatcacctctgcaagttgtcctctatcttagcacagatcagaggccctgtgtcatgcatgaacaggcacacacacacacacaatacatgtaaaagaaaaagagggtaaataaatagagtccagcacagtggtgtatgcctgaagttgcagctacctgggaggttgagccaagaaaatggtgagtttaaattcaacctggttaacttatcaagaccccatctcaggataaataaataaataaccccaggaatgatataaaacctacgatcccgggactcttattcttacttccagctgaggttgggagtaccgggagtaaaggctctgactctaaaacaccaagtattttcacacacatgaagatgtatacatacacacacacacacacacacacacacacacacacacacagtgcattctgaaagacaggtgcttttaatgtcttttaaagtgttgaattactgaatcatacttttggtttatcatcatcattatttctgttgctcttgcgctgtggggtctttctgtacagcccaggctgtcctgacactcacatattccagtctggacttgaacggcctccgtctgctgagtactggggttgcaggcatggactgacatgccaggttcctgatgttgggcatattctttagctaatcagaacatgtttattaaccagcaagtatgtgtacagacagatcttatattttcctaggcttgatagacaactaagaaaaaaattatcaatctctcactagaaacagtatgtctttaaattttttgtaaactatggtaacacccatatgctttgcacataagaaataactattgaacatgcacacaattttgaagcaaaaaactatatttaaaacaatttttaaagaattattgttgttattaccagtgggggatttgccgcagcacacatgtggagatcagaagacagctttgtggggatgctcctctccctccaccatgatgtgggatctggggactgcacttgggtcaccaggcttgatagcgagtacctttaccggctaagtcatcctgatgctctacaaaagctgcgtttcactaattacaaactttccctgggaatctccactctggccctggcattcttcttcgcttgtgtattaagcagatgaatattcatttgttcccattttaaactggtagttagggggcaataaaaccaactactttgtgctgggcgtagtggcacacgcctttaattccagcactcgggaggcagaggcaggcagatttctgagtttgaggccagcctggtctacaaagtgagttccaggacagccagggctacacagagaaaccctggcttgaaaacaaaacaaaacaaaacaaaacaaaacaaaacaaaacaaaaaaaaaaacaactgaaagactcagaggagccccttgctcaggcctcaggacaatagttgacacccaagaactcacgatagaccaagcttgatgcaaaccacatgaggctttatttggggaaagccagagctctggggacaactcatatcccacgcaggggtagaggagtcgacctcgagggaaaagagttcccagtttttataggccctcaggggagaatggagaagggggagagtaggggatttccagatctaaacaatgtctattctcaagaaatgggtatgggaggggtacaaggaaagagtctggtacaggtgtagcaactcaggattggccaggctgtggttgctggggagattttctgactctttcccagcaaccaatatcacaaacacctggcagtgaggtgcagcagtgggcacacacatgggttcaaggaacggtcaaaacattggcagacacacgggttcaaggagtggccagagcattgtgcacctctatttttctaaatcagtgaagctagttctgctaacactgacatctatcttgccaatttcaggccttctgtgacctttttacattctgtcaggatctttcaaaactactttgtaaaatcatatttgcagtagagtagggtgaacaaaacaccagggtaaacataaaatataccaacatacagtagagacagaaaaaatataccaatggacagtagaaacaataacaatataccaatagacagtataaatataccaatagagagcagagagagtaaaaataaaccaatacatagtttagacaaggacagaacgcttctgtttgagagagtttttgtttgtttgtttgtttgttttgttttgttttggggggggggacagggcttctctgtgtagccctggctgtcctggaactcactctgtagaccaggctggcctcgaactcagaaatccacctgcttctgtctcccaagtgctgggattaaaggtgtgcaccaccactgcccggctagtttgagagttttgctgctgtttaggaacaaggcctcatccagcctttcttcttttgtcatgtttgggagttttgtttcagacaggatcttgctgtgtagctcaggctgatctcaaactagtgattctcctgcctcagcctctagagtattggggttatagacgaggtgttaaccacactcaactaaacaccagcttggcaacccaagttcattccccagatcccacataatgatagtgaaagaacctagtggggaaacccccactcaattcccaatttggcgtgcacccaagaatcacgaacagacgaccatcttgatgcaaaaacacgaggtaatttaatggtggatctccagatctaaacgtatctcatgcaggagacagtggtttccgatcccaagccttggaagctaggggtttttatagaaaaggggctggggctgggggagggattggcgtggattctacacttgatcttagccaaaaggccgagaagcgattggcgcggtttcacatgattggttcatttaaacattagcagactgtcaaaagggtgggagatagggaggcgcatgtcattctctttctttatggctaagcagcctcaggaatgtctcaatgactggcctgcccgtgcatgttctggcctgttctgctatgttctcagccccaggtttcaaagctcacaaacaactctttgggctatttgacataaattacatgaatcacaggtctcgttttattttctttcaatagaaggagaggacctcgcccacaaagctgtcctctggcctccacatgtgtgctgtggcaaattcctcaccagtaataagaattctctcaaaagttgttaaaagtaatgccagatagtggtgatgcacacctttagtctcagcacttgggaggtaaaggcagggttcgagaccagcctggtctacagagccagttttaatatggtcagggctacacagagaagtcctgacttgaaatcaaaacaaaaaaacaaacgaaaaaaaaatgtttaaaaaaatatatagtttttgcttcaaatttagggtaatgactttggtgtcccatcactatccaagggaactctagcaggttcattaaacacagctgataagtccgtctacagaaatccacagctggagccagtatagcatgacctggcaggggttaaaaatttgtaaactggtcatggtggttcacgcctataatcccagacctcagtatatggaggtgcaagggccagatgttcaaggccacacttggcttcacagctggaagccagcttgtgctacctgaaagctgatgttaaacaaacagcaacaaagaaggcattaacttatgattttcctcaggctttaaaaaaaaggacaattattaaaagctattctcttcctgctaggaagagactcgcccgaaggaactggctcgaagaacctgcccagttatttgaactttctttgtttgactctgtttttttagctcctgggtgtggtttctcagctagcccagcagaatctacagttgctggtcctaggccggaagcacatgctgagacccagttcccagtggagaaaggaagagatggagcaggtgcgaaagcaagcccactgtttctttgctgataacatgtaagtatggaagggacaggtgagttagacagggttccagtcttcgctcacgagttatctagtctatcatttagaaatgcaggcctgtgattatgcagcctcatttaaaacgaaaacaaagagatgaaggtaagtacaaagtccaacatccacagtagaacagatatgcaggcgaggaagtcagcacacatgagagagggggaagtggggctggagtggggctgctactcagcatatacgccatgaactcctaaatcgatcgatgagcagacaccgacaaatgtgaacgcggcggccatgtctgcccttagtgcttagtgacagcaacaaaggccctgccctttagtcctgacgaacaagccagcagcagcctccttatagccagtgatcattgctgagggaaggatgcctcacactgggacagcaggggttcaaagcacaggaattagctggtgaagaaaaggcccgtatgggtgggttagagcagccgaggggaaggtagtcctttgggctggggatgcagttcagttgggagaaagctctcctggcatgcaggaagctccgtgttccaccccagctctgtgtaaaaccagctgtgctggtactggactaatctcagccctgtgaggtagaagcaggaagatcaggagttcaaggtcatgctctactctacagaagccatcctaggacacgtgagaccctgtctagaaagcggggaggggaggggagggcagcggaggggagggaagtttccaaatcaaagagaaggaccatattgcagaggacctcactgggacctgcatttattctaatagaaaacgctgttgcgctccatcttcccgggaagctaaaggaacatggaaagcaggattagtaaggccatatgcagttcataaacagaaagcagctctgcaggaagggaacctggaccacactgagacccgtcagtgtgcccacaggtcttcacacttagctgccacacttaggtcttcacactcagctgccacacgtttatttgcaggcatccccagctctcactttgcagggcgtgtgtgccttagccctaagtttaatgctcattagttcagaagtgagagcttcaaggtttttccggaatcacacaaagaatttattcttataaaggtaaaaatgcctcttcacgcacgagacaggtcagctcctcgttcggatcgcaaaccaaaccatgtttttaagtctaaagaggacatttccattgctttgagagcgttgctaagcattaggaggataccttcctgctcatgtcagaccacggacctgctgttgcccacccagaacagtgtttgcttcacatataatcttgatgttgttgttgtgaagggtaaatggttgtaacacataaaatctggcaccacgttcatggaatgcctgtgtgttcattactgtcaccgttgttatttgtcttataaagaggacctggataaatcatgtgctataacccaggagtctcatgggagtgggtctggctccctgctttggggcctggacttcagcctgtacttaatgtgcctgctgaagttctaagctctctagtaaagactaatccattgcacctctggatttagatatgtatacttttaatgttcacttgtattctctactaatgtactaaacaaacttttaaacaaaaaaatagagcagtatggtgaactcccataatccccctgtaaatgcaacctattctaacattccactctcttcttataaaactcctgtggatttttaggttctttgctttgctttggtttgctttggtttggtttagtttttttggtttggttttttggtttggtttggtttggtttggtttggtttggtttggttttatgtaccctcagcttttcactgcattttagagagtgtcaccaactaaggactccaagtgctttatggagtcattcagatcccgtctatcaaggaaagagagcctcttctgcctcctggagtgtctgaccgtgttctcccttatgtctgctgcagctcagaggatgatcctttccttctgtacgccacactgaactcaggcaatcactgcaagtttatcaccaaagacctgttgcgggaccacaaggcctgcctgccggatgcccggactcagcgcctgttctttaagtggcagcagggacatcagctggcaatcatgaaagggtttcaaaaatcaaaactaactttccaggtatggaatctgttctctaagtgacgctaacagaccagacatgcctgaagaagagaccgttgcatagttttttttaaatgtcacgagttgaaagttctaagtatttgttatagtttagcatttggtagttagccagttcctagaaacagcatctgtcagggcaaaagtatttgtaggccaactgcaaattgattgacagattgaaacctgtggagtggcataattgtgcctaaaactgcaccttcacccacacctagaccctcacactcgcgtgctcccacctacctgttcccttgaaatacctcagtatttcttatgctgtctacttttccttttaagcaacttttccaattttttaatttaaattacatttgtgtttttaagtgtgtgtgtgtgggggggcgggtgaactcaaagccttgcatatgctaggcaagtcctctaccactgaaccacatccttaacccagttttctctttttatctggggacaggctagttttggacacactaaactcaggcagatcttgactttagaatcctagtctacctgccaggccccactaatgtataatgttctttttttgttgtttttaattgtatgtttgtatatgtgtctttgtgggtatgtgaacgtcagtgcaggtgcccaaggagacaagtgggtattgggttcctggaggtggcgttacaggcaattcgttgtgagctccccagtgtgttcactggggaccaagctccggccctctgcaggagcaacaccactgagtcatctctctagcccacgtgctatatttctgaagactaataagagagtagagtctagattttctcgttatgaaaaaataaaaagttggtaactcacattaaatagcttgagtaaccattccacagtgtatgaatattacaaaatatgttgcacatggtactataaataagtttattaattttaaaaataggctaaaatgtgaaacaaatttataggaaagagtatcccatgatatcacagcagttattaaatcagcaaaatcaggactgtatgatgggaaatgagtcaaaacaactgacctgctttcctcagaaacaaaaccaaaaagtaaaaatagaagttcaataaaaattgagatgagaaaggaggctctagattcaaaaagtgtcagataggtcagtctctgacaaaggaacaatcctatgctacttcccatttaacaagcaaactataaaatatatgtatgcatatatacaataatggagaaaatacaaacgtagacatttgatgaggctaagtaattgttgattattctagtatgtttgtatatatatgtatatatataaatgctttcaactcgtgacataaatacatcaatgtgcatgcatacatgtattttaatcagacaagctttcgccatgtatctctgtctgtcatgaaactctctatataccccaggctggcctccaaaccctctatccctgtctcctatgctgggattactgggtactatgccaccatgcctgtctgatttctgtgtgggtgttggagaaagggtagtaatagcattgatcttagaattacagagcaactgctggtttttagacgtactcatctgagattcacttccagatagtcttttttttttaaatatttttattaggtattttcctcatttatatttccaatgctatcccaaaagtcccccataccctcccccccactcccctacccacccactcccactctttggccctggcgttcccctgtactggggcatataaagtttgcaagtccaatgggcctctctttccagtgatggccgactaggccatcttctgctgcatatgcagctagaggcacgagctctggggggtactggttagttcataatgttgttccatctatagggttgcagacccctttagctccttgggtactttctctagctcctccattgggggccctgtgatccatccattagctgactgtgagcatccacttctgtgtttgctaggccccggcatagtcttacaagagagagctctatctgggtcctttcagcaaaatcttgctagtgtgtgcaatggtgtcagcgtttggaagctgattatgggatggcagtctctagatggtccatcctttcgtcacagctccaaactttgtctctgtaactcctccagatcgtcttatgagagaactatttttctactttctatatttaattttttctcttccacttataaaacctataagcacagcgaaacaatcctgtaacttataaatgtgatactcctatagggagcccttaaccttaaaatgaaccccaccccctttacatttttattttgtttcctgatgtgggggctgggggggaggggataggtcagtgttagtgctcgctgagttcagatccctgcacccacaagcccagcatgtccttgtacatgcctgtggtctcagcactggagtcaagacaggaagatgagtgggatttgctagttaccagcctagcaagaaaaacacaagctccagattcagcccctgattcaaagaactaatgtggaaatggtaggaaagggcacattgtccacctacagcttctgtgcatacacaggcatgtgcatcagtacatatgtgtgcatgcaccactcacacagatatacaaaggaaggaaagaaggaaatccagtgtcaaataaaactcagtcctcttccaaaggaacagaaaagattggatagaggttgatagccctccgatgttcaccgtttggctctctctaactcctcagcatatcctcagctatgacacagtggtacaaaggactggagactcctggcacattccttatgatgaagacctggtgcagagatcctcctgtgaagtgccaaccaaatggctgtgcctccagagaaagacacccgacccctgctgagtcgcatggcctcctggctggttcacagctcttatatccatgctgatgtctgccatgacctctgtcctggaaataaaaagattttagtaacacttttcagtttagttggttttgcagcgtcaaactcacttttaactttgtgtggtcttgtttataagactggtggggtcctgtttgtagcccttcagcctccctcctcccgcttttacttcctgaatgctgggcttacaggcgggaccaacacgcctgctgtgtgcagtgcagtagacgggacctgggcttcacgtgtacaaggaggcattctactagccctgcaggctacatgcagccctagcccagcaagttgacgaatgagagcaggggttctgccacactcacaacctgccctcagttggtcattggaataaagatgaagggctagctaggttgcccaggctgatccagggcttctacacttaagcaacactcctgccctggcctgccaaatatctgagactaacctgtcactggacccagctcctcatatcttaatttaaaagcaggaatagagaggaggatggtatgtaggcatctgccaaagtaattggcacatagctaaatgaggtccctatctggtgtcttttggttgattggttgttggttggcttttttgtttggttttttgagacagggtttttctataaaataggcctggctatcttactttgtagaccaggctgcccttgaactcacagagatctgcttgcctctgcctccagactgctaggattattctgaccactagaatagtttgttaccagggagccctcgggatactcagctggatagactgaggctttgggctttttccttaaggcagcgtctcactttacagccctggctggccagaaactcactatgtagagcacgctggcctccaactcttttcctacctctgcatcccaagccctgaggtaagggtgtgcgataccacgcctgtataaagggtttaaggtggttttgttggtgatggtgatagttttatgcttgttgagaaggataccaaggggtgtctcgcagtgcgtacctctctggtgaggagcttgcagcccttcatttgcctgaactgggtcccaagtgctgggttgtaggcatgagtcgccatgcccacttagatggaattattaaaattgccatgaaaggggctggggagatggctcagttggcaaagtgctctccaaggaccggaggacctgaagttgatcccagtcctcccatacagagactaagcttaggggcatatgcttagacagcactggggaagctaaggcaggctcacactggtcaccctgctgatccggtgagctttaggacagagaaagagcctgttcaaggtgaatggcttctgaggaacaacactggaggttgtcctctggcctgtacacgcacatgcatgccacatgaacacaaaaaagataactgtggtagtttattataattagttgttaacatctgaaagatttttggtaactctggaaaaaaaaaagatcttttcaactaagctaaaattaatacactagtcatctactccaagaagcaaatgcctgagaagtcactggtagcaacttaatctctaatatgttagagaaataaattcaagatgtcaggtcaggcaacctcatcagctctcaaccgggcagaccattattggggatcaagctcggctgccatttaagtatttaaagtccattgctaaagttctcccagactgtctatgaccacataagaagagaatgtctgtgaccactaggtgccaatggaattcctgagggttctatccatggggattttctggggccgagctgagtcctgggctgaggggctgggacaacgcatccacctccacgaaacagcttctttttggtggatatggccagtctccgaaaaagtaagtgcctcgtttttggttattcggcaactgaagaggcagggaaggctggctttcccttgtggactctttttgtagactttgtaaactttgtaaaccctcagggcaggaaactggccaggtccctgcctggggagctctgctgcagccatgtcccctcccccagacctccctaactgccgtaactgtgtttccagcctcagtaacgacacctgcaaaagttatctccagcccctcaacaggaccctccccagattatgctaattttatgaaaaaaaaccaccaatccctgaaccagaaaatccatctatcccatcaatgaaactcaggactttaaatcccaccaaccctctccactctagaaggttccacacaacccccccccacccccacccaagagcccctatgtaagcactgcaccttgtccaatttgctgctgtctgctccctcccaggagcacaggcagacacagacacagacacagacagcacacacactcctgggtttgtccctctcctctcctcagctcaggctagccctttgtggtaaactatagcccctccgctgagaactgcagcgcctctgctgaggaggcttcctctcagagctctgtggttcctgggctcctgtgtctcaggatgcccttccactgggacactgttccacctcagagctgtatggttcctgggcttctgagtccaaggacaccttcacagccaagcaaaaaggccaacactggcgtcacttgttgcataaaatctgtatcagtgggatcattgcaaaaaaagaaattattcttagattttcttcctctttagtgaccttgccctagaatccaaggttccttttctttctttttttttcttttaagatttatttatttatcatatataagtacactgtagctgttttcagacacaccagaagagggcatcagatcttattacagatggttgtgagccaccatgtggttgctgggatttgaactcatggcattctggaagaggagtcagtgctcttaactgctgagccatctctccagtcccggttccttttctttttgagacaggctctccctgtctatagcccagaatgcactgtgtagatgaagctaacatacaagcttatcagattttatgtgcctatgtacacattttctttgtttagacagtcttctggcatttttatatacattattattgttattagtattattattttgggggggggggcagactttctctatgtagctctagctattccagaactcactctgtagaccaggctggtcttgaactctgagatctgcctgcctctgcctcccaagtgctgggattaaaggtaagtgccaccaccacccagctgttgttcacgtacattgtcatatactcataatgatgtaaattcacaggaagagttgactgggagtcagatgtagtggtgcatgtctattattctggctggaggaggaaggccaggagttcatctttagctacttggttcgaggcctgccttagctacatgagaccctgtctcaaaacaaaaaggggttggctgacttaaactagggtaacatgcttctcttgtggctacattgtcacactcgtactctgggcttgcctgagttcagaagaaactgttcccagaagcaggctaacacgaaaagtctgcatcctttggcacttagtctattccagcaggagcggtcacatccttgatgaaccggatcctttccaggtcaggccctctgatctccagcttagagagaactctggccaggcccgagtttgtgaagagaacataaagagcttcttgttattcagagcgaatcacgtggcttttgttgctgttaatccaggcacaaaggaaagtttagaggagaaaaccattactgaacattttgtactttgcaaatgtcaagaggttatttttctttcacttccagaatctccagagtctcagcctcttaccctagtgattcttggccctctgtgtaatggcccctctctttctctctcctatttctgacttttgggttttgaacagccgtctctcacagctgaggcttgcttgcctcaaccactatgatctttctgcctctacctctacttcccagatgatgggctaataggagcgctccgttatacctgactctgtgtgtgtgtgtgtgtgtgtgtgtgtgtgtgtgtgtgtgtgtgtgtgtgtgtgttgagattaaactcaaagcctagtctctccaaccttacaaagtcttgactgcctagccctttctggtgtcatcagacttccccctccccctcagagcattccgagacagcatcaacaccagcatagtcttccgtttgcctcacttgctaccgtgtctgtcttttcaatcccagtagcggatttctgctctcttcactgctctaccccatagcacagtgtttcgggggaggccttgagcttatggcgttgggcagcactctcctttgaaaacccctcttgtcatcttaactccggaaggtgctttcccaatcttttctgtcttagcttgaaaatcagctagctggttgtgcctccatcttcgggtcctgaggaaagtaggcaggctgtaacagtgcttcccaaactgtgatgtgctggaatgacctagggatctaacttcaaaggccggttctagcgggaagtataactgcatactagaagagagtgtgtgcatagccccgggttcagtccctgccaccaaaggaaaatgagctctatctcaggaagagtatccctggtggggtgcccacgctgccgtttatcgttccaggagaaagggcctcagtgagccccaagattttattaactacattttagaattacagttgtgtagtgtatgtgagagagacaggaaacatcagctgtcatcctcagggacgctagatacctcctttgctacagagtccttcactggcccggagctcagctaaatggcctagccaatgagcttcaaggatctctctatctctgcctgccctgtgactgggattacaagtgcctgtcaggcctttttccattggttctggagataatattctgctcccccatgatctgcggcaggcatctgcctgtacctgtttagaatttctgttacagaatttcatactccaacttctgaactgtgattttgttaaagtgcccataggactgtgttatctaagggggagcaaagatgtgatggaactttctagagcaaatagttctcaaccttcctaatgctgctgcaaccctttaatacagttcctcatgttgtggtcacccccaaccacaaaagtatttcattgctacttcataactgtcatattgctgctgttatgtactgaatgtaaatatctgatatgcaggacatctgataatgcgacacacacacacacaaggggtggacacccacagggtaagaactgctgagagatatcaactagaaagagaagagctgaaaagaatgggaaaacaagactccatgtttcctgttacaccgtgtctcacacttgctccagaaacaccccgctgccctttccctgacttcttactccatattgatgcgcatttggatagtctccaggccaggcctattacaaataaccctgcttgtgactaataatagggtgggtgggaagctaacatctggcagatgttgtttttttgctttctttactttaggcctctaaagccttcgcttgaacaattaacagtagcctcctggttcacatgctcagctagagttcaccctaaatcctacgacctcatttatctgtccaaagcatatcccagtcaggctccttactctgctgctcaaaaaacatcaaagagctgggctgcggttgtagctcagcctagcacgcacagagccctggatgcaagtcccaaacccatatagccagctgtgatagctcgaacgggcgtaagcctagcactcagaaggaggaggaggggcaggaagttcaaggtctatatgagaccctgtcccaaacaagccagcaagcaaacaaacaaaaagccaaatgtggtcatgtatgctgctaatctcagcactagggaagtcgaggcaggagagtcaagagtttaaggtcatccttgtctacatagcaagcttgaggccagcttgggcaactgtgtgccgctgtctcaaaaataacaacaataaaaaacccgacaagttttaaagttgccttctgtctagagcataaaccccttatctcagtgtgtgtgtgtgtgtgtgtgtgtgtgtgcgcgcgcatacacaagcattttgcaagctattttcttcctctgcttctgaannnnnnnnnnnnnnnnnnnncagcttctgtcatctgctgcacctgttaaagagtccttgtcctcccaagcctgccctctagtgggacagtttctgacacatctgcatataaacttcctttccttcccaacacccccaccccggcctgcagtactctgaaatgccctgtcaagttagcctccctttcattcatccttcttttcccccacaacccgaccccaccctgtgaactcagtgtgtatctctcagagcaggtaggccagttccttgtccatagacatggttcagttagtagtgctgaactgctctggagaaggtgtttgaaatgtcttcctgatttttatctcttttggctagttctcctttgagtgtatttcccctgatctttgggattttgtatgtgagctgagtggccagaaactaagtctatagtgtctgatgtctcatgctgatcaagaaatgctattctctgagagcctggcattttgccacatctgtggagacaggagaatcaccagttcatggccagcctcatctccataggaaatccctggccagccttggctacaagagactgtttccataaaattaacttcttaatactatcttccataatcattccatttaacaaccctctgcccgcccacccagagctgaaatgaattggatgtctctagagggcatctgtacgggtacacggtcctgtggtagctggggtgctgagaggcggaatcccagagtctgtcatcgccgtgttctcatgtttacatcttctgtcgctggctgttttttcaaacatgtttttcttccccactgtgaaacaaagccaattcagagtagctagagtgtcctcaaccgttcctgccaacaactgaatcttcaagacgcagttcctaagtcagcatgccggaggtagaggcaggaaaagttcaaagccagcacttggcgacctagaaagttctaggccagcctgcactaaggaacctgtctcaaaagaaaccaaactaaagtgggagggggaaagacaaaaccaaactaaacaacaaagccttgcttctaagtcagtgaatgaaaatgcttgtttaatggtcagaaacctcactcatttgcatgccccctgtctccaattaccccaagaggatatgtcctttgagcatcagcctgtcacttctgtggcaagaaaataggaattagaggaagccaattcggaaacctcaaagaagaggaagtgtctccaggctgaagggaaggcttcggagtcttacttcctctctgttctcgatcctccgggtggtcccccccacccacacaccccagacaggaaacaaggtctgggatgaacaagggaaagtctaaaagactccaaggtgcaaggacgcaccacagctgcgacagtcacaataactgattgatgtttgcagttccacaacgctgcccattcatgggtgcagccggactgtatgggacaggatgggtaagaagtagccactgtcccttctgagtacctccaagcgcactcaggtctgtgcagttcttggcttcgcagtttcctgggactagagctttctgaggcttgtttgcccacaccccttccaagcagagaagctgagttcaaatctagaaataacttgttttattttcgttgtagcaactaatttgatttctactttgcctttaaagtagagtcaggatgctcctgtttgagagaagagaccacaggcgtggtcagtgggtggtaagcctgtggctaggctcagattcaaacactgtttctgagccttgcgctcagagcccacgacgttgtctctcttttccctggattgctttttacagaaccgttcactgttctctggagctctggaaagcttcccgtgttagcctgagggaaagcagtgtgccacaaaccaccaatggctaagactaaaccaggtgtgctctcccagcgtctgggcagattaatgagacttctcaaggaatttgcaatctctctctggcttccagaaacttcagctgagcactgggtcttcagttaaggcagtctggaaaaacaagagaaacatcacaagtctaagatggttacagtgaagttatggctaaaaaccaagggtgagctgcagaactgcaggtcttggctgtgaagaaggagtcggtgaacggttatagttaaatgcccatgtgattgaaccaatacaattccctttcaaatcaaagaacagcatttatcattgttggtaattgctgagagaacccaggtatggaattatattgactggtaaggaaggagatggcacagaagagaaataacaatacatgtgtctgctctgttgatagacacagcattagagtcagaaagccacactgcataccatggacaaggggaatcgaggagcactgctgtagctttagtgttttcaatggctacttttactgatggttcttaaatgctttaacctcccttctagcccaccacccaccagaggtagtggggaaaaaaagattattgggatatggggaagtggacctgtttaggaatggttctttgaagcaaatcccatctgcattgtcaagaaatcagctgttcaattcccaggtcagcagtggcagcttgatccactcgcaaacacttcacggatataccagcagtccagctcagtggtagcagcagcgggtggcaccacctagcaggaacaggtagacctcagccaaattggcacgagtcagcaggagggaacaggaccaacaggaataccaggagcagttctttgctgtgcctctctcaatgaagccaagatcagtgaagatgcaagaccaaagagtgttgcagagccagctctaccagcaagcccctctcacagtccattcagtcccatttatccaccctccaaacatcacgtgacctccatgagtcctgcctcaccacatgccttgcccaagcacatgagtcctgtatcagctgacatcattctgccaatcagccatagtccaaggaagccgcaaaaaaggcgccagcgcatcaccagaagattttttggcacatttctccctatggagtcccaacaaacgcagctcaactaggaaatgtagggtggaccaatacataccatgtcggtagcaaagactccttcatcacgtgtcctttcgcgtgcttgcgttagcagaatatcctttcacctgtgtttgcttcaggaaaacactccttctcatttgctccaccaaaacaccgtccaacacaactgactttccaaagaccccttaagtttcccacttcacactgctctattagaatcctgtcaggtaggagtgtgaaggttttaagagtaaaactataatgaagttgaagctagagagatggctctactgttaagaacactagccattcttccaggggtcctgcctgggtttgattcccaacacccacatggcagttcatgaccctcttgtgactcctgtcccaggggacccaatgactttttgtgacttccttgaacactgtatgtacctagtgcacaagcatacatgctgacaaaacattaatacacatgattttgtcataaagtatgaagttaacatgtttcagaaaccacatcccagcccacatctgatgtctcatttgtccctctcctttgttcatagattatgggactagagtacagataaactgccttttctccttcacagtacttatcaggattactagactgctagctattcaaacacagctgctgagctgcaagatctgctggacagacttgagccagggaaagagatgggttgggttttgttttgttttgttttgttttaatgagaagactcagagtcttgtcaggcaatcaactggggagacctggttggtgaaag

SEQ ID NO: 1166 - DNA, 2429 bp, Mus musculus
accgcgtttatggttcctttaagcatgagtggcgtggtgagttgtttaatgaagtgaacttcgtttgtcgaccctccgtacagttaagtctgagctctttctggacctcacttccttccctatgatgtttatgctgcatttccatggcccctcttctccgaagagttttgcggcccggagagagttgtgaagagcaagggaccctagactggcttttcttgctactgctggggctgcgattggtggttcctgttcgttgttatttatttccctgttctagctcctttggtatcccgcccctcttcgggaccatcataatccacacgagtcaaactgggagtccatgtgctttttcctcagattcgaaaattggaaggtaacaggcacttcaggattcccgttccgccttctggtttagggattgctactggtgttggacgtctttggatccttatttaataaatagaacacgtgtgctttccttaccattacatcgctccaaacacatagtcttgatttgtttgtaacggagaaacaaaaaaagtctcactttcaagaactgcgcttccatatcctcgggcccccaataccttaattttacgtagtggagtgaaactgttttatttttaagtttcattcaactcactgcagcatgaccttctatttgtctggttttcggagcatcccgaaactttggaagagcaacccttactttgagctaggccctgcgacctcttctacccccttctttctctgtgccatcgggaaccaacaaagatggttttctgttaaacctactacccctccaaatagcaaagcactcaatctactggataccaaagctaggacacacaggaaagggaatgacaacaatgggcaggtttcttctgatcctcattacttcgctgctggagcagctaagaagaggtcccacataggtgctaaccctcagaatcaaggtcatgccttgcccgtgagaagctctgtccaacttccaactaaacctttgaattccgcagagtgggataaacttaaagaagatttcaaaggaaaggccagttttgaagacttcatcatttcacagatggcacgcaactgttgttcagtagatgtggccaagtctctcctggcttgggtagcagcaaagaacaatggcatcgtgggctataatctactcgtcaagtatttatatctctgtgtctttcataagcagacgtcagaagttattgatgtctatgaaatcatgaaagccaagtacaagagtttagaatctgggggttatacccttctcatccggggattgatccactcagacagatggagagagtccttgttgctgttagaagacattaaaaaagtcatggtcccttccaaaaagaactatggtgactgtatacaaggagccctccttcatcaagatgtgaacacagcttggaatttgtatcaggaattgataggtcataatctcatccctccgttggaaactctaaaagccttctttgattatggcaaagacataaatgatgatcactattcagacaaactcctggacatacttttgtatctaaggaataatcagctgtatcctggagagtcatttgcacacagtataaaaacgtggtttgaaagtggccagtgctcaggctgtggcagaactatagagcctattcatctgagtccagaagagtatgagtttctgaaggaaaaaatcatgagggatgtgatagatggcggcgaccagtataagaagacgacacctcaggaactgaagagattcgagagctttgtgaactcctgtcctccttttgatatcgttattgatggcctcaatgttgcaaaaatgtttcctaagggtcgtgaatctcaaaatctagcccagcagaatctacagttgctggtcctaggccggaagcacatgctgagacccagttcccagtggagaaaggaagagatggagcaggtgcgaaagcaagcccactgtttctttgctgataacatctcagaggatgatcctttccttctgtacgccacactgaactcaggcaatcactgcaagtttatcaccaaagacctgttgcgggaccacaaggcctgcctgccggatgcccggactcagcgcctgttctttaagtggcagcagggacatcagctggcaatcatgaaagggtttcaaaaatcaaaactaactttccagcatatcctcagctatgacacagtggtacaaaggactggagactcctggcacattccttatgatgaagacctggtgcagagatcctcctgtgaagtgccaaccaaatggctgtgcctccagagaaagacacccgacccctgctgagtcgcatggcctcctggctggttcacagctcttatatccatgctgatgtctgccatgacctctgtcctggaaataaaaagattttagtaac

SEQ ID NO: 1167 - protein, 574 aa, Mus musculus
NCFIFKFHSTHCSMTFYLSGFRSIPKLWKSNPYFELGPATSSTPFFLCAIGNQQRWFSVKPTTPPNSKALNLLDTKARTHRKGNDNNGQVSSDPHYFAAGAAKKRSHIGANPQNQGHALPVRSSVQLPTKPLNSAEWDKLKEDFKGKASFEDFIISQMARNCCSVDVAKSLLAWVAAKNNGIVGYNLLVKYLYLCVFHKQTSEVIDVYEIMKAKYKSLESGGYTLLIRGLIHSDRWRESLLLLEDIKKVMVPSKKNYGDCIQGALLHQDVNTAWNLYQELIGHNLIPPLETLKAFFDYGKDINDDHYSDKLLDILLYLRNNQLYPGESFAHSIKTWFESGQCSGCGRTIEPIHLSPEEYEFLKEKIMRDVIDGGDQYKKTTPQELKRFESFVNSCPPFDIVIDGLNVAKMFPKGRESQNLAQQNLQLLVLGRKHMLRPSSQWRKEEMEQVRKQAHCFFADNISEDDPFLLYATLNSGNHCKFITKDLLRDHKACLPDARTQRLFFKWQQGHQLAIMKGFQKSKLTFQHILSYDTVVQRTGDSWHIPYDEDLVQRSSCEVPTKWLCLQRKTPDPC

SEQ ID NO: 1168 - DNA, 175077 bp, Homo sapiens
catcagaaggaacagagttaaaggagtataaaccaaaaataaaattctaaggccccccaaccatctgaatggacttcctcctcagtcagcgcccttaaaatttaacctgagagactgtttcagggcatgatgggaagtgggggtcaaacatgcctcgttatacctctctggcattaacatcaacacagactttaagtctaataagaaacattttgcaacctattctctctgaagcctgctagctaaaagcttcatctgcatgataaaaccttggtcgctacagcctcttatcttaacccagacattcctttctgtttgatcccaggtttttagacaaactcagccaagtgtcaaccagaaaacatttgaatttacctgtagcctggaagccccacttcaaattgtcccacctttctggatcaaaccaatgtatttctcaaatgtatttgattgatgtctcatgcctccctaaaatgtatgaaaccaagctgcacccaaaccacctttggtacatgttctcaggatctcttgaaggctgtgtcacaggccatggccactcatatttggctcagaataaatctcttcaaatattttacagagttcaactcttcgtcaacagaagaaacattaggagatggggatggggctggagttgggggtgactgacattgtgttctagtggctagttaaccagctaatcagccaaggagagaagtggtgactcaagataataggtgttttctctgaagcagtgggaccatggagaggaagaagaaagaagggaaaggacttttttacaaatccatagctgcagacaggagaccatctaagatctagaggtggccaaagagagaagtgacacgaagaaaggaaaaaaaggagattccctcaggaaccagaaaaagaaggcaaaggtttggtcccggaagtacaagaaagttcagtcctgggctcaggaacggggtcacaccattcctatccaagagctgttaggaatgagacagagtaggaatgggggcttgggtcagctcactcccactatggcactcttttcatgcattcccactgatcacaaaacccacaccactacctcactgacaccataatgtccaaaccatgccttttactcaaaagaattccagtaactaggagataaccaaagttgtgaagtgagtgtcctatctggggaaggaatgctgaacaactgatttacagccttgttgcctctagccagaccaggtggcccgctgctcaagataaccatagcaaccagacaatgctgacctgcataccctacctgatctgctttgcccagcccagcctgcataccccaccctaatatcaattcctgatttttttttaaaaagccctaccagctcttttcagagtcaggtgctctctctcccttttgcattgagaacccaagaacctatgttcgataacagtaacatattatttaagaatccaggttaaatgagataaagaatacaaagggctctgcagtgcttagacactcaataaatgtcaattcccttctctctcccctcggctatcaaaaatattcagttatttagctgcctctgtttaaggaaagtgtgaaatgcaaaaagcagtaaaggtatgtatgatgtaatcccatttaaaaaaatacacagatacccacagaaatatgtagaaagattcatataaaatgttctgtttacattgttgggtgatgttgtcatgggaagagatcaacttgtttagccatattttttccttttctacaataaatataggctaggattacaggcatatgattcttaaaaggttgagaagtatatagtattataggaaggtttccaataaaaaatgttcggttgaaaaaaatttgcacttgaagaaatatttcagtatctggataactcacttatataaataccttaatctgtaagaacaccagctaaatcattgtttactatacttgcaaataacgttgtaattaatagagttagaaggtaataggttcaaggaacatccagctaagattccagttaacttgtataatactaaataggtatttttcagtagatttcagtttcaggtataaatagctttttatttttattttttttaaatagacaaaatagaccttaagaaaaaaaaatagacctctaaaaaaaaagatgggatgggccagcatggtggctcacgcctgtaatcccagcactttgggaggccgaggcaggtagatcacctgagatcaggagtacgagaccagcctggccaacatggtgaaacccggtctctactaaaaatacaaaaactagctgggcgtggtggcgcacacctataatcccagctacttaggagggctgaggcaggagaatcacttgaacctgggaggcagaggtcgcagtgagctgagatcgtgccattgcactccggcctgggcaacagagtgagactccatctcaaaaaaaaaacaaaaagatggggtgtggggtggtctcactatgttgcccaggctggtctcaaactgctgagcttaagagattctcccttcctcaccctctcagagtagctgggactacaggcgaattgccctaccattgccaggttgtaaacggcttttttttttttctttttctttttttttttttgagataggctcttgctctgccacccaggctggaatgcagtggcatgatcacagctcactgcagcctcaagctcctgagctcaagcgatccttccacctcagcctcctgagtagcggggactacaggtgcgcaccaccatgcccggctaagttttttttggagagacacgatctcaccaagttgcccagactggttctcaaactcctggcctcaagtgatcctcctgatttgatggcctcccaaagtgacaggattataggtgtgagtcaccacacctggccaacattttttttttgagacagggtctttgctctatcacccaggctggagtgcagtgaccctaccatgaatagcttttcttaaggtctattttgtctatacgtcccttcatagccattttcagagttttggcacaaggaaaaaataatcaagtgaaattccttttttgtttgtttgtttgagacagagccttgctctgtcacccaggctggagtgcagtggcgcgatctgggctcactacaacctccacctcctgggttcaagtgattctcctgcctcagcctcctgagtagctaggattaccggcgcgcgccaccacgcctggctaatttttgtattttgagtagagacagggtttcaccatgttggtcaggctggtctcgaactcctgacctcatgatccaccacccaccttggcctcccaaagtgttgggattacaggcatgagccaccatgcctggcctcaagtgaaattctttaggttttccataatctatttttcggtttagccttgagcaaaattttaaaactttataacaaagtgtatacctgataacataatccaatagaatacttactactaatatctataataaaaatcagaaagaaaaagcccacagtttaacaactttgtgtttacatacccacttaaatctaaacttgggattttattgggctcaaaatgttttataatagtgataagatcaattacaataaaataatatataaaatttaaaatataattctctatttttaaaacataaaattctggtcctatttttaaaactacttttttttctgggggtggggaggacagggtctaactctgttacccaggctggagtgcagtgacacaatcacggctcactgctgcctcgatctcctgggctcaagtaatcctcctgcttcagcctcctgagaagctaggactacaggcatgcatcaccatgtccagctattttttaaaaaatttcttttagagatgggatcttgctatgttgccctggctggtctcaaattcctggactcaagtgatcctcccgcctcagcctcccaaagtgttgggattacaggtatgagccaccctgccttgccaaaaattatatttcatttttaaactctgcaggacatttgattagacactacttaccctataataaaaccggggaatggtcttatagaattcatttgtgttttttctacctcctttccattcggagtaatattttgtaaataaatccatttcttcatcttttaattcttgttcactttttttttctggtaacaaaacagattaaggggagcacttttaaaatcaagcagtacttttactcaggtcatcctatatattatattaatagtttaattaaaatagttgcagtgccaaaaaggccttcacaattgtgcttagacactgagcatattaacttttctgaaataccaagaatcactaccctctactgaagcagcctcctctacatcttcaaccatttctcatgctccctctacttctgtttatcgctaaagctagtctcttcctcaaattacctctcctacagaactctgtagagtgctcctaattcattcaatgaaaagaatttactgagcacctactatgtacagagaacgctgtagtagacacggaatgaggggtgagcaagacagccccagcccctgacctcatggagtttcagcctcataatcactgtttctctacctaatgtagagaaaacaaacaaaaaaactcatcctctgtctgaagctcaaaactcagggctctattaccctgcaactcgcctgctattggcacgtggctgtctcattcagccaattcctccccacttatttgtggactatggtgactggtacacagtgttcttcacaaggtcctgcaatcatttaggatgaataaacatttatgtgggtgaccatgggtcctgcaactccaaagactttcacctctagttcattctgccatttggttctatgacaagatcacagattttacttgatccctttctgaaatcttaagctcaaatatactctcagatcatcctttctggtaattcaaaacctcactgccataccatttccacttcagcctcactgagctcttgaattctgtgatctattttctcaaaagttattttactctttctggtctcatttccttcccaacaagcctgtaattgtttccttgaattccttttatgactgcatttctgctgcatctgttaatttttttttttttggagatggagcttcactcttgttgcccaggctggggcgcaatggtacgatctcgggtcacggcaacctccgcctcccaggttcaagggattctcctgcctcagcctcctgagtggctgggattacgggcatgtgccaccacgcctggctaattttgtatttttagtagagatggggcttctccatgttggtcaggctggtcttgaactcctgacctcaggtgatctgcccacctcggcctcccaaagtgctgggattacaggcatgagccaccatgcctggcctattatgttaatttttaaccttagaccaaacctataagttaatttctttactatggctcagtgctgttgtagaaaactgcaaaatttttcaagcaaagtcaagactgacaactgaccactgaagttaacaatatagcagtcactgatgattcttgacaagcaggaattcgagacgagtacagatttaaccaacaactgttttaacaaatattgctataaggggaacagaaaaatgaggaatggctagaggtggaaattaagtcaagaaagtttaagatgggagaaataccagcatgtttatatgctgatgggaatgattaaagaaaaactgatgatacaggagaagggacaactgcaagagtacatccttcagcaggcaaaaatggaatctactacaaaggataggatctagtacactgatgaaggaaccagacttacgcaggtgctgtacaacctatataatttacttattattttattatttctctccacactaaagtgtaagttctacaaagacagagatttttttgtgttctgctataagctacaacggtacttggcacaaaacaggcatgcaataaatatctgctaaaagaatgcagtgggtttaagagttaaggggtcaagaaagcacacaaagtacaagtacaggtaccttccttttttttttttttttttccgagactgagtctcactctgtcacccaggctggagggcagtggcgcgatcttggctcactgcaaacttcacctcctgggttgaagtgattctcctgcctcagcctcctgagtagctgggattacagacacttgccacaatgcccggctaaattttgtatttttagtagagagagcgtttcaccacgttggccaggctggtctgtctcctgacctcaggtgatccacccacttcagcctcccaaagtgctgggattacaggcatgagccactgcgcccagccaagtacaggtaacttctttgagaagttttcctatgaagagtgcagagaaatgcaacagaagctggagagggatgtgggatcaaatgacttttttttttttttttgagatgtagtctcgttctatcgcccaggctggagagcagtgtcgtaatctcagctcaccgcaacttctgcctcctgggttcaagcgattctcccgcttcagcctcccaagtagctgggattacaggtgtgcaccactgcgcccagctactttttgtatttttagtagagacggactttcaccatgttggccaggctggtcttgaactcctgacctcaagtgatctgcctacctcggcctcccgaagtgttgggattacaggtgtaagccacagtgcccagcccaaatgaattttttttaagacagggtctggctcttgtcacccaggctgcagtatagtgtcatgatcatagctcactgcagccccaaactcctagactgaaacaaccctccctgcttcagcctctcgagtagctaggactacagtggtgcacaaccacccgggctaattttttactttctatttttgtagaaacggtgtttcactatgttgcccaggctggtctcaaactcctggcctcaagcgatcttcccatcttggcctcccaaagtgctggggttacatgaatgagccaccgagcctcccaacaccactacccccgaccacccaccttttaaaaagatgggtgatattaacagcacgtttgtgctggtgtaaatgatccagcagaaggaaaatctgatgatgtaggaaagaaaggaggaggctggaaggaagtcagtgaatacagggaaaagaatgcaatctagtggtggactggagggactcttaaataggagcatggacagttcatcttttttttttttttttttttgagacggagtctcgctctgtcgcccaggctggagtgcagtggcacaatctccggctcactacaacctccgcctcccgggttcacgccattctcctgcctcagcctcctgagtagctgggactacaggcgcccgccaccgcacccgtctaattttttgtatttttagtagagacggggtttcactgcggtctcagtctcctgacctcgtgatccgcccgcctcggcctcccaaagtgctgggattacaggcttgagccaccgcgcccggcatcagttcatcattttaacagtgaagccagagtgtatgggcaactaactgtggggttgtggggctgaaagaaatgttaagggggacaggtgatgttctcctctgactgcttctcctttttttttgagactgagtgtcgctcggtcgcccaggccggagtgcagtggcacaatctcgggctcactgcaagctccgcctctcgggttgaaggtattctcctgcctcaacctctggagtagctgggactataggcgcccgccaccactaccgggtaatttttttgtatttttagtagagacggggtttcaccgtgttagccaggatggtctcgatctgctgacctcgtgatccgcccgcctcggcctcccaaagtgctgggattacaggactgagcgaccgcgcccggccgactgcttctcctttcttaatgagatatatattaaaatacaagttcatcagcttaaagtaagaagcgggtaggacagactgcaggtgtaggagatgagaagaatagtgtaaaagagtgttgcctgggtgcggcggctcacgtctgtaatagcaacactttgggaggtggaggtaggaagactgcctgaggccaggaattcgagaccagcccaggcaacatagcaagacctcatctccactaaaaataaaaaattagccgggtgtggtggcgtgtgcctgtacttctagctgctcaagaggctggggtgggaagatcccttgagcccaggaaatcgaggttgcagcaatacttcactgcgccgctgcactccagcctgggcaacacagggagatcctgtatcggaaaaaaaaaagtgtatttaggaaaacacagattggcagtttgggagatgaaaattgaatgtaggagaatgaacgtccaggaaaacacggtagacatgaccaaaacaccttctttagattagtggacttgtattaaaagtgagataactcggcggggcgcggtgactcacgtctgtaattccagcactttgggaggccgaggtgggcgaatcacaaggtcaggagtttgagaccagcctggccaatatggcgaaaccccgtctctactagaaatacaaaaattaaccggccgtggttgcgcgcgcttatagttccagctactccagaggctgaggcagaagaaccgcttgaacccgggaggcagaggttgcagtgagcggagatgctgccactgcactccagccagcctgggcgacagagcaagagactccgtctcaaaaaaaaaagtgagacaactcaccaaggttctgtttttctccagccactttcaacagcccttagtgcgggtgtggaataggaaaggtagatttaacgaggttagttaataagcaatgtgaaggagaaaaataaaaggaaaaatggattatgaaatataaaatggattacgagggaagcaaaaagcgtgacagtaaaaaggcaggaggacaattataggtcctggtggggttcaggcgttgttggagccggggttccaagttattcttcacaagtttagattaagaccatggaagtcagtgactaaagctaagtttttcgttcctctagattctgccccaggaaagtttgggtcaaacctatcgggatccttaaaccacattccactccgcctcctttgtcgggaggtttcacagaagcggaaaaggcggctcccccttgctcctcctccccacctcccccctacctctaggagtttagggccgggccatcccaacgggctgcccctcccaaaactcactgtttggacaggtgttgggcgtcgctaggcgccgacgaagaacttctttccagtccatggccgacttccgcgcagcagcttctgcatttgctgtttcctacctgctccacccctaccagctcaggcgtcagcaccgccaggccccgtaaaggttaggaaggccgtccaaccaccatcttgatcgagggcggaagtcttggctaaagaggcaaaaacaattactgtcactgccgcggagaataccgctaccacgctgactgggggaaaaaactatgaaagagatggaaaatggttctccttcagaggcgacccaagctcaccaagccggattttaaaggccacgataagcccgcgttttcctttatcgtgtgcctttggcgcgtgcgcaccacgtgacccaggagttcattagttccggcttgagggaagcgccttctttcacaatttcttttcattgttcattgcggatatctggaagccttccaggtcccctgaatgtagtagacacttcagcagccgtctcctaccccttttgccactaaatgcttcaaaactgccttttttcctcgccgccgggccaggcggaacgcctaagtccgggtcagtctcgtccgtcggtcggggctggcgcggtgcatcgtgggcactgtagtttccgccgcgtttatggccgcgttaagtctgagtgccgctttgagttgttgaatgaagtgaacttcatttgtcagcgttcggtacgcagtctaggcagcgcccttcctgtacctctcttcctttcctgagtcgttggcgcagctgactcgccacctcctccctcctcgtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccacgtgagtaaaactgggcgttccgtcttgtgctttttcctcaggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagaggtaattttggtttttttatatgtatgtttttattctttaattttttttttttttgagacagggtcttgctctgttgcccagactggagtgcagtggtgtgttcatagctcactgtaacctcaaactcctggcctcaagtgatcctctcgcttcagtctcctcagtagctaaaaccacaggcatgtgccaccatacctggctaattatttttaatttaataactttaaacctcaaagtagccattcttttttgttgttagttgctgagaatcactcttctgattatacttttttccatctcttagtaagatttattttctctttacgacaaaattttctctctttaaaaaaagtaacaacatacataatttgtgctaatctttacccatcacataaaactgaaattatatagcagttttaatttttacatttttttccttttggaaggatcattaattttgttttcttaggcatctagtatgatgtgagtacttaatactacttatggccactgttcatagcaagaaaagaatatagcatttgactagaactgtctctggccatattagtattttcagaagttcctctgaaatctagcgactgagataatatgcttatatttattctgtctactctctcccttttttttttttttgagacggagttttgctcttgttgccaggctagagtgcaatggcatgatctcggctcattgtaacctttgcctcccgggttttctcctgcctcacactcccgagtagctgggattacaggcatgcgccaccatgccctgctaattttctattttctttttagtagagacggggtttctctatgttggtcaggctgctctcgaactacctcaggtgatccgcctgcctcggcctcccaaagtgctgggattacaggcgtgaaccaccgcgtccggcctattctgtctactatctatagttcatcaacttggatgattagagtggacagggggatattgatcaagccttatacgtaagcattacaatggaaaatcttaacccttccagtttgttttggacctttctatcatttggctgctgtctctctaaagctctctcctttggtttgcttttgctttattcatgttactgggtacatacctgtttattgctttagtcttttttaaaatttttgaaaatttttacttattttttaaaattaatattctttttttaagaggtggggtcttgctgtgttgaccaggctggactcaaactcttggcctcaagcgatcaggtgtgagccaccatgcttagtcattatttcttcattaatttgcttcctaaaaatttgttccttccctctgtttttctcttgcctttttttcccctatatcatgtttacggagctttgaagcagtaattatgcttaattatcttaaacttactgaagatcaagggaggaggagcccatttgtgaaaatctttgaataccaaggagtttggattttattctgttatcaagaatgctggatttggctgggtgctgtggctcacgcctgtaatctgagcacttttagagactgaggtgggaggatagcttgaggccaggagttggagaccagcctgggcatggtgaaaccctgtctctacaaataatacaaaaattagcttggcatggcggtgtgtgccggtagtcctagctacttgggaggctgaagcaagaggatcacttgaatctagggagtcaatcaaggctgcagggagctgtgatggcgccatgcactccaacctgggcgacagagcaagaccttgtctcaaaagaaaaaaataatgctggaatggagttttacaaaggcagttgccaagtgagaagagtagataggagagggattaagattgaaaacagggagatctgcgtgaatacaattttaggtttaggtgagagatgatgagaattaagaactgaggaaggagagaaggcagtagaatcataagaactgatggtaatatgtggaaggggaaggaggaaaggatacattgattgaacaaatacatcaatacatagtttttgaatgcttccaaataggctaggcattgcgagtgttttataaaatctattatgacattctcaatttaattgggaatacagtaccacacagtgaaataacagtggtgtgtaagaggtaaattactctcggcaggagcaatttctggcagctttatggagaaggtaagagttgagtttggtttagaggttatgctactaaggtcagccgcttttggtagacttgaagatgagagttatttgttgggaggagaaccacagggaagaaggagatccagagcagagtaccagcagcttcttaaccccatccaggatagcagccactttttaaattaaaccattctacagaagtatcttgaacttttcggacttcttgcttataagagtttccaaataccatgaatatctttcatttcagtaggaatctaaccttctcatgatttggttttgcaatcttttcatagtgttcctggaaaacaatggaaaggacaattcaccacagtccgaaaaaggtgaagaccaatgtttatttttaacttgtttgattttggtttagtaggttttgttgctattaattgaaaaatatttaagaacaccttaagggtaggataattaaaagtttgtaattagagtatctgaggaaaaaaacatactttgcatacagagacttagcagtgcccaaaatgtttttcctgtgagtactgtgaacctatatgaagtcttagagatgttttttccctagaggttccagacccagttgtgttttaggatttatttatttatttaattcaccaatatgatattccagaggataggaattactttaaaaatgtcatctgagctgggcgcggtggctcacgcctgtaatcccagcactttgggaggccgaggcaggcagatcacgaggtcaggagattcgagaccatcctggccaacatgttgaaaccaagtctccactaaaaatacaagaccctgtctcaaaaaaaaaaaagtcatccaaacggccaatctacttttttgggttttctggcacactaatttgtgatattatcaggtttacaaaaaattagatgtatgtgattatcacaaaggttttaatgttcttttttattaccttttaatttcctcattgttcatttcacaaatttttttccccagaacattattcgacatatttaaatattattatttaacaattataattacagtggccagtgttcgggctgtggaaaaaccatagagtctattcagctgagtccagaagaatatgaatgtcttaagggaaaaatcatgagggatgtgatagatggaggtgaccagtacagaaagacaacacctcaggtgagtctaacaagttttatttcttcttggattgcttgtctagagcaggggttagcaatttttgtaaaatgccagatactaaatattttaggctttgtaggtcatcggtccctgttgcaacttttcaactctgctgttgtagttaagacatccatagataatacataaatgaatagacatggctgtgttccagtaaactttattcatgaaaacaagcagtaggctggatttggcctgctgactacaattgccaacctttcggagagattgctttagaatttcgtagaataattgggttagaccatcatctgttgaagtcaatcctattatactggggcataataagtgcacttaaactaaaaagatgcttattctttctgtaagtgcttccagaaaactatgttcaagtagactgccatgaaaacattgtagtttctcacaacttttctagtcaagagagtttagagtaacttaagattatttacagattttcttagtatcacgttaactgatttgtgtatattgaaccatccttacgtctcagggataaatctcacttggtgatgatgaatgatctttttaatgtattgttgaatttggtatgctagtattttgttgaggatttttgcatcaatattcatcagagatattggcctgtagttttttgttttttttttgttgttttttgggttttttttttgctgtgtctttgtctggttttggtatcaaggtaacactagcctcatggaatgagtttggaagtcttccctcctctattttttggaatagtttgaataggattgctattattctttaaatgtttggtagaattgagcagtgaagccgtcaggtcctgggcttttctttgctgggagactttttattatggcttcgatctcgttacttgttattggtctcttcatgttttttatttcttcatggttcagtcttaatatattgaatctgtctaggaatttggccatttcctgtaggttttccaatttattggcatatggttgctcatagtagccactaatgatcctttgaatttctgcagtatttgttgtaatgtcttctttttcatctctgattttatttgggtcttctctccttttttcttagtctggctaaaggtttatcaattttgtttaacttttcaaaaaaccaactttttgtttcatgatcttttgtatggttttcttaattccaatttcatttatttctactctgatctttattatttagtctctccattttgggtttggtttactcttgcttttctagttctttaagacgcatatttggccgggcgcgatggctcatgcctgtaatcccagcactttgggagaccaaggccggtggatcacctgaggtcaggagttcgagaccggcctggctaacatagtgaaaccccgtttctactaaaaatacaaaaaaaaaaaaaaaattagctgggcatggcggcgcacgctggtaatcccagctactcgtgaggttgaggcaggagaatcgcttgaacccaggaggcggaggttgaagtgagccgagatcacgccattgcactccagcttgggcaacaagagtgaaactccatctcaaaaaaaaaagatgcatatttaggttgtttattttaagtttttcttctgttttgatataggcacttatagctgcttttgttatatcccaccgtgcctagatacatttaatgttattattgataagtaaggacttagtcctgccattttgttttctggttgttttgtggtcttattttttccttcctttcttccctttagtgaagatgattttctctggtgatataatttagtttcttgctttttattttttgtgtatctgttgtatttttctttttttttttttgagatggagtattgctctgtcgcccaggctagagtgccgtggtgcgatcttggctcgctgcatcctccacctcctgggttcaggagattctcctgcctcagcctcttgagtaactggaattacaggcgcacaccaccatgcccagcaaatttttttttttgtatttttagtacagacagggtttcaccatgttggtcaggctggcctcgaactcctgacctcatgatctgccttcctcagcctcccaaagtgctgggattataggcgtaagccaccgtgcccagccttgtatgttttttgattggaggttaccatgaggctcactaatacttaactatagcctattattttaagctgataataatttaacactgtataaacaaacaagcaaaaagaaaactaataaaaactctacacctttactttgtctccctgctttttaactttttattgtttctatttatatcttactgtactatcaatgtcttgaaaagttatagtcgttattatttttgattggttcattgtttagactttcttttttttttttttttttgagacggagtctcgctctgttgcctaggctggggtgcagtggcacaatctcagctcactgcagcctctgccccccaggttcaagtgattcttctgcctcagcctcccgagtagctgggactacaggtgcccgccaccatgcccggctaatttttttgtattttttagttgagacggggcttcaccatgttaaccaggatggtcttgatctcctgacctcatgatttgcccgcctcggcctcccaaactgctgggattacaggcgtaaggcactgcctcactaaactcattgtttagtctttctaaagataagagtagttttagtttacacaccatagttacagtgttataatatactatgtctttttgtgtacttattattaacagtgagttatgtaccctcagatgatttcttattgctcattaatgtccttttctttttttttttcattgagatggagtctcactctgtcgcccaggttggaatggagtggcacgatctcagctcactccaacctccgcccccactgggttcaagtgattcttgagtcttaccctcccaagtagctaggattacaggtaccctccaccagacccggctaatttttgtatttttagtagagacagggtttcaccatgttggccaggctggtttcgaactcccaaccttactttatccagctgcgtcggcctcccaaaatgctgggattacaggtgtgagccactgcacccggcctatgtccttttctttctgccattttttttttttaaatatagagacagggtcttactatgctgcccaggctggtctcaaactcttgggctcaagtgatcttcccaccttggcctcccaaagtgctggaattataggcgtgagttaccagagttacggtccttttcttcttcttctttttttttgaggcagttactctgtcgcccaggctggagttcaatggcgcgatctcagcttactgcaacctccgcctcctgggttcaagtgattctcctgcctcagcctctgaatagctaggattataggcgtgcaccaccagacctggctagtttttgtatttttaatagagacggggtttcaccatgttgaccaggctggtcttgaactcctgacctcaggtgatccacccacctcggcctcccaaagtgctggaattacaggcatgagccaccacagctggccatccttttctttctgattgaagtactccttagcatttattgtaggataggtctggtgttgatgtaatctctcagcttttgtttgtctgggaaagtctttatttctccttcatgtctgaaggatattttcactgcatatactattctggggtaaaagtgtttttccttcagcactttaaatatgtcatgccattctttcctggcctgtaaggtttccactgaaaagtctgctgccagatgtattttagctccattgtatgttatttgtttttttctctagttgctttttggtttttttttttttgagacagagtcttgctctgtcacccaggctggagtgcagtggtgctatttcggctcactgcaacctccacctcctgggttcaagcgattctccttcttcagccttccgagtagctgggattacaggcatctgccaccatacccagctaatttttatatttttagtagagacagggtttcactatgttagccaggctgatctcgaactcctgacctcaggtgattcgcctgcctcagcctcccaaagtgctgggattatagataggtgtgagccaccacacctagccaatcctttctttttttctttttttgagaagaaatctcactcttgtcccctaggctggagtgcagtggtgctattttggctcactgcaacctccgcctcccaggttcaagtgattctcctgcctcagcctcccaagtagctgggattacaggcacctgccaccacgcctggctaatttttgtatttttagtagcgacgggtttcaccatgttggccaggctggtctcgaactcctgacctgaggtgatccgtccgcctcggcctccgaaagtgctggaattacaggcatgagccactgcgcccagccccaatcctttctttatccgttgaaggttggattattcaactgggtgtggtggctcacacttgtaatcccagcactttgggaggctgaggtgggtggatcagctggggtcaggagttcgagaccagcctgggccaagcgtggtgaaaccccgtctctaatacaaatgtgaaaattagccaggcgtggtggcgggcctctgtaattccagttacgtaggaggctgaggcaggagaatcgtttgaacctgggagccggaggttgcggtgagccaaggtcacactactgcactccagcctgggcaacaagagcaaatctccatctcaaaaaaataaaaaacaagaaaaaaaagaaagttggattattcgtccaggcattgtggctcacgcctgtaatcccagcactttgggaggccgaggtgggtgtgaatcacctgagtttaggagtttaagaccagcctggccaacatggtgaaaccctgtctctactaaaaataaaaaaaaattagctggaaatggtggtgcgtgcctgtaatcctacctactcgggaggctgaagcaggggaatcatttgaacccgtgaagcggaggttgtagtgagccaagattgcgccacagtactccagcctgggcgacagagtgagactccatcaaaaaaaaaaaaaaaagggaagaaggaaaggaaaggaaagcaaagcaaaggaaagggaaggaagaaggaagaaggaaggaaagtaagtttgatcattcaatgctttgagttagtgtttttttgttttgttttgttttgttttgttttgtttttttgagacggagtgttgttctgttgcccaggctggagtgcaatggcatgatcttggctcactgcaacctctgcctcccaggttcaagcgattatcctgcctcagcctcttgagtagctgggattacaggttcacgtcaccacgcccagctaatttttgtatttttagtagagatggggtttcaccatgttggccaggctggtctcgaactcctgacctcatgatctgcccacttggcctcccaaagtgatgggattacgggcgtgagctaccatgcccagccctaactgtgtattttcaaatagcctgtcttcaatctcactaattcttctgtgtgatcccttctgctgttaaaggactctgatgcattcttcagcatgccagttacatttttcagcttcagaatttctgcttgattctttttaattttttttcaatctctttgttaaatttatctggtagaattctgaattccttcttgggttatcttgaatttctttgagtttactcagtagagctattttgaattctctgtctgaaaggtcacacatctgtttctccagtattgttccctgctgccttatttagttcattttgtgatgtcctgttttcctggatggtcttgataccatgtctgggcattgaagagttaggtatttattgtagtctttgcagtctgggcttgtttgtacctttccttcctgagaaggctttccagatacttaaaaggacttgggtgttgtgatctaagttgtatgtgctttagggggcagccaaagcccagtaatgctgtggtaagaggtactgccttcatggccttgaacaagatcagggagaattctctggattactaggcagaagctcttgttctcttcccttactttttcctaaacaaacagtctctccctctcattctgagccacctggagctgaggacgtagtcacacaaatacccttgtggccaccaccactagaactgtgctgggccagacctgaagccagcagagcactggatcttgcccaaagcctgcttaactactccctggctactgtctgtgttcactcaaggccctggggcactacaatcagcagttggtaaagccagccaggcctgtgttcttcccttcagggcgacaagttcccccaggcctcagcaggtccagaagtgccatttgggagccagggagtagagtcaaaaatcttagaagtctacctggtgttctgttgtattgtggctgagctggcattcaaatgataagacacagttcttcccactcttccctcccgtttccaaaagcagaggagccccaccgtgtggccaccgccaccaccagcccacagggagttctgccaggctcccactgatgttctcataaggccgaaaggctcttcagtcagcttgtggtgcatgctgcctggcctgggactcacccttagtgctctacccacctctggctgaggtggtacctgaagctagcaatatcagagtctcactcaaggcccatgatgtactacctggatattgctgctgcttattcagggcccaagggctcttcagttagcaggtgatgaatccttccatgattgggttcttcccttcaaggcagtgagttcccttctggctcagagtgtgtctagaaatgtccaggagctagggcctagaaaagggggtgtctcatgactctgaccggtaccccatcctgctgtagctgagctggtgtccaagatgcaagacaaagtcctccccactcttccatctcttctcaagtagaaggagtgggtctgtttaggagactgtgagatgtgcggcctgggcttaggggaggtatggcaccagtactcccctagctatcgtctcagtaggtcacatgcccctaccagtccactggctctgagcccagttcaccactaggactcacctaagagttgcaatccttgtggcttagactgcctttcaaatttatttacgggcctggagcactttggcccatggtggtgaggcttgtgggaactccagtttcaaccactgggatgggcaatttccctctggctagagctagtttaaatgccccttctgtgggtgggtatcagctgagtttgttctatttttgctttctgctataacagggcagcactgagttcaatgcagtgtctcacaattgctgcactctccctctcccaaacactcagagtctttctctgcaccacattgctgctgcagggggatgggagaggaatggcagtggtgattcaagactgtttttcctacctcttcagtgcctctttcagtgatacaaagttaaaaccaggtactgtgagtcctcacctgatttttggttcttttgaaggtgctttttttacatgtgtagatagttgttaaattggtgtccttgcaagtggacgatcagtggagccttttattctgccttcttgctccaccccttctcctctgtctatggtacttttgtcctgcagagttgagtagatataaaggagaacatgtggcctacagagcctgaaatatttaccatttggcccttaacagaaaaaaattgctgatccctggtatcaatgaatatcataaacctctggagaagtaatgagtgtgaaggagcagtggcatccaggagagggcctctcctttctcattggttggtcctatagcatactataggataatgagcagctattattaagaaacattgtcataggttctggggagccattaacgtgttttaagcaggccgggcatagtggcttatgcctgtaatcccagcactttgggtggccgaggcgggcagatcatgaagtcaggagtttgagaccagcctgggcaatatgggaaaaccccgtctctactaaaaatacaaaaattagctggtcgtggtggcgtgcacctgtagtcccagctactaaggaggctgaggcagaagaatcgctggaacctgggaggcggaggttgcagtgagctgagatcatgccactgcactccagcctgggcgtcagagcaagactctgtctcaaaaaaaaaaaaaaaaagtgttttaagcaaaagtatgatatgtatattttagagagacctctctggcagctggttggaaaaaggagttgaaaaggataagattgaggcactggagttgagtcagacggctgctgagtggtccaggtgtgggatgatgagggaaatgaaagccagaataagggtagagaaggaccagctcagctttgagaacattttaggagataaaaatttcaccatttggtttggctgcagtgatgggagaagacaggatgatgttcaggttttcggcttgggtgatggggtgaacaaactctcactccctaattccttttcttttgtcaccctggaaagatgccatctaccaagaacaggtatgaggagaagataattgaatatccgacaacgggtttttttgtttttttggttttttttttgaaacagagtttcgctgttgttgcccaggctggagtgcaatggcgcaatctctgcttaccgcaacctccgcctctcgggtttaagcaattctcctgtctcagccgcctgagtagctgggattacaggcatgcaccaccacacccggctaattttgtatttttagtagagacgggggtttctccatattggtgaggctggtctcgaactcccagcctcaggtgatccacccacctcggcctcccaaagtgctgggattacaggtgtgagccaccgcacctggcccatattgggttttaatgtcagcagaagatccaggacttgggttccagcttacaggggagagttaatgctggaggtttggggaccatcacataatagtaataggttaaatgcgaagagtgcctgagctcatccaggaaaacagtgagaacagtagtgggctcaattcacaacttggtgggggtgggatggggaacaccagcataggaaggaaggtcagagaagaagtttcatatattagatagaacagtcagaacaaggcagaaagaatctattcagtacagtgtcacaaatatcaaaacagagtgcaatacactagagatttgttaaggtgtggactgaagggatacattggatttggcaactaagaaatcattgatgaccttgggaagaacagtttcagtagtttaatgggggccaaattcagccaggttatagcagctgagtgaatacccattgagtgtaaactctaattttaagaagtttacatgaaaattagaaagatgatatagtggtggctagaggatggtggagtcaagggagggtttagagagataggcttgtgcctgtttggaggatgaagaaaaggtatcaatagagataaaaaatattgagtatacaggatatgtaggagagaaaaaggaatattgctgagtaaaagtagcaggggttgccaaaaagagcacaaatgtggaggttggaaatgaaggaaatatcatttgaggctgtagaaaagaaagtgaagatgggtgtggatgataaattggtagaaagagggaacattgagagaaatgatacctgctgtgttaagtggtatacaagatgagagagatgagagtcaagtagagtactagagagagtggggaaggtttggaatggttcttgaggggatgtcaagatgctaactcaaggcagaaggattatggcagagggtgggtgctgaggtttgaatctgtgaatctgtagacattactctgtgtgattgtgtgatttaatatatttccaacagagcttggctcaccaagagcagaggtagtaaagacaaagggtagcgttggtccagagtttgggttttgttggttagatgtggcacatgatagagagcaagagaaggcgattctgacaaagtagttaacatggtctgcatggggtccaggccagataggaaagggaggaaggccaaagagcactatatgagaggattccagggactggttgtctcttcgtgcatgtacatgtgtgtgttggttttgttttggttggttggttgttttttttcctcaccatttgtattaatttgctaaagctgctattgcaaataccacaaaccaggtggctttaacagcagaaattcattttctcaccattctggattctagaagtccaagatcaaggtgttgtcagctttggtttctcttgatccctctctctttggcttgccgatggctaccttcttgtggtatcttcacatggccttcctctggtgtattcctggtatcatctttgtatgtacaaatttcctcttataaggacacccatcagatttgattagggcccatccttatgaccttattttaccttaattacctctttaaaggcctatctccaaatacagtcacattctgaaatactatgggctgagacttcaacatatgaatttggtgagtggacacaagtcagtccgtaataccgttcattgtaaatatgcgttaataaaactatattatattcagcattttaaattattttgtgttaggaacattagaaacatctagttgacaaatagctggatctgccttcaatgttgctttctaaagcttgcttataatttgagaatatgaggtataaaccaaggaataattattaaaggaataaattattaaataattattaaattattaaatctacttaaaaaaattttgccaactgacctccataaacacctaaaatgagcattataaaagttattttaggcttatatgttttccccaaatagtactgttgttcaaaacaaagtaaattagatgacaccctctaatgtagcagctttcaactgtggctgctggttagaatacttgggaagtgtttaaaactgctacctggacctcagccactaaagatattgattttttttttttagacggagtctccctctgtcgctcaggctggagtacagtggtgccatctgggctcactgcaccctctgtctcctgggttcacatgagtctcctgcctcagcctcccgagtggctgggactacaggtgcataccaccatgcctggctaatttttgtattttttgtagagacggggttttaccatgttggctaggctggtgtcgaactcctgaccaaaagtgatccacccacctcagcctcccgaagtgctgggattacaggcatgagccgccatgcccggccaaagatactgatttttcatacaagtccttttggttttgttgttaaaattagagatagggtctcactgtgttgctcaggctggtcttgagctcctgggctcaagtgattctcctgccttggcctcctaaggttctgggattacaggtgtgagccaccgtgcccaggaatattttgatttttcaactatagttttattgcagtatatttgacatacagtaaacagcagatatttaaagtgtacaactttatgagttttgtcatatgtatatacctgtggaactgtcactgcaatcaagataatgaacatatggatcacccccaaaagtttcctcatgccattttgtaatgactcccttgccctgccatccccaggcaaccactatggaatcatacaatatatacttttttttttggtctgatttgttttattcagcataatcattttgagatttcatccttgttttgtgtctcaatcattctttcatttttataattgagtagtattccattgtgtgactattttacaatttgtacatttgttgatggacatttaggttatttccagtttggtgctgttataaataaagctgattagaacagtcttgaacaagtctttgtgcttttgttattgtttcctagggctgccctaacaaattaccacaaactgggtagcttcaaatgacagatatttactctctcacaattctggaggctagaaatctgaaatcaagatgttggcaaggtcatgctccttttgaaggatccagggaagaatccttccttctctttcctaccttcagaagccagatcctggcaattgatggtgttccttggcttttagctgcatcactccattctctgcgtctgtcttcatgtggcctttgtgtgtgtgtatctctgtgtgccatctcttcctcttataaggctacaagttatgggatttagagcccaccctaatctagcatgaccttgtcttatttcatttacaaagaccctctttctacattcacattctgtgtttcctgctagacataaattttgaggttacactattcaacctactacagctttttttttctcttgggtaactctcttaggactggaatggtttggtcttatggtagatgtcttatggtagatatgtgtgtgtgtgtgtcgctttttcagaaactgcccaactgttttccagagtggttgtaccattttacatttccaccagcagagtatgagggctatagtagccccacatcctggctgatgcttagtatggttaaggttagtctctttactgttctaataggtatgaagtggtatctcattgtgattttaatttagattttcctaatgactaatgttgttgagcatctttttatatgcttaattgccatccatatatctttggtataatatttatttgttcagattttttgcctattttaaaaattggattgtttcattattgagttgtaagaactgtttctatattctagatacaagtcctaagtccaatatattttacaaatattttctgtcagtctgtggttgactttcatttcataacatggagattctgatttaattgctttggcttggtggggtccaggtattaggattttcaaaagcttccaggtgattttaaagtgcagctagaatcaaggacaattgcttctaatgtgagattttgaggaaacttaaagtatggcagcttcttttctgttgaatagttttgggagaaaaatctcagttattatataaggtaattttttagcttttctgttttaaacatttgtttactgtaattagacaacatagccagcagatggcaataatgtaacatataaaaattattctaggtatgaccaagtccatcaggttaaaggatttgttgaactttttaaaatattaaactgaaagatatctgtcatttctgtgtaagtcagattagtgatagtaggtagagaaaagagtggtatatgtgaattttaagtgaacaaagcagaattccaaataatttgcatctactgatttaactactgacactaattgagtgggcatcagtgaaggtcaaaaagtgaatttggagctatgcgcatagtgttactttaatgttaattaggtttttttcttattttccttccttgtttttctttttttttttgtttttgtttgtttgttttgttttgttttttgagacaagttcttactattcacccaggctggaatacagtggcatgatcataactcactgcagccttgaactcctgggctgaagtaatcctcctgcctcatcctcctgggtagctaggattcaggtgtgtaccatcacatctggctaatttttttattttaattttttctgtagagacggggtctcactatgttgcctaggctggtcttgaactcctggcttctagtggtcctcccaccttggcctcccaaagtgctgagatttcaggtgtgagctactatgcctagacatggttcttgataataacattaaattacagtcagattttttatattcaactacaaagataataattctttaatattttcattagagaaaatttcaaacataatcaaaaagagactaacataatggacccccatcctccatgattattaactcatgaccactttttttttgacagggtcttgctctgtcacctaagctggagtgcagtggcacaatcacggctcactgcagctgagacctcctgggctcaagtgatcctcccacctcagcctcatgagtagctgggactacaggcatgtggcacaacacctgggcaattttttttttttaagacggagtgttgctgttgttgcccaggctggagtgcaatggcacgatttcggctcactgcaacctctgcctcctgggttcaaacgattctcctgcctcagcctcctgagtagctgggattacaggtgcctgcaaccacgcccagctaatttttgtatttttagtggagacagggtttcaccatgttggccaggctggtcttgaactcctgacctcagctgatccatccgcctcggcctcctaaagtgctgggattacaggcgtgagccaccgcgcccagccttaatttattatcttatgtagagatggagtctcattatgttgccaaggctggtgttgaactcctgggctcaagcattcctcccacctcagcctcccaaagtgctgggataataagtgtgagccaccacacctggaagctcatcctgtaaattataaattcattgcttttttttttttttttttccaagagatgacgccttgctcttttgcccaagctggggtgcaatggtgtgatcatagctcactgcagcaatgaactcctgggctggagcaatcctcccacctcaacttcccaagtagctaggacttacaggtgcatgccaccctgccctgctaatttttaaattaaaaaaaaaaaaattttagatagggtagagatggcattgggcttggtggctcacacctgtaatcctagcactttgggaggccgaggtgggtggattgcctgagctcagaagtttgagactagcctggacaacatggcaaaacccgttctctaataaaaatacaaaaaattagctgggcatagtggctcatgcctgtagtcctagctactcgggaggctgaggcaggagaattgcttgaacccaggaagctgaggttgcagtgagctgagatcgcgccactgcattccagcagcctaggtgacagagtgagactcttgtctcaaaaaaaaaaaaattgtaaagatgggatctcactatgtggtccaggctggtcttgatgccctgagctcaagtgatcctcttgccttggcttcccgaagtgctgggattacaggcataagccaccatgcttggcctaaattctctcttaaacagctttctttgttttcttgttgtaaaaagtacttctttgtaaagctatatttttcgtgtactttaagaaatactttagaattgcagttcttaaccttttggtctcgggacccttttacatatttaaacattattgaacattctagagagcttttgttttttgttttgttttaagcgagacagtctctctctgttgctcaggctggagtgcagtggcgcaatcgctgctcactgcaacctctgcctcccaggtcccaggttcaagcgattctcctgcctcagcctcccccgagtagctgggattacaggcatatgccaccacacccggctaatttttgtatttttagtagagacggggtttcaccatgttggccaggatggtctcgaactcctgacctcaagtgatccagccgcctcggcttcccaaagtgctgggattataggcatgagccactgtgcccagccagatatatattaatttattgaaaataatataaaaactattataaaacataacatttttatagaaaataattctgttgtccagaataaaaccaatattagtgagaagagtacattgtattacatttttgcaggtcttttaaataatatggcttaataaaagacagatagtttttgtttgtttgtttgtttgtttgtttgtttttgagacagagttttgctcttgttgcctaggctggagtgcaatggcgcgatctcggctcaccgcaacctccgcctccgaggttcaagcgattctcctgcctcagccttcccaagtagctgggattacaggcatgcgccaccaagcctggctaattttgtatttttagtagagatggggtttctccatgttggtcaggctggtctcaaactcccgacctcaggtgatccgcccaccgcagcctcccaaagtgctgggattacaggcgtgagtcaccgcgcccggccaaagacaggtagttttttaaataagtggcaaaaaaaaaacccttatatttagaattagctattcggactcagtttaggttatcccagttttactggcaacatccaaaacatcatagttaggagccagtcaaacataggctgccttctctccatcagtcctgattagggtgttgatcgtggtcatgtcagtgtcacagaccttcatatagcctgtttgatctggtgcttgttggctttgataaccacagtgaacacagatgtggtattgtcttcttcatggtcagctcagtggtcaaggggaacttgatggcataatagtccagcttgtatatcctgcaggttctctactgaggatgtttgggctaccttcaaagccaaagtgtgttgggctactggaacataggtgacctgcagatatttttttgtgtgtgtgactggatgcctttcaacactgccttgctggccttaaaagccttagctttggatttggctttgggaggagcagggatttccttctttgctttcagcatcatcattttggtgaaaagggttgacacctggatttttatatctatttctatattcagtctgttgtggtatggtatggcgttttggtagaagcatatgaagaaaatgaaagctcatggaaataggtagttggaaagcaaagaggattttgttggctcttggagataatcataatcgttctttgatactatgcccaaactctactgtacacttgtgagcaaatgagagtgaaaaaggcatataacgtcttagcattatgaaaatagttttaactttgcagatcccctgagagggtcttggggatacccagcagtccttgaaccacagttttagaaagtactctggtttagatatgattttctttttctttctattgtaaaagttcaagtaaagtttatttccctctatcttattacacaagcatattaacaaaggaagctaaaacaaagacagcagtctcagtactcagtatattttctattagtttcttatgttcttttttagttcttttgtttgttttaagagacccttgtcacccaaactagagtgcagtggcgtgatcatagctcattgcagcctcaacctcccaggctcaagtgatcctctcaccttagcctcttgagtagctaagactacaggcacacaccaccacgaccagctaattttttaattttttgtagagatgggggatctcactttgttgcctgggcttgtcgtgaactcctgggctcaagtaatcctccaaccttggcctcccaaagggctgggattacaggcgtgagctactgcacctggtgcttttttagttcttattgagacttcttaatcattttcttttacttttcaaaatggaagtgggttttatcctgattataatatttattaattataaaaaatttcatcaacacctgtgaaaaggggaaaattttttttttggtcaaaatagctataaagaaagataaaaggccgggcgcagtggctcacgcctgtaatctcagcactttgggaggccgaggcaggcagatcataaggtcaagagatcaagactatcctggctaacatggtgaaaccccgtctgtactaaaaatacaaaaattagctgggcatggtggcatgcgtctgtagtcccagctactgaggaggctgagacaggagaattgcttggacctgggaggcggaggttgcagtgagctgagatcgcgccactgcactccagcctggcgacagagcgagactccatctcaaaaaagaaagaaagaaggaaggaaggaaggaaggaaggaaacagcccaccatgatccattcattttgaactttaattttatttgattatttatttatttatttatttatttatttatttattttttgagacagagttttgttcttgttgcccaggctagagtgcaatggcaccgtctcggctcactgcaacctccgcctcccgggttcaagcgattctcctgcctcagcctcccaagtagctgggattacaggcgcctgccaccacacccggctaatttttttatatttttagtaaagaaggggtttcaccatgttggccaggctggtctcaaactcctgacctcaggtgatccgcccgcctcggcctcccaaagtgctgggattacaggtgtgagccgccgcactcagccccattttgaacttttaatgaaactttaatcataatcacagtccccataattctgtgatttagaagtttttaaataaagctttaatgatttaggattctcctttctggaaaagaaaaaaaggcaggcaaattgcccgtggtacatttaattgagtttttagggttaagtttaaagcaaatcatttgtcctgcttgatagtatctcttcagtttattgacaaagaggtgtttctctaaatacaaatttaagacaggacatatgaccctaatgaaatgtcagtataagaacttatctaatttaggtctttagggatttttttttctttatttggttacaaactgaaagatgtgaactgagctctttatcacagtctccagaaccttctcttttctctgggtttgaagatcttgtcatctctaaaatgaactgtgggtttttttccccagatttaaataaatgttgtgtggtaaatggaaaactttgtgggtttagtgattttttaaaaatctgagaaagaaatttaattatctgcaaaatatagttttaaaccatgtgttttaaagtacaggcataccttgaagacattgcaagtttggttctaagctttatcgtaaatattgcaataaagtgagtcacacaaattttttggttacccaggtcgtataaaagttatctttccatggctggatatggtggctcacacttgtaatcccagtgctttggggcccaggcaggaacattgcttgaggccaggagttcgacaccagcccggggaacatagtgagatcccatctctacaaaaaaattttttttttagttagctcggcttggtggtgtgtacctgtagtcctagctactttggaaggctgagtttgtaggatcactcaagcccaggagttcaaggttacaatgagttgtgattgtgccactgaactccagcctgggagacagagtgagactctgcctctaaacaacaacaaaacttatctttccactatgctgtagactattaagtgtgcaatagcattatgtctaaaaaaatatatatagataccttaatttaaaaataccttattgctaaaaaatatgctggtggtcatctgagccttcagcaagttgtaatctttttgctgatggcaagtcttgccttgatgttggtggctgctgactgatcaaagtggtggtgtttgttgaaggctgggatagctatgacaatttctttatttttttgagacagggtctcactctgtcacccaggctggagtgcactggcaagatcatggcttactgtagcctccacttctcaggctcacatgatcctcccacctcagcctcctgagtagctacaactacaagctcacatgaccatgtctagctaattttttctaattttttgtcgagctggggttttgccacattgcccaggctggtcttgaactcctgggctcaaacgatccacccacctcagcctcccaacatgctgggattacaggcatgagccactgtgtggcaatttcttaaaataagacaataatgaagtttgccacataaattgactcttcttatcacaaaatatttttctgcagcatgcagtgctttttgaaagcattttaccacattagaacttttttcaaaattggagtcaatcctctgaaatcctgctgctgccttgtcaactaagtttacgtaatattctaaattctttgttatcattttaacaatatttacaacgtgtctactaggagtgagttttatttcaagaaaccactttctttgctaatccataagaagaaattcctaatccaagttttattttgtgattgaagcaattcagtcacatcttcaggctccacttctaattctagttctcttgctatttccaccatatctgcagttccttcttccactgaaattttgaatccctccgagtcatccatgagggttggtgtcaacttcttccaaacctgttactgttgatatttcaacctctttccatgaatcacaaatgttcttagtggcatgtagatcggtgaatcctttccagaaagttttccgttgactttgcccaaatccttcagagcaatcactgtctatgacagctatagccttacaaaacatgtttttcaaataataagactagaaagtcgaatttactcttttatccatgggctttagaatggatgttgtgttggtagacatgaaaacaactttcatctccttatacatctccataagagctcttgggtgactaagtgcattgtcactgagcaataatattttgaagagtcttttttttggagcagtaggtctccacagtgggcttgaaatattcagtaaaccatgctgtagacagatgtgctgttagccaggctttgttccattgatagagcataggcagaggagattcagcataattgttaaggactctaagatttttggaatggtaaacgggcattgacttcaataaagtcaccagctgtattagcccataacaagagagtcagcctgtcccttgaagttttgaagtcaagcattgacttctctctagctatgaaaattctagatggcatcttcttccaatagaaggggctgttttgtctccacggaaaatctgttgcttagtgtagccaccttcatcagtgatcttagatcttctggatagcttgctgcagcttctacatgagtacttgctgcttcaccttgcactttttttgttttttgtgttggttccaccagtctgtgcccataacctcccagcagcctacatgttgcactttttaatttttttttttttttttttttttttgagacggagtctcgctctgtggcccaggtgggagtgcagtggcgcaatctcggctcactgcaagctccgcctcccaggttcacgccattctcctgcctcagcctcccgagtagctgggactacaggcgcccgccaccacgcccggctaatttttttgtatttttagtagagatggggtttcaccgtgttagccaggatggtctcgatctcctgacctcgtgatccgcccgcctcggcctcccaaagtgctgggattacaagcgtgagccaccgcgcccggcctaatttttttttttaatacagtgtctcattctgtcatccaggctggagtgtggtgctatgatcatagtccactggggcctcgaactcctgtgctcaagtaatcctcccatctaggcctcccaagtagctaggactacaggcataccaccatacctggatcatttttaaattttttgtagagataggatcttgctatgttgcccagactggtctcgaacgcctgacctcaagtgatcctcttgcttcagcctcccaaagtactgtgattacaggtgtgagcaaccatgactggcaccttgcatttttatgttatggggattgcttattttcttaaacctcttgagccaaattctgctggcctccaacttttcttctacggcttcatcacctctgtcagcctttgtggaattgaagcattcaggtcttgctttggcttaagagaatgttgtggctggtttgatgtttcatccagaccaccaaaactttcttcatatcagcaataaggctattttgctttcttatcatttatttgttcactgaagtagcacttctgatttctttcgagaactttgcatttgcaaagtttggtacctagcttttggcctatcttagcttttttgttttgttttgttttgttttttaaggcggggagacagagtctcactctatcacccaggctggagtgcagcggcataatctcagttcactgcaacctctgcctcccaggttcagttgagcaatcctcatgcctcagcctcccgagtagctggggattacaggcatgtgtcaccacaccggctaatttttagtagagatggggtgtcgccatgtttcccaggctggtctggaacttctggcctcaagtgatccgcctgcctcggcctcccaaaatgttgggattacaggcgtgagccaccatgcccagccctgtcttagcttttgacatgccttcctcactaagctcagtgatttcaagcttttgatttaaagtgtaagaccggagactcttcctttcacttgaacacctagaggccatcgtagaattattaattggcctaatttcagtattgttgtgtctcaggtaatagggaggcctgaacagagggagaaagatggggaaatggctgttggtggagcaatcagaagtcacacaacatttattgattaagtttactgtcttacagcagcacggtttctggtgccctaaaacaattaccattcaggtatgtcggtgcaagaattctggccaaaaatgtaaagcttctagaaaaatcaatgaattcagaattttaggaaggttaaaaagttaaaaggacaagcaggtcactcctagcagtggccttcccaatgtcaaatgttttccttatttcttcattctttttcttttatgtaacacttgactgaaattctaccagctgggatccaggcttttttatgagatttagcttgaagcagtgtactttcctcctaaagcctagctgagtttggctttacaaggaaatgaaaattatgtgtggctatgggtgtttggctgctgctgttttagagttgggttggtgatttttcatagagaacgttttgaggggctgatctgaggggggtgctcaaatggaaagttttgtgtggagtagtgtgctagagacagagggataaagtcacctttaggaggttgaaacaaggtgggagtgtgcaaaggagatacttgacttttcttgtgctaagggcaagagagtcttatctttcttacagcgagtgatcttttctctctcagattcaggttggcattattactgttatactataacccattgcatcatttggcttggaaaccaagccatttttaaattaatttttatttatgggaaaagtgttgtgagttctttataatcatctactaagtgaatttttagaaacagtatttggaagtgaggtacgtcccagagtgatacacttttagtgttatttttcttaaaagattctgcctaggatttttgatttagtttttctatagctattgcttaaatgtatcgattttattgctttttcatttggtcttcttagagaatagaataatgtaaataagatactagattagaaacagtaatactggtgctgaagacagacagcttacttctgaaggaagagaaaactaccagtgtgaaagagcagcagctgagatgttgagaataaggcctctgatcaccactgaaccaaactcccgatctttatacacatgtatagtcttccctatctcagtaaatacaactttttccttctagctattcaggtcaaaaaggtcagaatcatccttgattcccctctttccttcatatccccattctaatctgccagcactccctattttccatctctgctttatttttctccatagcacttatctgacatgctacacacacacatacacacacacacacacacacacacacacacacacacacagagcttttactatatatcttttctctgtatagagtgaaagcaccacaagggtagggatttttaaatgcctgtttagaacactgttgtatcctcataactcagaatagtgctttacataaagatgctcaatttgttgaataaatgaataatagttaccatttactgaattcttagtgtcaggctaagatctttgtgctaggatctttgtatcagttatctctaattttttttcttcttttttttttgttaatccatctttttttttttttttttattgatcattcttgggtgtttctcgcagagggggatttggcagggtcataggacaatagtggagggaaggtcagcagataaacaagtgaacaaaggtctccggttttcctaggcagaggaccctgcggccctccgcagtgtctgtgtccctgggtacttgagattagggagtggtgatgactctcaacgagcatgctgccttcaagcatctgtttaacaaagcacatcttgcaccgcccttaatccattcaaccctgagtggacacagcacatgtttcagagagcacagggttggggataaggtcatagatcaacagcatcccaaggcagaagaatttttcttagtacagaacaaaatgaagtctcccatgtctgcttctttctacacagacacagcaacaatctgatttctctatcttttccccacctttcccccttttctattccacaaaaccgccatcatcatcatggcccgttctcaatgagctgttgggtacacctcccagacgggatggtggccgggcagaggggctcctcacttcccagaaggggcggccaggcagaggtgcctcccacctcccggatggggcagcggccgggtggaggcgccccccacctccctcccggacggggcggctggccgggcgggggctgacccccccacctccgcctccctcccagacagggcggctgcctggcggagacgctcctcacttcccagacggggcggctgccgggcggaggggctcctcacttctcagacgggtcggccgggcagagacgctcctcacctcccagacggggtggcggccgggcagaggcgctcctcacatcccagacggggaggcggagcagaggcgctccccacatctcagacggtgggcggccggacagagactatcctcatttcctagacgggatggcggctgggaagaggcgctcctcacttcccagactgggcagccgggcagaggggctcctcgcatcccagacgatgggcggccaggcagagacgctcctcacttcccagacggggtggcggccgggcagaggctgtaatctcggcactttgggaggccaaggcaggcggctgggaggtggaggttgtagctagccgagatcacgccactgcactccagcctgggcaacattgagcactgagtgagcgagactccgtctcaatcccggcatctcgggaggccgaggctggcggatcactcgcggttaggagttggagaccagcccggccaacacagcgaaaccccgtctccaccaaaaaaatacaaaaaccagtcaggcgtggcggtgcgcgcctgcaattgcaggcacttgggaggctaaggcaggagaatcaggcagggaggttgcagtgagccgagatggcagcagtacagtccagcttcagctccgcatcagagggagacggtggaaagagagggagagggagaccgtggggagagagagagggatctctaatttttgtgacaatcctacaaggaaggcagcctccccttttttgctaaacctcagagaggttaagtgacttgccaagcaaggtttgtaagtaacagaattaagatttgaatgcacatctgtctgattcccaaatatgagttctattcattaagcttccctgtgttcataatgaaagggtcactgagaagtttaataagatagtgttcagtgttcttcatttgatgaaggaaactgtatactatatttctgacaacagtttccatcttggattatcttgactttaaaagattaaaacgaaataaaattggttgtttaaaggaacatgcctcagttatctggaacattttggtatatgtagagtgcattattcccccaaactgcaaagtagaagggagtattatttgtgttcttagagaaatttaagaggtcctcactcaagtactaattctgtttcttaactaattttaacttgctttttaaaaagcaaatgtttatataagggttattataagctagtcactgttatgagtactttataaatattaactaacttaacatatatctttataataaccttggaaaagttacttcagcactttcgttctttttcctggtctttaaacagagacagttggaccagatgatctccaaagcccactccagctctgcaatgttaaggctttctaactaacacataacacatagttatgtgttaagaaaagttagataaggtcagcttttcctagtgggaacagagatgagagtggagccccaaagacagtgcacagtagaacaggaagttgtgatttaggtgaattaaaagtgcagagtctgtatgtagcacagtgtcagtttgggagggaaggaaggcagcatcaaatcgttgttgaggttttgatgatgtgaagctctttagtctacctttctcctttccttaatatctaaagggagaaattccaagttgttatgtcttgagcagagcacatgacacctccttattaaccagcactactttttagctataggttgaaatttggctcgtggttcttcaagattttaagaaatagtaaataggagagttaaggatttggtatgtgaaaatatcaaacctgaatctagatgcatgaatctgatcaagcatctagagctcactactaatttactggaaatacagggggcagaggaatatgttaaattacacctcaagggtacaattaccaaataccatctgtgggaaactgcaagacaacccagtttcttccaataaatgaattgccaaaaaaaaaaaaaagagatggagcaatgatctatagataaaagcaatttgagataaagcaaccatttgcagtgtatggatcatattgggcccttagttcctgatttgaacaatcagaggaatctgaacaccagttattggagttattaagacatttttgttgatttttatttagggttaataatgctagtgagttaaaactcttttttttttgaggcagggtctcaatctgttacccaggctggagtgcagtggcacaatcacagctcaccacagcctcaacctcccgggctcaggtgatcatcccacctcagcctcctgagtagctaggactacaggtgcctgccaccacatcagctaagttttgtactttttgtagagagggggtttcaccatgttgcccaggctggtctcgaactcgtgggctcaagtgatttcccattttggcctcccaaagtgctgggattacaggcgtgagccaccatgcctgacccaaactctttagattcagagctaaacactgaaatatttatggattaaatgatgtgatgtctgagatatgcttcaaaaataactgggaaataggggatggaatagatggagttatatatgaaacaagattggtcatgagatgataaagctagtttatgggttcatggggatttattatactattctgtctacttttatatatgtttaagattttcatcttgaaaatctttttttataagctaacaaagggccagctgtggtggctcacaactgtaatcccagcacttcgggaagctgaggtgggaggattgcttgagcccaggagtttaagacaagcctgggcaacatagcgagacctggtgtctatttaaaaaaaaaaaaaaaaaaaaagctgacaaatacacatatgctttcaggatagaagttatgaaaagggagattataaaacagtgctttcttagtgattttcatgcagaagcaacatcttcctaatcttcctatagtaaagatttcctcaagtaaacatattatatattcattataatataaatagtatatattcattagaaaggatataaacagttcagaaataccactatagagaatgaaagtccccttcttaaagcaaattatactttttaaatgctgaaaattgtcatgtcatttgcacgtttctttttccatttttgaaacgcacaagataaaatttcttaatagagtagaacaactaatttagattcagagtcaattctataaaggtttcctactgtactgcattgtttttgctttgcaaagaggttattaacattttttttctgggttaggggaggagtttgaaaaaatcctgtacaagttaatccattgtgtggtaaaagctatagctgaagaggcaatgtggaatactccagtgtgcacaacccctgcttttatcataggtggcaactgcagattaattctggtgtggttaggcatttcacaaagggaaatatgaacctgagagcctatgtccccaacagtgctaactgggagatgtggagtgtggggatttccactctttgttaataagatctccggcacatttcctctttgcttttgcattttccttggttatgaagcagctgcagagaagtaaaatgtgatttcctgtgtttaaaagagtgctggcttttctttcagagacttaaaattggaagggtggaatgcatatggattgagctacctacagggctaatttaaacataggtgttttatttttgtttttgtttttgtttttgtaatgagttcactgcatttgtgccaggaatatttttgttcagatgttttgaattagcagataactcaggttgtctcaaaagcaggcttctctctaggctgatcactgctttaacagtgtgattctttgcaagctgactgaaaaaccactaatggcaaaagtgcattctgtcatatcaataaaaatactgtagttcctttgcagattcatgcagtataaatgcttatcttgattatttaacctgtaaaattctccaaaatgagaaaaataggcagagggtgtttttcaagaaaatatgataaggccatatcaaggtacagtgtccccagatacaatgtcagtgggaaatgaaaagaacttattcgcagagtagatgcttaggaatcattagacttaggtgaaagttcctatcataaattaatacctttttttgtagtcgttgtcaatatttcttgccctaataatggtagttcatttttttcttttttcttttctttttttttttttttgagacggaatcttgctctgtcgcccaggcgggagtgcagtggctccatctcggctcactgcaagctccgtctcctgggttcacgccattctcctgcctcagcctaccaaatagctgggactacaggcgcccgccaccacgcccagctaattttttttatttttagtagagatggggtttcactatgttagccaggatagtctcaatctcctgacctcgtgatcctcccgcctcggcctctcaaagtgctgggattacaggcgtgagccaccgcgcccggacgttcatttttttcaaaatatacttaggagcctatcctaaacatgggccagacctgtggatatttttggatgtggtttcttcccaagtcattcaccattgtgttgatggtacaaggcttctccacttacaatcagagaaacgtcagatgactattagtaaacaagaactgattattaagtaccagattagcagagctggatgatcagatccaaaccacagcattcattgttcctgtaaactatgtgatcagtgaagctaaacttgtgtttaaaacccaggcacccgctgccacacccagctaatttttgtatttttagtagagagagggtttcagcatgttggccaggctggtctcgaactcctgacctcaagtgatctgcctgccttggcctcccaaagtgctgggattacagtgtgagccacggtgcctggcctgttactttctattaataagtacacaacaccctaaacaattcaaggcatcttaatctccattaagaacaacaacaaaataatttttgtcatgctgttaaatctatcactatggataaaactggtgcaaattggtcaaatggatccaacaaacactgatgtccaagttgggatattcgtaactattaataatacgtaactattgatcaatagtttaaaagatctctttattctttttctttttgaaggttctcaaagagttttgttctgaaatatgttgttgagcttcccagtttgcatcctcatcctcaaactgatgttgtttcttctctaattctttgtgttatgcttctttttcatttgctcatggcactgccattggagctcaacttcagagtccttcagtttttgaactttttttttttaccttcatttcaaacacctgctccatttccagctccgtcttcttcattttagctacatgctcccttctttcttcttccatttgtgccagaaggctcttagtaagcccttatttgttatcaactccattataagtcacaactgccagttttctcctttcatagtgggcatttagtaacatctttcaaatcgtgcatatgtgttatcaacatatttcttagaattgtaaaaacaatgttcaccattttcaactttaccaacaccccaaggatactgccttcccctaacccttttgccattaagttcaatgatatagtattactacctacctaagcaagaggtaaatggtccttcttctttttaacaagcttgttgtcttcttcacctgtttctggaaatttatatattttaagttcttagatttctttcattatctgttttaaagttattatctggtttaattccatgtcctgaaggagcagtgaagtataaacccggcaccctgttatcaggcatctgaaatctgttcacttgtgattctgcatttaggtagtccacagatttactatcaatgtagttgatgacgagctgccagcaattactattatctactgcatctccaaatcctatttggtatcaactattgtgagcagcaacttaacactaccttccttgattaaaactttggattgttcctcctgtacagtctttttagtaataattctatgagaaagacttggatattctggagaatgcaaatctatgaggaatcatgagttgattaatgttgtctttcctggatttcccaccaccgtaagtgtgaattcaaacgttctcttcactgattctctggatacttgatttgggagattggcaaatcccacacatttccatcattccagtcgtccagattccaacagaagaaatccacagaagaaccacggtgctgctgttgacgctcctctcctaatcagcagtggatctcgcactccaggtcattcttttcaaaacactgatgtaatcctattactcccctgcctcaaaaccttcagcagtttcccattcctgccctgcaagtaattcctccagtttggtcgcagcctacttttcaggcctcattgcttgccactctcctctacagacacgtgcgtcagccagtgccagctaattagtggctctagactgctttgtgttttcttcctcttctttttcccctcatctaaaatatacttctacctccaaatcctgtttttccttcgtgactatctcagtcccttttctgtcacacaaccttttttgacccctgtagtctgcatttatcttttcttcctttgaacttgtagcatttattaaccctggcacacatctggctattgatcctatactatgtgttctttttttagtgttgtttagtttttcatatcagtatctattgttatttcaaccagattagaaactctgagggacaggacaccctttttcctattttccacaatgcttggcatccagtaggtgtgtaataaatacagttatttatacattaaataatccagtgcttacatttattatgtcatagctaccatttcagttaatctttacaataactttgagggaatgagtattttctctccttgacaaatgaggaaactgaggctcagaaaagttcggtaacttgctgaaaccacacaggttaagtgatgaagtcaggattcagacccacatctttggactcagtaacacttgctgtttaaccatactggtaattctgcctccttatgagactggtgtatgttttctgaggatgggaaattacctaacacttagcttactattatttgcttgataatggcagaagaaaaggtgtgcaaacctggattcgtagtgattcctagcaggaataatgaaacagattcaaactgtgccaaagttcacaggaaaatagaatttcccttaatctcgttgattactggtggaatgactcatcttccagttgtacgttgctcttgagttactcagatatttgtataagttagacagcggagggaaaaccactgatgagatgtacaagacacgtcatttgagctgatgaatgttcctgggatatccccaagatttctacctgagtattcctgcctgtcctatttactgttggactctttcaccttttggttttctttcagagtaaaatcacttcccatttcctttctgctttccacttggataactttcacaggctactctgttactactgcagtgcacaaagatttactgtctacatatttaacattagtcagatttactgttgaatttatgcactagaaatttcaggaatttaaatttttcctttttcattctcttctctgcttccgatttttttcactaaaagaggacaaaaattgcccaaactattttctttttttaaaaaattagcaatagaattgagtatagatggtagtaaattctgcttcatttctgtgggaacattgaaaacttgatggcttctgcaagtgactgataaattgtttctgctttataaagaaaggaaacagctcattcaactcaatgaagtcattagtaaactgggaattagaaataaagattctgtatttttttgttgtcattaatttggtctttctgtctgcatctgttttctcacaagtttgttttgaggatagatcagaagacatatgcacattgtaaagcataaagtaatccttaaggatgcactacaggcaatcctcagccaaaaaacatgatttatgaaccatgcatacatgcatactacaaagggatcgatcttacctcagtctagtgccctttgaaggcgacaagctaaatggtctttttggcccctgaatcagaatacctggaaacaactgaaatgtagacatatttttcttatacatgtggaagcagttaggttatgggtcctttcagggattcatctactctactgccatgtgaagaccggagcccatttctcagtcaggaacaggaagcaggcaaagttactttcctggtatccagtgttaaaacccaaagagttataaatgttgacaaactattggtaaaacttgtggtattattatttacctaaagcacatacaggggcttttatagtatagactttttacagtcaaatcatttaattttcttgagtccttacaatagcccttcgaagtatgtgttaataaccccactttattcctgaggaacgtaaggcccagagaagtgaagcgatttgattggtgaaggggcttaaattttctacacatttccttccaaggacgaagggaagttagacactgtgttggcactttagagcagattctgggttaggtgtgaagcagaggggatttccagggtgtgtaagcatggacaaactccttgaatgaaagcagaattttttctttttttaaagtagttaacagcattttggggtttgcaggactcaggctgtgttactgccttttttattttttggcctgatttgtttctttctaatttgggagcaagattttataattaaaaatatattgccttttgccctttctttgagctattctccataaatctgtaagaatatgatatgaaaaggaagaagagtgggattaaaaataatatagctgattctgtctagaaatttaatttctaaactatctttacctgagttagatctatttctccaaagatcagtcaagatttaagaaataactttaaacttgtaagtaaattcttttctatctggaatttacaggataatgtattaatacttggaaatgatacctaactgctagggagcatgcatctttagctcatgattctagatgattgagaattttttagggaaactttttcagtccttcatctagttgatagtgggctatcattttatatttctagattgaaaaataggttatcttctttctccttcctctctctcctcttccccttctcttttttcttctttctagctgtatggaatgaccataatttaattattcattgagtctcctattaacgagtatttaacttgtttcaaatctttcactattacaaaagtgtcacagtgaatcatcttacacatttgtaatttctcacatattccaagatagatataagatagattcccacaaattgaattgctagcacaatggagacatattaattttgattggccttcatggaaattttaacagtatatactgtgatcagcaaaatatgagaattctttctccgcaccttgaagattcagtgtgttatcaaacattttgatctttgcctatatgaagtaaaaaaataaaattgcagtataggattaatttacaattttcttggagtgtggtggagcatattttcataggtttaagaggcacttatatttattttctgcaaactgctcctgtcttgtctgttttttgagttattgactgttttcatattaattttaggagctctttatttgaaaaatcatctgtgatttaaattacaatttttgaggcttattttttttctctatgtatactttaaaatattcgaatttgtcagactttccttttatggctcctgggtttcatatttagaaagattttttctgttgcaaggttattgaaaagccaacaaacacaaaaaacttccttttgctcccttcacttttgttgtttttctctaaatttttcatccatttggaatttttttctgatgtgaggtatagttccaacttaatttcctccccagctaattagccaattgtgtcaacatcatttaacaacccatattttaccccactagggataaagcgggatgttacttttagcatataccaaattcttcatataaatatttaggtctctttttggactttctgttctgattcactaatctgcattcctaacagtatgacactattttgattattgtagttttatgatatatctaatatctattagagctaatttttataacttgggttctggcactttctttaataaacttaccagaggtaaatattataggcctctgataaaatgtattaataatgctccctggggcaaaatcatgttttatatatgtgacagagtcctattacccgtggcttttaagcgttttttaacacaacacagatacaatatacattttatgtaataacacatttataaatgaaaaaaaatgtatacataaaaaaattatgtactcttgctgtatttgttgcactctattttagttctgtttatttctccctgaaatgctggttgcaactgtattaaattgatctcatgacctagtaaggtgttgtgacctgcagttaaaaaaacaccttattatttgatgttgtaatcatagccattctaactggtttgagatggcatcttattgtgcttttaatctgcatttctctgatgattagtgatattgagcattttttcatatgtttattagccacttgtatgccttcttttgagaagtgtctgttcatgtcttttgcctgttttttaatggggttatttgttttttgcttgttgaattaagttccttgtagattctggatattagaccattgttggatgcagtttgtaaatattttctcctattccgtaagttgtctgtttactttaatagtttcttttgctatacagaggctctttagtttaattagttaattaattaggtcccacttgtcaatttttgtttttgttgcaattgctcttggggacttaaccaaaaattctttgccaaggctgatgtcaagaagggtatttcctaggttttcttctaggatttttatagtttgagggtatacatttaaatctttaatccatcttgagttaattttgatatgtggtgaaaggtaagggtccagtttcattttgctacatataactagccagttatctgagcaccatttattgaataggaattcctttccccattgcttgtttttgttggccttgtcgaaaatcagttgtatgtgagtgtgcagctttatttctgagttttccattctgttccattggtctctatatctgtttttgtaccagtatgaggctgcagagaaaagggaatgcttatacactgttgatgggatgtaaattagttcagccactgtggaaagcagcttggagatttctcaaataacttaaaacagagcaaccatttaactcaggaatccactgctgggtgtatacccaaagggaaatggatcattataccaaaaagacacatccactcatatgtgcattgctgcgctactcacaatagcaaagacgtggaatcaacctagtgccaatcagtggtggactggataaagaaaatgtggtactatacaccatggaatgctatgcaaccataaaaaagaacaaagtcatgtccttcacagcaacatggatggagccggacgccataatcctaagcaaattaattcagtaagagaaaagcagatactgcaagttcttacttataaatgggagctaaacattgagcatacatggacataaacatgggaacaacagacactgcagactgctagagggggtggggtatgggttgaaaagctacctactgggtactgtgttcactacctgggtacagtatacccatgtaacgaacctctacatggatctgctgtatctgaaataaaagttgaaatactgaaataaataaaaataaggaaaaaagaaaaatccttcattagacatatccaggtgaaattccattagtccttattagtctcttttggggagggagtaggggagtgggagtgatgtatctccttaaataaaatagggagaccacatcaaagaaagtaggatttcccagccaaaaaaaactcatgaaggacgtttgcaaagtttctctcccattgtttgcaggtaccttgcagggaagggcagcagtcttgattggcacgccttgcttaagaatacaggccacactattaaaatgtaccgtataggaagaaggaaataactattatagtgcatgtgccaagaggtttaggccccgtgtgtaaactactccatgatccttaaacatagttgttttgatgtcttctggcttttgggatttctagcttgaatttcttagttttgagatggggtcttactacgttgcccaggctgacctggaactcctgggctctggcaatcttcctgcctcagcctcctgagtagctggggtccagcttgatttctgttgctctgagggatagtacaagagaatgaacttctgggttttgaaccccaagttcaccatttactagttaggtgatctgcttaacttttctatgctttattctcctaatctgttaagtgggaaaaatgataatatctacctcataccattgttacagcaataagaaagtatatgtaaagcacttagaatttttgtttcttaatagcattgtgatctacatggcacatggaaagcactatgtaagtttatgatattatttatttgacttggaagtgtgtaggatttttttctttaatctcacaattaaacattttgtgaggagacgattaggtgatttttttcatttttcccagagtctcatgtcatgtgccctttaaaatgtaaggttttttttttggagacagagtcttgctctgttgcccaggctggagtgcagtggcatgatcttggttcactgcaaccttcgcctcctgggtttaagcaattctcctgcctcagcctcctgaatagttgggattacaggcacctgccactacgcccagctaatttttgtattttttgtagagacaaggtttcaccatgttggccaggctggtcttgaactcctggcctcaatggatctacccacctcagcctcccaaagtgctgggattacaggcatgagccagtgtacctggccaaaaagtaggtattttttaatctcggggaagttatattttttttaaaaaaaagattcttcttctttttgttttgatttattccttgagaacacccttctgaggcttaaaagttggatctctgttctctgtcccttatatccataatgttctttctcttaacattctttttcttcttttcttctgcactgaagtagaatttctcaaaatttgtgctgcatttcatgaaatacatgttctagtatattagttctaatctttactgctttcaaagcatatttaaattctgctgttgcattttttttcatttctattttatttttggatctctttgcatctcttgctattctctccttaaagcttattgctctttcttcatagatgcaaccgaatttgtcctcttctttgagggatccaggcagaggtcttctaaattgtatttgagtttcagaacatgcttttatctgaatctttttttttttttttttttgagatggagtctcgctctgtcgccaggctggagtgcagtggtgtaatctaggctcactgcaacctctgcctcctggattcaagcgattctcctgcctcagcctcccaagtagctgggactacaggcgcgtgccaccacgcccagctaatttttttggtatttttagtagagacagggtttcaccatgttgagcaggatggtcttgatctcttgaccttgtgatctgccctcctcggcctcccaaagtgctgggattacaggtgtgagccactgtgcctggcctatctgaatctttaaggcaaagctcctaacgtatctttcattggcctgtgatagactttttcaccctattgaattatccttgagagaagagatccattaatgctcagcatatgccattaggtagatgggcagagtgtacttaccccttcattgtcccttcggatgctggcagtttccaccttttggatctagactcatcaggatattactccagtttatctggtaagctgcatgaagatggggcatttttcctctctggcttctcaagtcagatgccatttataattcttctctgaacagcttatgaaagattattccttggtgtcatgtgcttgtcttatcttactttcagtcccgttacctgcttataccacttctctttagatgataaagtgttcaaagatgctgtatttgcctaactctcctgccttgaaggttaattattttattaggatagaagaaaacagctaacggaccacctggattgagtggtaaagtaaacttgcttgagagatgtttgacatgcggtaaggagaccatcactgttttttctgtttattgcagccttttttcttaaaattgagttaaagtattttttctgctttactttgagtcacctctactcttttttgtctccaaagctggagaaatgcgataagatagtttgtctcaataaattaccattgattactattggtcatttggttaggagaactctcccaaacatctcttctctttagtttacagtactgttgccagtttaaaatttctctagcctccatgttagttgttagcttacaatgatactttttagccacgtggcttcattttcccctagctacattaaggcagtcatgttaatgttcttatttaggatctatttggcttccatggtttaaagaatgcacaggaagtaattagatacagagatggattttttatttttgttcgcatgttaagagcactgcttccaaccaaaagagctggtattcccctgtttttccacatctgctatgactaaagccagttgctttaataccgaattcacaaagacctttctcacttaatgtcctactctagcaaataagaagaaataagtggaaaacaataatgcatactcaaaactttgcataaaaagtagtgatcgtcacatgttaactatatccatgtgctgcagacaccagataatattttctaaggattagaagaaaaggagtattaaagcaactggctttaacacatttttcccccattcattcattagttaatagacacttgaattgttttcggtttttggcaattaggaataaagccactgttaacattcacatataagtctttgtgtgggtgtgtattttcttacttcttctgtgaatactcataaatgggactgctcagttatatgataaatatatgtttaactttgtaagaaactgctgaattattttccaaagtggttgtaccatcccgcattcccatcagcaatgtttggaaattccagttgctccacatacttgttatgggtcagtctttttaatttcggccattctagtgggtgtataatgatttcttgctatggttttaaatttgcgttttcctaaagactaatgatgttgagtattttataatagttattggaccaaagggagttcttcatctttgtaacattgatataataagattatttaattgctagttgatactcaggttttgtcacttgtcccaataatgtccataacaagcttttccttcctctagatccaaactatgaccacacattgggtttagttgtcatgtttctttggtttcttttaatctcagttttctttgtctttcttagacctcaacttaaaaaaaaataataaaaaagcataggcctattattttgtaacatgtctgtcaatttgggtttatctgatatttccttatgataagattcaggttggtatttttggcaagaatgttacagaaattatcttataaccttttcaagggcattgtatcaaggacccccgtatgtgactattagtgatgactttgtatgttgcccaagaaatttatgcctattctaatgttgctaataattttcctgttttcttctagaattttcatagtttcggcttttaagtttatgaactatttagaaatattttgtgtgtgtgatgtgaaatagggattgaggttcattcatttttttttcaactttttgccttattagcttttcctatttctttgatttctgcttattattattctactttctttgaaatttaatttgctcttctttttctacctttttaagttgaaaacttaggtcaatgttttatgacctttctttcttttttttttatataagtatttaaagctatgtatttcctgctaagtactagtatactgcatcccatgaattttgatatgtaatttttattatcacttagttcaaaatatttccctaattccctttgtaatttttttgacccttgggttattgagaactgtatttaggaatacttggggcttttatagatattttactgctagtggttttttgtttaagtgtgtgtctgtgtgtatatgtgtgtgtatgtgtgtatcagcaactataaagatctcagtattttgaaatgtattgaaacttattttatggttagtctattctcacactgctataaagaactgcctgagcgtgggtaaatttacaaagaaaagaggtttaattgactcaaggttctgcatggctggggaggccttaggaaacttacaatgatggcagaaggggaagcaggcatgtcttacacggcagcaggcaagagagtatgtgagagcacaggaaaaactaccgtttataaaaccttcagatctggtgagaattcactcactatcacgagaacagcatggaagaaaccacccccataatctaaacactttttaccaggtcttcccttcaacacctggggattacaattcaaggtgagatttgggtggggacacaaagccaaaccatatcaatggcctacttgtggtctgtcttagtagatgttccatgtgcacttgaaaaggaatacgtagtctgctattgttgggcatagtgtcctacagatatagatttgtcttcgaagtcctcactgatttttatctacttgttcaatcaattatgcagagaagagtgttgaaatctccatctgtaattgtagagttacctgttcctcctttgttctgtcagcttttcctttatccacatcttgaagctctattgttatttatgatatgactttgatgtattgatcctgtcatcattatgaaatgtcccttctttttgtagtattccttttcttcaagtctattttgtctaacattagtgtcaccattccaagtttcttaagcttattgatgcatgatacatatttttccctacttttcactttccccttattctgtattaaagataagtacatctattatagatagcattttttataaggttggatttaagcattttattttgctatttgtcttctatttatcccatctgctttttgttcttctgtttctcctttgatgtctccttttgggttaattgaatttcttttaatttgtcatataattcatctattggcttttatctatacctttttgcttttttttaaacttttaaaaaattttatcaactctggcctacagatctacattattttttaaatgtatgatttgggctttacaatctgaatccttaacttaattcagtttacttacagtttatattgaacgatttcacatgaaatataagaacattatagcaatagaattccatttaccacttcctggtctttgtgctattgttttattgtagcttaaaacatatattacatgtgttttaagccccataatatagtgctatgataatttttgctttaagtagtcacatgtcttttaaagaaattgaaagaataaaaagtatattcttttttataaatatccacatctttaccattttatttttggtgttttttcatttcttccaagtctaggttttcatctgatattatttcccttcagcctgaagaaattgctttagcatttctttctttcttttctttttcttttttcttttttttttgtgacggagtttcactcttgttgcccaggctggagtgtaatggcgcaatctcggctcaccgcaacctctgcctccccggttcaagcaattcttctgcctcagactcccgagtagctgggattacaggcgtgtgccaccacacccagctaattttgtatttttagtagagatggggtttctccatgttggtcaggctggtcttgaactcccgacctcaggtgatccacccacctcggcctcccaaagtgctgggattacaagcatgagccactgcacctagccttctttcttttttgtagagacagtatcttgctgtgttgcccaggctggtcttgaattcctgacctcaagtgatcctcctacctgggcctctcaaaatgctgggattacaggcatgagccatggcactggccagctttagcattccttatgttgcaggcttgctggtgatgaattatctgttttcatttacctgaatatatctttatttcaccttaattgtttttggcaatttttgaaggatatttttactagatatagaattgtggattgaaagcagttttttgttgttgttattttatttgttgtctgttatccttttaaagatgttctctggccccattgtgtctgatgagaattaaactgtcatttgtatcattattcctttttatgttatgtatcctttttttctgactgcttttaagatttttctatttttgattttcatcagttttactatgatgtgcctagttatagttttacttatggttttctttgtgtttattctgctttgagtttgctctgcttcttgggtaagttatgtatttcatcaaatttggggatgttttggctattcaaatactttttattactctatcctttctatcctctccttctagactgtaattacacatgttaatctgtttgatattgtaccacaggttactgagacccaattcatctttttgctttcattaaattgtataattttttgttgctctgtctttcatgttcactgactctttcttctgccatctccaatctgctgttaaatccaccctaggaatattttatttcacatttgtgctttttggttctgtaatgttcattttgttaatttttctagtttacagtctctgtggagattttctttctttgcattaattatgactatatttacttctaattttttttttttttgagatggagtttcactctgttgcccaagctggagtacagtggtataatcttggctcactgcaaccttcgcctcccaggttcaagtgattctcctgcctcagcctcccaagtagctgggattacaggtgcccaccaccacatccggctaatttttgtatttttagtagagacggggtttcactttattggccaggctggtgtcgaactcctgacctcaggtgaggcacctgcctcaggctcccaaagtactgggattacaggcagaattcttgattatatttgcaatagttactttatagctcttgtctgctaactcaggcatctacactttggattggtttctttctttccttccttccttccttccttccttccttccttccttctttctttctttcccctctttcctttctttcccttcctctctccctctctccctctctccctctctctcctgtcctctcctctcctctttctttctttctttcttttctgagagtctcgttctgtcaccaggctggagtgcagttgcatgatctcagctcactgcaaccttcgcctcccgggttcaagcgattcttctgcctcagcctcctgagtagctgagactacaggtatgcactaccatgcccagctaatttttatttttaagctaatttttttatttttagtagagacaagctgtcaccatgttggccaggatggtcttgatctcttgacctcgtgatccacctgccttggcgtcccaaagtgctgggattacaggtgtgagccactgcgcccagccagtttcattttttttttttggagatagagtttctctctgttgcccaggctggagtgcagtggcgtgatcttggctcactgcaaccttcacttcccaagatcaagcaattctcttgccttagcctcctgagtagctgggattataggcatgcaccaccatgcctggataatttttatatttttagtagagatgaggtttcaccatgttggccgggctggtcttgaactcctgacatcaagtgatccacccacctgagcctcccaaattgctgggattacaggcttgagccactgtgcccagcccagattagtttattttgaatcccttttttcttgactgtggatcacatttctgtatttcttttcatgtttattaattttcaattgtgtatcagacattgtgaatgacacattgcagaggctttagagattatctatgtttgtctagaaattattgattttttgctaatttagcaggctgttaaacttctttagacttagactccaaactgtctcccttgcagtgggtagcagctgagatctctgcttaggtctttcaagtctttcacctgttgcttttttgctgggcttcttggaatcttctccaagcatgtgcagatcatgttttacccaaggatttgaggagatttatgtgcaaattttgtggttttatcctttctaggattccctgtcattttccagcctctggttgccccaaactctgtcttctgtttcctcaaaccagtaagttctgcagctttctgcttgatttccagctgttcctgctggccatactgtctggagattgccctctgaccaagacaaattttacctggtataattcccttcttttctttcctttattttcccaaatatagtggctttaaaaaaacgcaatcatttattactattattattgttgttctctctcgtggttctaggggttgatgagactcaattgatgcttcttgcttgggtctcctattgtaatcaaataggggctgggggtcatcttgaaatccccctcagtctcatcggtgtggtgattgatgctagctggctgttggctgggactccgttggactgtcagatggaacacttacatataacgtctacttgggcattctcaggatggctggtttccaagagcaagcatcctgagagtgacagccagatgaaagctgtattatcttttatttcctagcctcagaaatcacataatgtcacttctgccacatcccactcattgaggcagtcacaaaggagagcccatattcaaagcatagggtattagacatcaccttttgagaggggagtgtcaactaattttcagacagattttaaaactaccaaaccttcaaatgtcatgtcccctccagtttctgcctgcttttgctcattctttggtactttgaaatagttgggtatttatctagaatttatattattatctagtagtccagtacaaactattccatcattaccagaggtagaactccctcccctatttttttctccatagcattctcacatttaatattatttacttattgacttcgtttattttctgcatcctcccactaagctccattaagttggggtttttttgttctgttttgttttgtttgtccctttggtaaactgctaggcatgtagtaggtgctcagcaaatatttgttgaattaatgattggctgaatctttacctctccaaaacagccataggtaaataaaagcctcttaatgacaaaagaggacctatacgttttacagccttgttctttcagcacggttgtactggtagagtggcatacctaaggttcactcctccttggcctacagaacaggacttagagattttgacagttcattcttcttttttttttcttttttttttttttattatactttaagttctagggtacatgtgcacaatgtgcaggtttgtatacatgtgccatgttggtgtgctgcacccgttaactcgtcatttacgttacgtatatctcctagtgctatccctcccggggcgccccaccccacgacaagccctgatgtgtgatgttccccttcctatgtccaagtgttctcattgttcaattcgcacttatgaataagaacacgcggtgtttggttttctgtccttgcaatagtttgctcagaatgatggtttccagcttcatccatgtccttacaaaggacatgaactcatccttttttatggctgcataggattccatggtgtatatgtgccacattttcttaacccagtctatcattgatggacatttgggttggttccaagtctttgctattgtgaacagtgccgcaataaacatacatgtgcatgtgtctttatagcagcatgatttataatcctttgggtatataaccagtaatgggatggctgggtcaaatggtatttctagttctagatccctgaggaatcgccacactgtcttccacaatggttgaactagtttacagtcccaccaacagtgtaaaagtgttcttacttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgaataaatgtcttcttttgagaagtgtctgttcatgtcctttgcccactttttgatggggttgttttttttcttgtaaatttgttagagttctttgtagattctggatattagccctttgtcagatgagtagatagcaaaaattttctcccattctgtaggttgcctgttcactctgatggtaggttcttttgctgtgcagaagctcttgagtttaattagatcccatttgtcaattttggcttttgttgccattgcttttagtgttttagacatgaagtccttgcccatgcctatgtcctgaatggtattgcctaggttttcttctagagtttttatggttttaggtctaacatttaagtctttaatccaacttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagataagcggcattatttctgagggctctgttctgttccattggtctatatctctgttttggtaccagtaccatgctgttttggttactataaccttgtagtatagtttgcagtcatgtagcttgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatactgattcttcctatccatgagcatggaatgttcttccatttgtttgtgtccttttttatttcgttgagcagtggtttgtagttctcctggaagaggtccttcacatcccttgtaagttggattcctaggtattttattctcttagtagcaattttgaatgggagttcactcatgatttggctctctgtttgtctgttattggtgtgtaagaatgcttgtgatttttgtacattgattttgtatcctgagactttgctgaagctgcttatcagcttaaggagattttgggctgagacaatggggttttctaaatatacgatcatgtcatctgcaaacagggacaatttgacttcttcttttcctaattgaataccctttatttctttctcctgcctgattgtcctggccagaacttccaacactatgttgaatagaagtggtgagagagggcatccctgtcttgtgccggttttcaaagggaatgcttccagtttttgcccattcagtatgacattggctgtgggtttgtcataaatagctcttattattttgagatacgtcccatcaatacctaatttattgagagtttttagcgtgaagggctgttgaattttgtcaaaggccttttctgcatctattgagataatagtgtggtttttgtctttggttctgtttatatgctggattacatttattgatttgcgtatgttgaaccagccttgcatcccagggatgaagcccacttgatcgtggtggataagctttttgatgtgctgctggattcagtttgccagtattttattgaggatttttccatcgatgttcatctgggatattggtctaaaatttctctttttttgttgtgtctctgccagactttggtatcaggatgatgttggcctcataaaatgagttagggaggattccctctttttctattgattggaatagtttcagaaggaatggtaccagctcctccttgtacctctggtagaatttggctgtgaatccgtctggtcctggactttttttggtttgtaggctattaattattgcctcaatttcagatcctgttattggtctattcagagattcaacttcttcctggtttagtcttgggagggtgtatgtgtccaggaatttatccatttcttctagattttctagtttatttgcgtagaggtgtttatagtattctctgatggtagtttgtatttctgtgggatcggtggtgatatcccctttatcattttttattgtgtctatttgagtcttctctcttttcttctttattagtctttctagcagtctatcaattttgttgatcttttcaaaaaaccagctcctagattcattgatttttttgaagggttttttgtgtctctgtctctttcagttctgctctgatcttagttatttcttgccttctgctagcttttgaatgtgtttgctcttgcttctctagttcttttaattgtgatgttagggtgtcgattttagatctttcctgctttctcttgtgggcatttagtgctataaatttccctccacacactgctttaaatgtgtcccagagattctggtatgttttgtctttgttctcattggtttcaaagaacatctttatttctgccttcatttcattatgtacccagtattcattcaggagcaggttgttcaatttccatgtagttgagcggttgagtgagtttcttaatcctgagttctagtttgattgcactgtggtctgagagacagtttgttataatttctgttcttttacatttgctgaggagtgctttacttccaactatgtggtcaattttggaataaatgcgatgtggtgctgagaagaatgtaaattctgttgatttggggtggagagttctgtagatgtctattaggtccgcttgatgccgagctgagttcaattcctggatatccttgttaacttctgtctcgttgatctgtgtaatgttgacagtggagtgttaaagtctcccattattattgtgtgggtgtctaagtctctttgtaagtctctgaggacttgctttatgaatctgggtgctcctgtattgggtgcatatatatttaggatagttagctcttcttgttgaattgatccctttaccattatgtaatggccttctttgtctcttttgatctttgttggtttaatgtctgttttatcagagactaggattgcaacctctgcctttttttgttttccatttgcttggtagatcttcctccatccttttattttgagcctatgtgtgtctctgcatgtgagatgggtctcctgaatacagcaacactgatggatcttgactctttatccagtttgccagactgtgtcttttaattggagcatttagcccatttacatttaaggttaatattatgtgtgaatttgatcatgtcattgtgatgttagctggttattttgctcattagttgatgcagtttcttcctagcatcgatggtctttacgttttggcatgtttttgcagtggctggtaccggttgtatctttccacgtttagtgcttccttcagaagctcttttaggtcaggcctggtggtgacaaaatctctcaggatttgcttgtctgtgaagcattttatttctcctccacttatgaagcttagtttggctggataggaaattctgggttgagaattcttttctttaagaatgttgaatattggcccccactctcttctggcttgtagagtttctgcctagagatccgctgttagtctgatgggcttccctttctggggaacctgacctttctctctagctgcccttaacattttttccttcatttcaactttagtgaatctgacaattatgtatcttggagttgctcttcttgaggagtatctttgtggcattctctgtatttcctgaatttgaatggtggcctgcctgctaggttggggaagttctcctggataatatcctgcagtgttttccaacttggttccattctccctgtcactttcaggtacaccaatcagacatagatttggtcttttcatatagtcccatatttcttggaggctttgttcatttctttttcctcttttttctctaaacttctcatcttgcttcatttcattcatttcatcttccatcactgataccctttcttccagttgatcgagtcggttactgaagcttgtgcattcgtcacgtagttctcgtgccatggttgtcagctccatcaggtcatttaaggacttctctacactggttattctagttagccattcatctaatcttttttaaaggtttttagcttctttgcaatgggttcgaacttccttcttcagcttagagaagtttgatcgtctgaagccttcttctctcaactcatcaaagtcatcgcaaagctttgttctgttgctggcgaggagctgcgttcctttggagggggagaggtgctctgatttttagaattttcagcttctctgctctgttttttccccatctttatggttttatctacctttggtctttgatgatgttgacagacagatggggttttggtgtggaagtcctttctgtttgttaattttccttctgacagtcaggaccctcagctgcaggtctgctggagtttgctggaggtccactccagaccctgtttgcctgggtatcagcagcggaggctgcagaacagcgaatattgctgaacagcaaatattgctgcctgatcgttcctctagaagcttcgtctcaggggtacccggccgtgtgaggtgtcagtctgcccctacttgggctactcgggggtcagggacccacttgaggaggcagtctgtccattctcagatctcaaactccgtgctgggagaaccactgctctcttcaaagctcagttgaaagtgcagaaatcacccatcttccgcatcgctcacgctgggagccgtggactggagctgttcctattcggccatcttggaaccgccagttcattcttatcataactatcatgtgggttaatttagaagtctagataggccagctgcagatcaaatgaaattacatatgaaagtgctttgtgcagtataaagcactatgagattatagagtgtattggataattgtatgcagttgcatccattagactggctttttcagatttcatttgtagagtatctgtgtgtgtgtgtgtgtgtgtgtgtatttttaagggatgaatattttgaattatcaaaacaataataaaggtcactgcagtgtgtttataataaagtccttactgagttcttattaatgttttgtctgacatttctttattaggaacttaagagatttgagaacttcataaaatctcgtcctccttttgatgttgtcattgatggtctcaatgttgccaaaatgtttcctaaagttcgtgaatctcaacttgtaagtataagttttactttgttattccacatctctagaaatatttattatacccatttatgaccttcttggggctcttagctcctcagtttttcttcctctaaaactaaggtcttcagggtgccacagtgaccaactgcatgctcccctaagatttactattttcatcactaataagtcgctcttcaaggctgggagaaaacaattaaaagtgaggaattaaaagaaagattgcaatacagggccagattttcccgtttcgtgtaacctttagctaaccttctcctgggtctctgctttctctttggggtcgctctgtcatttccctttgggtcatatccttatatttgaaaattatcaatatacaatatcaagagatattaatcactcattactcacatttgttttttccaaacatagtatgttcataaattaacctaagcagtttttttttctatatggtagccatttgttaatttataaatgccctactagtttctaataagactatcatttttcatagctgcaattaacagttactttaatctctattttgtagattaaaaaattgaggctaattttgtatagtaaatctatagaaaacagtcataacatcaaaattagattgtagagagctcctgggtttcagacttgtggctcttatcattggcaatctatagccattcatctgtaattaaactatttcttaaaaattgctgccgctggctgggcacagtggctcatgcctgtaatccccagcactttgggaggccaaggtgggtggatcatcagaggtcaggtgttcaagagcagcctggctaacatggtgaaaccctgtctctactaaaaatacaaaaattagttgggcatggtggcatgtacctgtaatcccagctactcgggaggctgaggcaggagaattgcttgaacctgggaggcggaggttgcagtgagccgaggtcgtgccattgcactccagcctgggcaacaagagcaaaactgtctcaaaaaaaaaaaaaaaaaagtaatgataaaaagagtagtaaaatacatatatattatttttatatttgaaattgaagcatatgtaaagttgaggaaccctaatgggaagaatagaaaaatttgctagacagtaaaaaacaaaacaaaactgaactaaaaaatataaacactgttgaaagacaacaaactgcaaaatgtaggccaggcatggtgggtcacacctgtaatcccagcactttgggaggctgaggcgggcagattgcctgaggtcaggagttcgagaccagcctggctaacatggtgaaaccccatctctactaaaaatacaaaaaaattagccgggcatgatggcgcacacctgtagtcccagctacttgggaggctgaggcaggagaatcacttgaacccggaaggcggtggttttagtgagctgagatcatgtcactgcactccagcctcggcaacaaaacaagactacatctcaaaaaataaaaagtaaataaaatgtttacaatatgtgacaaagagcaaatttcctcactgtatcaggactcataagcctataagaaaaagatgaaccgactgggcacggtggctcacgcctgtaatcccagcactttgggaggccaaggcgggtggatcacctgaggtcaggagttgaagaccagcctggccaacatggtgaaaccccatctctactaaaaatgcaaaaattagccgggtgtggtggcaggtgcctgtaatcccagctagttgggaggctgagtcaagagaattgcttgaacccgggaggtggaggttgcagtgagctgagatcttgccattgcactccagcctgggcgacagagtgagactcctcgaaaacaaaaaagaaaaagatgacccatgcagtggaatagtggtttaattttacttatatttatagatacacagattaaaatatttatcttccagattggtaaatctttaaaagttggtaatattcagtgtttagaatagtttgaagaggtaggaaggatgatatcagtgcgatatttttggtggatgatttgtctgtaactttcattatctaaaatactgaaattctgcttttaggaactgacatagtaacactagtacataaagaaatgtattcaaatgtgttcattattgcattattggtgagcagaaaaatctaaacaacctaaatatctatcaatcttaagcccgatacatatttaaatattaatttttgtgaataaggtaaaccaatatgtgctgctgtggaacagttgtcagaatataagtgtaagaagcaaaatgaaaaacaacatgcttagaattgctctatttatattaaaaacaaagcaaaaaattatccatgtatagataaatgtttgttagataagtttgtgtgtgtatgcccaaaaaatttctagaagtttaacacatacatacatacacacacacacacacacgcacacacacacaatttaacagtgtagttacctttgggaattggggatagaatactgtataagagaattgagaggacttctggtttttgttcacgttttttgaattttcttttaccatgagtatatattacttaaaaattttaaaaatatcaggaaaggaaaaaagttaaaaagcattcttgataaatattttaaaataattttgtaatactctgtgtcttgtggatgtacaataatttttaaatcatttacctgttgttagacaaatgaggctttccatttttcactataataagtaatacttggaagacagcctctgtgcatgtttcataggatgtctttggaatagattttgagaaactggactctttagtcaaagggtatatatatttttaaagatctcactatatattgccaaattgctttccaaaatgattgtagtaatttatactaccaccaaaagtgtataatggtgcctaaatataacacatttctttaaggttacttattacatgattgtttcagccactcacctatgccatgagtccgctaagtgaaaagggctggatggtttcttccccattttttaggtcaaacagatttttttaaattgtgggacaaactttaatgaaatagttccagaaagggaatattcttcactgtcttttctgtcttccttatctttctcttaatacaattacctataagtgtacataaaggaaaaattaggaattcgaagttctataagttttaagttttttccatctttgaagagatttccagactttttgtctgtggagtgatgtacatattatttatgctcttcctataaactctctgcattatacattacacatttttctcggtccttttacattaatggttgattatatatctagtattctctgtaagttcattaatgagaagataacttttttacattcattgtttatggaatagcaccattatcacatatcttgatctcagagcctatagcttaagggtgatagagattaaggaactaaaaaaagaaagttctagttgtaaatgtattttattttctcaattttcaaatgaatcttttttatattttaacttttctgaagtctatgttataattcatgtcagtagaaacttgccagccaccatgtagagatttattggtgactgtcattgcctgggtgtgtacagaattagctatacattgccacctcagttgaattagttatattcgtagctccacacactgttacactgtttaattttaacctaaatcttttttaaaaaacttttattttaagcttgggggtacatgggaaggtttgttacatacataaacatttgtcaagggggtttgttatacatattatttcatcacccaggtattaagcccagtactcaatagttaatcttttctgctcctctgccttctcccacactccccgctcaagtagaccccagtgtctgttgtttctttatttgtgttcataagcttttataatttagttcccacttataagtgagaacatgtagtatttggatgtctgtttctgcattagtttgctaacgataatagcctccatctccatccatgttcctacaaaagacatgatctcattctttttttggctgcatagtactccatgttgtatatgtgccacattttctttatccaatctgtcattgatgggcatttaggttgattccatgtctttgctattgttaatagtactgcagtgaacattcatttgcatgtgtttttatggtagaatgatttctactcatctgggtatatgctcagtaatgggattgctgggttgaatggtagttctgcttttagcactttgagaaattgccatactgctttccacaatggttaaactcatttacactcccaccaacagtgtataagtgttcccttttctctgcaacctcaccagcatgtattattttttgacttttccataatagccattctgactggtgtgaaatggtatctcactgtggttttgatttgcatttctctaatgatcagtgatattgagctttttttcatatgcttgttggccacatgtttgtcttcttttgtgaagtttttgttcatgtcctttgcccactttttaatgggattgtttttctcttgtaaatttgtagttttaacctaaatcttaactttaaatatttgccaaaggtttcctgacaatgtaataaaagacagtggaagttgcttttctaagactaaggtacagaattttaaagcaagaagaggttgttatgactgatttttgcattttgaaaagttgccactgagcctgcaaacttccacctgccaataccttcccatagacattcaagcaaagttgactaacttccagaatggcataattcaaagaaagaaaaagcaataatcagatgtgaaatacaggtaaactccagtatttttcaaccttagtgtcatgctgttggtcctaaaagtgttataaaagtgaagatgaatagcacaggctctaaggagagtggtgtgtaatatgtcaccatgaggatgtacagaactgttatggccaaaagtgatttagaacagaacagccttcaattcagatatgaaagtgtatacttacatgttaattgtgattccaaaacaagattatggtatgaactatatggattaatgtacaattttgttggttactgaaatagtatacttttttgtttgtttttttgcttaaaagttatttattcctaaaccagtgtttcatcttacagtttctggaatgttaataatgaggaagtatgattacaagatgtgctaagtggaactggggactataaagtccctgggctcaagacaccccccaacctcagccttctgagtagctgggactacatacacatgccaccaagtccagctaatttttttttttttttttttgtggagacggggttttgtcatgttgcccgggctggtcttgaactcctgggcttaagttgcctgctgtggcctcccaaagtgttgggattacaggtataaaccaccatgccgcctagattttgcttttggcacaattggagacttggccaagtcatgtctcaattctttaatggttgtatttttttttcttttttattgagaaatataatatttatataacataatattcacccttttaaagtgcacaattcagtggtttttactgtattcacaaagttttgcaatcatcaccactatcctattccaggacattttcatttttcttgaagaagcctcatacccattagcactaactcccagtttcttcctcccattggtccctggcaaccactagtcttcattctgtcttttccttttttctttcattttctttttttttttcttttgagacaggtacttgtgttgcccaagctggagggtaagggtgcagtcatatctcactgcaggcttgacctcctgggctcaagtggtcctctgcctcagccttccaagtagctagaactgcaggcacacaccaccaggcccagctaattttattattattattattatttttcatagaaacagggtctcactgtgttgctcaggctggtcttgaactcctggcctcaggcagtcctcccaaagtgctgggattacaggactgagccaccatgtctggccttctttctatctttatgaatttacctattccagacatttcatattttcacttagcatagtgtttcaaagttcatccattttgtagcaggaatcagtatttcattcccttttattgccaaatcgtgttccattgtatggatatgccacattttatttatttgttctgtagttgatggacctttgggttgttaccacttcttggctattatgagtaatgctactatgaacatttaggcacaagtttttgtgtggacatatgttttcatttcttttggctatatacctaggagtagaattggtgggtcatatgataactctgtgtttaatcttttgaacttcccaactgttttccaaagcatctgcaccattttgcattctcatcagctgtgtataaaggttccaatgtctccacatcctcacgaacacttgttatttgtctttttgattatagtcatcctagcaggtgtgaagtggtatctttttttgtttgttttggtcatgtaagaaatgcaggacctggtatattgtagtttctttgttttttttttttttttagatggagtctcactgtcaccgaagctggagtgcagtggcatgatctcagctcactgcaacctctgcctcctgggttaagcaattctcgtggctcagactcctgagtagctgggactgcaggtgtgcaccaccatgcctggctaatttttttttttcgtatttttagtagagacgggttttcgccatgttggccaggttggtctcaaagtcctgacctcaggtgatctgcctgccttggccttccaaagtgctgggattacaggcgtgagccaccgcacctggcccagtatcttgtagttttgatttgcatttgttaatgatgcatgatgttgaatatcctttaatatatttaatggccatttgtatatcttctttgaagaaatgtatatttattttcttttctttttttttttattttttgagacagagtctcgctttgtcgcccaggctggagtggtgcagtggtgcgatctcggttcactacaacctccacctcctgggtgcaagcgattttcctgcctcagcctcctgagtagctgggattacaggcacggccaccacacctggctaatttttgtgtttttattagagacagggtttcaccatgttgttcaggctggtcttgaacacctgacctcagcctcccaaagtgtggggcttatgggcatgagctaccgtgcctggccagaaatgtctatttctttgcccatttttaattgttttttattattattgttgagttgtaatttttttttttttttttgagacagagtctcgctctgttgcccaggctggagtgcagtggcatgatctcggctcactacaacctccacctcccgggttcaagcgattctcctgccttagcctcctgagtagctgggattatgggcgtgcaccactatggctggctcttttttgtatttttggtagagatggggtttcaccatgttggtcaggctggtctcgaactcctgacctcgtgatctgcccgcctcggcctcccaaagtgctgggattacaggtgtgagccatcacacccagctaagttataatttttaactatataccaaatactagatctttatcagatatataatctctaagtattttctcccaggctttggattctcttttcggtgttttgatgatatcctttgaggcatggaagttttagttttgatgaagtccaatttattttttcttttgttgcctgtgcttttggtgtctaatctaagaaatcattgcctaagagccgggcgccgtggctcacgcctgtaatcccagaactttgggatgccaagacaggcagatcacgaggtcaagagatcaagaccatcctggccaacatggtgaaactctgtctctattaaaaatacaaaaattagctgggtgtggtggtgggtgcctgtagtaccagctactcgggaggcggaggttgcagtaagctgagatcgtaccactgcactccagcctggcgacagagcaagactctgtctaaaaaaaaaaaaaaaaaaaaaaagtattgcctaatccaaggtcatgaagattaatgcctatgtttcttctaagagttttatagttttagttcttgcagttacagagtttgcattgttagggaaatagttcaatcttgagtacctgataaaccaacataatttagaatatagtgagattaaaggggactaaccttcaccctatttatttgtttaacctgtaaatctaggcagactaagtcttactacttttcttgtagatgtttttcaactgtaaattgtattttgcttaaagtatttttgttgttgttgtttttagagatggggccttgccatgttgtccaggctagtctcaaacccctgggctcaagtgatccgcctgcttcagcctcccaaagtgttgggattatgggtgtgagccatggtgcccagcctgcataaagtaatatatttccctggtttcaatttttcagaaaaagaaaaattctgagcttttttttttttttttttaaagaagagggaaggattctgagtgactagcagattgattatatagcctgccttttaagaagaacagttacagaaacttggcagggaattattaggttgattcaattactgtttcttgagcacccattccaagccagatactgttttaagctgtgaggatatgaccatagatcaataacaggaatgctagccacaaggttaggctaatgattgtgttatctaaacaagaaatgcatattgtgtattctgttgtctattaacaatgattcttgtgttcgtgcatgactcttttcattaaagatttacttgaattgtcagaatagaaaatagtatttacccaaaatacatgagataaaatttttttaaaaaataagcatagcaggctgggcatagtgtctcatgcctgtaattccagcactttgggaggctgtggcgggtggatcaagaggtgagaagttcaagaccagcctggccaagatgctgaaaccctgtctctactaaaaatacaaaaattagctgggtgtggtggcactttcctgtaatctcagctactcgggaggctgaggcaggagaatcgcttgaacccggcagcagaggttgcagtgagctgagattgcgccactgcactccagcctgggtgacagagtgagactccgtcttaaaaaaaaaggctgggcgcagtatctcatgcctgtaatcccagcactttgggaggccgaggtgagtggatcatctgagttcaggagttcaagaccagcctggccaacatggcgaaaccctgtctctattaaaaatacaaaattagccgggcgtggtggtgcatgcctgtaatcccagctactcgggaggctgaggcaggagaatcgcttgaatccaggaggcagaggttgcagtgagtcgagatcgagccattgcactccagcctgggcaacaagagtgaaactctgtctcaaaaaggaaaaaaaaaaaagtattgcaaaatggtctagtaacatttaaatctccagagtatgttgtaattttgaagaaactatgactaaatttattttattatttttatttatttttatttttttgagatggagtcttgctctgtcacccaggctggagtgcagtggcatgatcttggctcattgcaacctccgcctccggagttcaagcaattctcctgcctcagccgcctgagtagcggggattacaggcacgtgccaccacgtctggctaatttatgtatttttagtagaggcggggtttcaccatgttggccaggatggtctcaatctcctgacctcctgatccgactacttggcctccctaagtgctgggattacaggcatgagccaccgcacccggctgactgtatttaaaagtattagttatggacccttacatactacttgagtcaacttttatatagcacttgaaccaacatctcttcatcataatctgttgcaagatattttagattttcttggattggatttcttttttcttttttaatttaataaacttaattttcctagagcagttttaggttcatggatttctttttatgaacaaccatttcccaacatgttatttggactcttacaaatacttctgaacaaagccaggcatggtagcatgcacctgttatatgatttggctatgtctccacccaaatctcatcttgaattgtagctcccataattcccacatgttgtaggaggaacttggtgggagataattgaatcctgggggcagtttccctcatactgttcttgtggtagtgaagaagtcttacaagatctgatggttttataagaggtttcccctttcacttctctcattctctcttgcccaccgccatgtaagacgtgccttttaccttctgccatgattgtgaggcctcccaagccacgtggaactgtgagtccattaaacctctttttcattataaattacccagttttgggtatgtctttatcagtagcatgaaaacagactaatacaacctgtaatcccagcacttcaggaggctgaggcgggagaatcacttgagcccaggagtacgagaccagcctaggcaacatagcgagaccccatctctacagaagatcaaaaacattagctggatgtgatggcatgcacctgtggttccagcttctcagaaggctgaggcaggaggattgcttgagcccaggaattcgaggctgcagtgaggtgtgatcatgccactgcactccagcctggacaacagtctcaaaaaccaaaaccaaaaccaaaccaaaacaaacaaacaaacaaaaagaaacaaaaactggggtgggtaattggcactactatccaccaaattgctcaaaccaaaaaccaaggattccagccagccacaattactctttctcactactcctatatccagtagactgacaagttttcttggttttaaccccagtagactgacaagttttcttggttttaaccccagtagactgacaagttttcttggttttaaccccccaaaatatcccatagtctagtcacttctttccatttccattaacatcatctctcaccaaaactcctaagtggtctccttgcttttttcatgcttgcctcaataacttccctttacacttagaataaaatccaagttcctcgtcgtggattatagtaactctcattatctggtctttgcctctcttttcaacctcatctggttttttctcattgtctttcactgaattgtaggtacactaggatttttcctgcccctcaaacatgctgaatttgtgcctgcctccaaatcttcgtacttgctatttctttaatattcttccatcttcaaatggctggattattatcagcacctcaaaggtctttcttgattcttccaaagtaacctcattctgcctagtcacttctgtctgtattttcagttacatcaggattgccaagtctagcccaggaactagagatgagtttcaacatggcaatgcaaaactgtctttgcctggattgtctttttcaatatcaagttccttcatagtagttttttgtgaaaagagaccatgctgttgttgaccatttatcctagaatgatcagggagggaattctaaaagtctccatgactcatactttacacatacctttgtaacttccatttcaataaattaggttttcttttcagttatcactaataattggtgctgtgagacccccttgaggaggcagggacaacatagtataataactttccattaagaaaacaaaaggaggggccgggcatggtggctcacacctgtactgtaatcccagcactttgggagaccaaggagggtggatcacctgaggtcaggcgttcaagaccagcctgaccaacacggcgaaaccctgtctctactaaaaatacaaaaattagccaggcatggtggcgcgtgcctgtaatcccagctactagggagactgaggcaggagaatcgcttgaacccgggagccagaggttgagtgagcctagattgtgccactacagtccagcctgggtgacagagtagaaaaaaaaaaaaaagaaaaaggatatgaagtggaaagcttctaatgctgcattttctctctcattctctcttcccccacatacctacccataattcagtcctaatgcttttgttctttgttccttttgcagcttgcattttggattttcagtgttcataagctcctctaatagaagatgtatggggggaaaagcacatcattttagttaatcatgctagttcttcaaaattctgctccctatttctgtggataactgagaattggttaaaatggcttcagcagaatgaaaatttataatgtaatttaaaagaattatggctgacaccagcactgaatgctttcattcttatagcatgcttggggcattgaatagaaagtggtttggtgaaaacactgtagaatttgttttgattgccatctgttagttggttttactacagtgagagaaaaatagaggcacaagtattggtcattaaaggtcatttggtaaagtgtttacttgacagtaagttcttattttttctgccactcaagttattttatttctttctgttgatttacataacctcttgtaaaagtttcaataccataaagcacctaagatacaataaactatgctcagtatttttgtgtgtatataatcccgggtgtattttttttttttttttgccccaactgtagaaatgtgagtttctcgatccccatgcttgaaattatgtttcaataacgttaaagtgggaaggaaacttagaaataccctattatgtttacaataggaaatgttaaatattgaagtagaatttttatcatacctccttgacttttaaatactcttttccatataattgtttctcccgtttaaagactctctcttaacatctggctttagaggtagaatgtcttgtcccttatgtcccaaaacttgggtgtcttattcacacttgggtgtccttctttgaagaacatactgtcttcatgtctgctctgagaagctgtttgaggaatttttttttctttttcaaatatatatatgaggagcagcatattagagtttttatgcatggattgaaagtggagggatgggattactactagaggcaggtatgcttacattagggagaagagagagactgctgtccaggttgaaagaaaaatgctgccataagaagtcaaaaagtccttcacttcccttgtaagttgtattcctaggtattttactctctttgtagcaattatgaatgagagttcactcatgatttggctctctgtttgtctattattggtgtacaagaatgcaacccaaatgctcatcagtgatagactggataaagaaaatgtggcatatatacaccatggaatactatacagtcataaaaaaggatgagttcatgtcctttgcagggacattgggaaagctggaaaccatcattctcagcaaactaacacaggaacagaaaaccaaacacctcatgtcctcactcataagtacaagttgaacagtgagaacacatggacacagggaggggagcatcacacaccagggcctgtcgggggatgaggggctaggggagggatagcattaagagaaatacctaatgtagatgacgggttggtgggtgcagcaaaccaccatggcacatgtatacctatgtaacaaacctgcacgtttggcacgtgtatcccagaacttaaagtataattaattaatttttttttaaaaagtcaaaaagtgcaaccttctggatccagctcagccttccagcaaacagctcagtagcctcaacagccattactgtattaaagaaagtagcatccaatatataatcttcaaaattataaagaaagtcttaaactatgactagtatatcctatttcaaaagataggcaaattgtgatttcttttttgaaaatttataattgtaaagaaaatcgtaaattgtaactatctgcataattaagaaggcaagaaaatcataatgcttttcagaaagttcctctcacacatgattttaagttttatttatcttgaaattcatttatatgaaacttatatttgaacagtgttcagataaatgtggtattagcatatgcagtgttttattatataaaatattttaattatagatattagaaaacattaactaggccatactcttttatgccatacgtgggaatgtaagttaattcagctttatggagtctgtttggtactgtatctattcaaaatatacagtgatgtatcagttccactttcagaaatctgttctgcagaaatatttgcacaggtacataaagatacataattttcattgtatctctgtaatagcaaaaaattggaaattatacagaagccaactgagtactggaggtgagtttactgacatagaaaggtacccatgatacatgaaaaagacaagttgaaaacaaaatatacaggatgatcccattttttgaaaataaaaaaaaaattactgtgtgtgtttttatgtatattcagggaaaaaagcctggaagtagaaattctccactgaccagtcacttcttcctttatatagttatgtatttttacaaatactttttctagttctttttaaaaactcacacatattttaaagataagaaactaaaataaatctttaatggtataaacttaaacactaatgtttctgctcttctgcagaatattaattttcaaacttgagtttgagaaactcaaaaacaagcaattttagaagtcagataggtcttttaatgattcttagggtagaaatctatttttttaactatatatgtgaaacttaggaaactggaacttagttctaagagtgatatacttctttcattttcaaaaaagaagcttctcatgttttcataaccaacagttatgttatcaaggagttactttagtattataatagtttaaattacctagttatgactttaagaaacatatgttaaggagtccaaggagaatgtataaattgggaaaaacctcagacttaaagtaattatatgtaatatcaaagcaatgtaattgtaagcttctccctagggaatctgaaatatcccccaataaatatcatccaaacaagtcactgttaatgtggattcttggaagaagatctaaaaataaataagtcaatagaaattataaacttgggctgtgaatcttaaaacaactaatcagttagcagcatttaagtgctatttcaggccaggcatggtggctcatacctgtaatcccaacactttgggaggccgaggtgggaggaccacttgagcccaggagttagagaccggcctgggcaacatagtgagacccccctgccccctgccatgtctacgaaaaataaatttttaaaaataagctgggtatggtagcacacacctgtagtcccaccaactcaggaggctgaggtggggggaggatcacttgagccctggagatctaggctgcagtgagccgtgattgcgctgttgcactccatcctgggtaacagagtgagaccctgtctcagaaaataaatattttcatcacatggggaaaagtaaatctaatcatgactccttagttttaaggagttactgctgggtagtcaagggtgatataagtgacttgaggaaacaaatttgcattagtggatgccaatccagaattcactaaagaacacaaaagaatggttcttgggtttttttcttactattcatttttcatgacatggcaactcagggaagtcatattgccctaggtcaaacagtgccaggctgactacttccttttgtcatgtatcacttcacccactcctgccttgacatgtgttaagagttatgttttgtcatgtgactgctgggatcgtctgcatcactcagaattattcttaccaactgctaatgaagttaatgatcaactgtcaggtgggtttttagtgaagtgatcaagggcataactagcaagatgaatggagccaggcaaaatttctatagtgatttggcttcatagtcctttcttttcaaatgtcccagaaaggaacattctgcatagtgtttgaaacaagatttccccaattgttgtagaagtcaagtgatccagtgtctttgaacagcattaaaaacactgtgttgccaagctcccatatcttttctctctctggcaaaatcctaatagcaagttgatttcccatcactgatgtgtcattgataatgtctgtgtgataaccatttagggtgtggtgagattgtctcgtgagtcattattgtgtatatcttgcttccatcacagtgttttaaaacactctcattgagagtgtggtaggaagaggccacttatgaaaatataatatccattttaacaagaaaagtttaaatatttgttgtcagtaaggtaaacagcaattgcagagtgagtagtaaatttacttaaactgtttataaagctatataaattattcttacctaattattacagtggtaacactttaatcataattttctggtaatgtttattttaaaacagcatttttttccttttaaaattgtttctgtttcacaattttcactaatataaaggctgatttttatcccagtcaaatacgattaagatcagttgattaagatcagttcagatcttagatttcttttgcagtgatttagacatggctttttttctagatagtattaggaagggtatattgttccttagagtattcactctgccaactcaagtggatactccttattggtatattatttctaccccattttgtcttatgaaagatgtaagatggttataatatatgtgatacagaaaataaaataaatttaaaataagttaaaataaagttaatgtaaaaagggtacaaagggaaaataagcttagggaaataaaaggtttaaggttggtgcacaaaatgcatatggtgaagtgctctattaatttggctgtaaattctgtcagcaaacctgaagatgataacatgatcacttaagagcaggggctcatgcttttatctgcttgcacatcatttgtaagtacctcacattctcatcataaacatttctctttcctaaagagattctcaaaggaggtaggctaagagcagtagcagaagggagaaatcagagctttggagaatggggaaatttgaaggaacacccaattctggtatatcttccaaaggagctatttccactataagactcattcatttataggcttcacataattcataagattaaatagaaacaaattgttcagagaatgttccattattcctaatattgaaaccaaagggatttttcctgtgaaccctcagagggcagggccatgtgggcactctgagtactattcacaacattcttgttacgaaccggtgaatggattgtgtaagcatcagcagtaaaggagtcaggagaacagtgggtgagcttgagagaggcttctgaaagtactaaacaggcctcaatacctcagcaataactaatgctaggaagttggtgagaagactaaataggaggactcctgccctttgactcttggaaaataaatttttaagctgattttttcacttcagatccatggtaatccacagcagggctagaccttgttttaaaattttataattataatttcatttcagttctttaaaagtttggttacaaaaagaagcatatgtccctaatattactgctgtgtagtaagcactctgaagaggtacttatgtaagttctagtatcagaattgccttcgatgtctgttaaataattatagtgagggctgggcgcagtggctcacgcctgtaatcccagcactttgggaggctgagcgggcagatcacgaggtcaagagattgagaccatcctggccaacatggtgaaaccccgtctctactaaaaatacaaaaattaggccgggcgtggtggcttacgcctgtaatcccagcactttgggaggccgaggcaggtggatcacctgatgtcaggagtttgagaccagcctgaccaacatggcgaaaccctgtttctactaaaaatacaaaaaattagctaggcctggtggcgggcacctgtaatcccagctactccggaggctgaggcaggagaattgcttgaacccgggaggcggaggctgcagtgagccgaaatcgtgccattgcactccagcctgggcaacaagagtgaaactcctttgaaaaaaaaaatacaaaaattagctggacatggtggtgcgtgcctgtagtcccagctactcgggaggctgaggcaggagaatcgcttgaacccggaaggcggatgttgcagtaagccgagattgcaccactgcactccagcctggcgagagagtgagactccatctaaaaaaaaaaaaaaaaaaaaaattatagtgagtacttgctatagtttgaatgtgtccactccacattcatgttgaaacttaattctcaatttcacagtattaagaagtgaggcctttaggaggtgattaggtcatgaggactctgccctcgtggatgggattagcacccttataaaagggcttgagggagtgagttcagctctttttgtccttctgttccttttgcctcactgtgtgaggacacagtgttcaaggtgccatcttggaagcagagacccaaggtcttcaccagatacagaacctgctggcatcttgatcttagaattcctagcctccagaactctgaagaaacaaatttctgttctttataaattacctagtttcaggtgttttgtgtgaacagactgagaccgtagtatttctttaatgtgaaaaaagaagcttgcaaagtcaacctgacatcatttagtttagtcagtcttacctagactataaataagtagaaattgcttatgcatgtaaagttacagaattaattgaaatggaaactttccaattataataggtctctctttctccatgttatgttatgaaagcctctgttatatcaggaaaaccccctgaaaattttctcatctgttgaggaaagagataacaggtaatcttattgggtttaagcttggaggataaatggaaacagccattcgtcttcaaatgaaccaaaataatcctgcaagataaaaatacagtattttaacagtattaatattttaccaaaagaacttgaaggtgaaaatcccaaaagccacgacaattccatgattgtgaaaatattaagtatgcaaaattttttgtttgtttgtttgtttttttcttttgagacagagtctcactctgttgcccaggctagagtgctgtggcacgatcttggctcactgcaacctccacctcccgggttcaagcaattctctgcctcagcctcccgagtagctggcattacaggcacccaccaccacgcccagctaatttttgtatttttagtagaggcagggttttactatcttggccaggctggtcttgaactcctgacctcgtgatctgcccaccttggcctccccaagtgctgggattacaggtgtgagccaccgcgcccggcctaagtatgcaaaattcttaattactctccagtattttgttttagcatctccatttcttatatctcatttaaactattttaaaattagtgttatattatttttattaataaaataattcttcaggaataattgacttttatgatatttacttatcccatctgagaaaattatatatatgttatatatatagtagattttaaagtttttttacaataagacttttattttagaaaagttataaatttatagaaaagtttcaaagattagtagagttctcatataccccacacccagttttttctatcactaagatattagtatggtacatttgtcaaaattagtgaaccaatattgatatattgctattaactaaagtccatactttatttagatttgcttattgtccttgttctcttctggaatcccatccaggataccatattacatttaatcattttgtttttttaggcttcttgttcctatgacagtcactcagacttttcttcagttttgatgaagaaattgacaattttgagaataatggtcaaatattttgtagaatgtccctcaattgggatttttatgttgtgtttttcataattagactgcagttgtgggttttgggtaggaagaccacagaggcaaaatgccattctcgtcataccatatcaaaagtagatagtatcaacatgacttatcactgttgatgttaaccttgatcacctggctaaggaagttttgtcagctttctcaactgtaaagttactcttttttttccccttgccatactgtactcttcagaaggaagtcactatgtgcagccctcagttaaagagctggcgggaggagttatgtttcacttccttgagggcagagtatttacgtaaattatttggaattctccccatgaaattgtctgttctaccttatttacttatttatttatggtagtatggactcatggatatttatttttagtactttgggttataatctaatactgcttattttgctgctcacagtgttctacctttggccattgcaagctttttgttgctgtaggtgttttttgtttctttattatttttttttagtacttccttactctctggcactacaaaatgcctcattgtatacaaaattttatttatttatttatttatttatttagagactgagtctcactcttatcacccaggctggagtgcagtggtgcgatcttgcagtggtgcgatcttggctcactgcaacctccgcctcccagtttaagtgattctcatgcctcagcctcctgaatagctgggattgcaggtgtgcaccaccacatctggctaatttttgtatttttagtagagatggggtttcactgtgttggttaggctggtctcaaactcctgacctcagatgatctgcccacttgggcctcccaaggtgctgggattacaggcatgagtcaccgtgccccgccacaaaattattattatttttttttttttttgagacagagtctcgacctgtcacccaggctggagtgcagtggtgtgatctcggctcactgcaagctccacctcccaggttcacgccattctcctgcctcagcctcccgagtagctgggactacaggcgcccgccaccacgcccggctaactttttgtatttttagtagagacggggtttcaccatggtctcgatctcctgacctcgtgatccgctcgcctcagcctcccaagtgctgagattacaggcatgagccaccacgcctggcctcacaaaattattttttaaaagctaaaaaacatgataattaggtaggttcttccaatcatctttgaaagaaaaatgctgttcctgttttttattattgagggcaactaaaggaaatgtgtttctgccacttggtgtcacaattttgcccagtcaccttatgattttttttcaggggttaatcttatttgtgggttgtctttttggaggattagcatgtatttttgatttttgtttttgtgtttccttagcagtggagtaggaagggcacagataaaaggagaagtttaagcaattagtataaacttatttagagcagctctcctattactgtctcatgcgatcaaaaggtggttttttgtttagttggttagtttggtttttttattttttagagacagggcctccttctatcacccaggctggagtatagtggcaggattatagctcactgcagccttgaactcctggactcaagcagtccttccgcctcagcctcctgagtagctaggacaacaggcatgtgccgccacacctggctaattaaaaaaaaatttttttgtagagatggagacttgccatgttgcccaggctggtcttgaactcctggcctcaagcaatcccctcaccttagcctcccaaagtgctgggattacaggtgtgagccagggcacttggcctgaaaagtggttgttaaaactcaattgatagcaccagttacctccaaaggagaagtttaaataaaatgttggtttttgatattatgtatttgtgtagtgttaaatttttttaataagaaggtttttttaaaataatctggaaaataataaaggtttatttttaaagttactggaaatgcaaagaaaagaacttaccctttctgtggtttgaaatactttagaacttgagaacttttttccatacttgatgcactcaaaagttttgattattttgcattaattttgtttggctgtacctgtttttcactagttcagctgtactaatgaaattggcacttcagctcaattgtttttatttaattgcaatgatcactttagcatttgaagagtttgaggccagcctgggcaacatggcgaaaccccatctctacaaaaaatggaaaaattagccggtgtggtggtgggcttctgtattcccagctacttgggaggctggggtgggaggatcacttgaccccaggaagtggaggctgcagtgagccaagatcacaccactacactgcagcctgcacgacagagtgataccctgtctcaaaaaaattaaaattaaattaaaaatccagattttagtctaaagatattcttttgaggctgggcgcagtggctcatgcctgtaatcccagcactttgggaggccgaggcgggcggatcacaaggtcaggagatcgagaccatcctggctaacacagtgaaaccccgtctctactaaaaatacaaaaaatgagccgggcaaggtggcaggcgcctgtagtcccagctactcgggaagctgaggcaggtgaatggcatgaaccccagggggcggagcctgcagtgagctgagatcacgccactgcactccagcctgggcgacagcgagactccatctcgaaaaaaaagatattcttttgatagaaccaatcattttattattgcattgaggcaatgacaacaaaaattctcctttgaagataaagcaagaacatcctaaggttatttattggattggttcattaaattctgaaccactaagtatgtacatattgtatagttatcttgagctttgtatttcacatatggtatctgttacctcctttaatctggcaaccacaaaaaacttcctgtggaggaacactttgtattcttaggtaatactctgcttatttacctttctcctttaattttttttcttccactttaaaccgttgtcagaggtgatactcatgtcacatggtcatgttactggaaagtagtgttgggaaaatatttaagaaagaaatgagaaaaaaaaattctgcttgagaaagaaaataggtcaatgagaccacaaaacctaacatttaattttatgtgtcaagactcctgcctccctagtcacaaagttaccacttaagaatactgttcagtttctttaatgaatcacattctagttactttatgattttaatgtatacattttaagatattgctatgctacaaagttaccaaatttatttagcctgtcttcagtgaccacaactacattgatctgaacatcctaatcattttattcatcaaatattttttgagggcctccttgttttaaggccctgtactgggtgtttcagaagtacaaaggtgaaagaaacatagtctttatccttaagagttttatagtctcttgggggaaataagaaaaaaaaagataaatatctgtagcagaagacaatatcagcaacgtgttcattgtaccggtaactctatgtacaagaactgcaagtaacatttcttagatttctcagattttcttgtagttcagactagtctttctgtccagttgttcagaaatattaagcctttatggtatttccagttgacttattcataatggccccaacatcttttgctttttttgtttttcactaacatttattaagaatttcacgtgtaccagcaactgttttgagtactttatacacattatttcatttaatcctctcaacagtctaataaggtattatttttattttacaaatgtaaaaactgagggttagagaagtcaatgataaatcacccatgataaattcagagctagtaaatgtcagaattgggatgcaaacccggattttctatgccagaacctgagcttaatgatactattattttctctctttatgggctttgtcaacattcttcaacatctgctctattttttaaaaaaatatgcagtttttgttgttgttgttttgagatggagtctcgctctgttgcacaggctggagtacagtggcatgatctcggccctctgcaacctccacctccctggttcaagcagttcccctgcctcagcctcctgagtagctgggattacaggctaatgccaccatgcttagataatttttttgtattttattttttagtagagatgaggtttcaccatgttggccagactggtctcgaactcctgacctcaggcaatctgtccacctcggcctcccaaattgctgggattacaggcgtgaggcaccatgcctggcctacagttttaaatatagagacaaggtctcgctatgttacccaggctggtctcgaactcctgggctcaagcaatcctcccaccttggccttccatagtgttgagattaaaggcatgacccaccatacccagtgatatctgctctattaacagagaaaagcagtttcagaagtgaaagaaaagttattagtggtttttgtttgttttaattagatatttatatgtttttgaagtagaaagtttgcactatcaccatggtggcttcatacacacagttttttgtttgtttgttttttctcacacctctcagggatgaaaacgtggctaatttcttctcacccttcaggtctcaacttgggggttcctctccaggaagtcttccctaatctccatgctacccctgccaccaagtcctcttcagtctgtgcacttgacccctcctatgttctctctaagaagcttactataatctctgtcataccaccagtcacaccattgcagtgatctcagctccttgacaacagggtctgttatttgttttagaaatcgcaacatccagcatggtgtttggcatgtcataggtacaaaaaaaaatgttgaatgaatatttgacttgaagtgcattttcagacttgcagaatgtttggtgactccttttagtctgtgtttttgcaccaaacgtgacttgtgatagagtgctgcttatgacggacattgtcccttttgatcctctagtctttctggtgaagaaggtttgtttttcatatccctgaatccttgaggtcattagctgggagaggagtgagggaatgctgttagcgaattccctgagtgaggtggaggacactgttattctgcttccttcttcccatggtgagaatgtggccaggctttagagtttggaggaagataatcacgataacattaatccccagaaattatcagtagtagttcactgtttactggctgggacttctgttttaattactggccaggtctactctgttcaaacccatagctatttcatacagctttatattcccaccaaccagacccaggtttaaactttgtaattcgagatgatagatcattcctgtgttcacttctaacctgaaatcatcttcttctctaccataagtctatagactagcaacatcatcatatagcagaaggcaggagaactgcacaccatcccaccaccactatttattgactgggtgactataggtaagatagtgagcctctctgggccttaatcatctcctttctaaggtgggagtgctaagattttatgttcctgagaccatggggctaaactggattttttgtcaaggtccattccatttccatattaagatgcataatttatatgaaatattcatcatgttctaatgctcacttagaaggacgattagaagttttcttctctgtagggattatgcatgtatcatttctttgtaatttagcagtgttgaaatcttaacaaatgaacttattacattcagggttgtgattttaacccctacatttttctgcttttaagattattaatatcacatggaggcctctctttttaaatttttcttcccaaggtggctgtgtatcttttatttttttttctttaaggctaacagcctaatatgccaaacaaatgtatactgtcaggccatttacctggcgatgccggagccctctgggcacatgcatatatttatatcagtacatgagatacatgctgaaatgttattgcctacacgctttaactctttactctcaaaattcagttcttgaatgtaaaataaaaagaccttacaattctgctttattaaaggcttacttcctgaaggcagaaatcagacaaggaaagttaagaactgttgtaatcacaaaaaattaccttcttcaatattactacaaatacattgttgtcctattcaccatcaataaagaaactacaaagcatacaacatttttaaagaggagggtgtctgtaacaggtcttctaaccctgtcattcattcctttttctactattccatgttgctacagccttcctgtttccctttttatcaacattttatttaaaaatttttcaaaaatataacaaagtttaaagaatgtgttatagtgaacgcttaacacagctgtctccttagattctaccattaacattctattgtacttgctttcttgggtatctgtctatccctcaattcattcattaatccatgtgggtttttaaatgcatttcatagcatattgaagatgtctatatctatacctatttctcttttgatgagtttcatttttctgctaaaattgactgagctcaagtatgcaggcacaattacctcttcttactgacttatataagatgtaactggccgggcgcggtggctcacgcctgtaatcccagcactttgggaggccgaggcgggtggatcacaaggtcaggagttcaagaccagcctggccaatatggtgaaaccccgtctctcctaaaaatacaaaaattagctgggcatagtggtgtatgcctgtagtcccagctacttgggaggctgaggcagaagaatcgcttgaacctaggaggcagaggttgcagtgagccgagatcgtgctactgcactccagcctgggcaaaagagcaagactccatctcaaaaaaaaaaaaagactatagttaaagatgtaacccatatcactggccttatcagtactatgctgtcagcctgtgcaaagtggttttcatagagttgaccagtgacattctagattagcaccaatagaaatataatgtggttttagctgggcatagtggtgagcgcttgtagtcccagctactcctggggctgaaacaggagaatcccttgagcccaggagttcaaggcctgacggggcagactattattttagtgaagccccatctctaaaagtaataataatttctaaacattataaagacatataatgtaattttaaatgttctagtagccacaatttaaaaagttaaaattaacaggtcaaatagttttaaattttatttaagccagcacatccaaaatgctatcatttcaacatgtaacttaaaattattaatggccgggcatggtggctcacacctgtaatccctgcactttgggaggccgaggcaggcagctcatttgaggtcaggagttcgagaccagcctggccaacatggtgaaaacccgtctctactaaaaatacaaaaattaggccgggcatggtggctcacacctgtaatcccagtactttgggaggccaaggtgggtggatcacctgaggtcaggagttctagaccagcctggccaacatggtgaatgaaaccttgtctctactaaaaatacaaaaattagccaggcctggtggtatacgcctgtaatcccagctactcagcagtctgaggcacgagaatcacttgaatttgggaggcaatcacttgaacttgggaggcagaggttgcagtgagccgagattgcacaactgcactctagcctgggtgacagagtgagactttgtctcaaaaaataaaaataaaaataaataaaaatacaaatacaaaaattagccagacatgctcacttgaacccaggaggcagaggttgcagtgagccgagatcgtgccactgaaccccagcctcggcgacagagtgagactctgcctcaaaaaaaaaaaagttattaatgaaatactttaccgtctttattatagtaacttttatacaaatccagtacatctcaattctaattagccaccatactttaagagctcaatgatagtaatatgtagctagtggcttccacgttggacagcagttctagaccttcaaacataaggagtaccttcctcctcataaatttccatagtctgtctatactgacttagcagacaaatttcctaataagtgcaaaagaagtagtgatgttcatcacagcaagccctaattatactgtttcatgttaaggtcggttttaattttagtttccttgtcagaaagttcttaggattttttttcctttattcatttgtcttgatttctttttgttttgttttgttttttgagacagggtctcgctctgttgcccaggctggagtgcagtggctgcaacctctgcctcccaggttcaagcgattctcctgcctcagcctcctgagtagctgggattacaggccatgccaccacacctggctaatttttgcatttttggtagagatggagtttcaccaggttggccaggctgctcttaaactcctgacctcaggtgatccaccgtcctcggcctcccaaagtgctgggattacaggcgtgagccaccatgcctggcctctcttgatttcttgacatatgtgctcagttgagttacattccctctagcaatgttgggttattttattacttgtcttctatccttcctctagtttcataccccactaatatatcttctctgattttcactagagcactctctctaaatgagataagatctttaagtttctcttatcaaaataaaaaacacatgctggtgttaaaatattaatcagcacagaattgtaaaaattaaaattaacagtaaaattgttctgtatcctaattgtggttgtcattaaaatccataaaactgcacacatactcacaaatggaaaaaaaagaacttggttaagtattatgaattgaagtttttattttatttgactagaagaaggacctttggctgagttactggaaaaatattcctacctataaagtgcaaactcagtccccagtaattacttgtcaaaaaacatctatattcttcctttctccactaacaaaatggttaattttggatcatgaatatgtttcatcttattctctgctttgaattatattgcatccagaaaatgaatgaggtacaaagtcatataaaatatatctgacttcagatacatcttggttgttttttgtttttaacttttagtttgtagttaggagttttattcagcccatagaaaaagacttatacagggaagtcagcaggagtggcaagaatagctagtattctgacagtggcagaattttgcaggaagaggctcatgttgataagtatcagttatcttgaaaatcaacacatgcaactagctagaaatacctaagtcaccaaatttagatactagataaataaattaatttagatatcgggaatactaagatatgcctgctgggcttctggaaaagttttccttttcttcttttcttttgcccttttttttttttttttttttttttttttttttaagacaaagtccccttctgtttcctaggctggagtacagtagcatgaaatggctcactgctgccttgatctcccagactcaagctatcctcccacctcagcctcccaagtagctgagactacaggtgcatgctaccacacctggctagttttttaaaaattatttttttgtagagacacagggtcttactatgttgcccaggctggtcttaaactgctgggctcaagcgatccttccagctcagcctcccaaagtgttaagattatagatgcgagccaccacgcctggtcaaaacagttttctttagtaaagcaaattactacaggcctcatgctcctatcctattacatcataatgaacagtgatatacatatataggattggctcaggtaccatagtggaactggtgaacgttttttagtgggtaacactatagagatacttttaaagttttttcgtatattatctgttttattgtcttctcagcacttcttaaacatcttatttatttgtttttgtttactgacagcttcccacctctaaagcatgtaagttctgtgagaacagagacttggcctcttttatttactgctatattcccagcacctaagaccatgccttgtgtataatggctgctcagtaaatatttgcagaagaatgaatgattcttgtttttacagcttcatcaatagacagataactatcagccaagaagaagtatacgtatactgcagagatattgcaagtttggttccaaaccactgcaataaaaagtcacacaagttttttggtctcccagtgcatataaaagttacgtttatactatactgtagtctattatgtatgcaataacattatgtctaaaaataatgcacatacctaaattttaaaatactttattgctaaaaaatgcttaaatcatctgagccttcagggcatcctaatatttttttcttggaggatcttggcctcagtgttgatggctgctgatagggtggttgttgctgacagttggggtggctgtggcgatttcttaaagataacaatgaaatttgctgcattgattgactcttcctttcacaaaagatttctctgtagcacgcaatgctgtttgatagcattttacccatagtaggacttctttgatagtcagagtcaatcctcttaaaccctttcacttgctgtatcaactaaacttatggaatattccatatcctttgttatcatttcaacaacgttcacagcatcttcttcaggagtacattttgattctgtctcaagaaaccattttctttgtttctccataacaagcaactcctcataggttcaagttttattatgaggttacagcaattcagtcccatcttcaggctccccttctaattctagttctcttgctgtttccacatctgcagcaacttcctccactgaattttttaatcccaccaagccatccatgagtattggaatccacaccttccaaactcctgttactattggtattttgacctcctcccatgaatcatgaatgttcttgctggcatgtggaatagtgactcttttccagaaagttttcaattgattttgcttagatccatcagaggagtcactatggcagctatagccttatgaaatgtatttctgaaataataagatttgaaagtgtaaattactccttgagctatgggcttcagaatggatgttgtgttcacaggcatgaaaacagcattcatctccttgtatatctccataagagctcttgggtgactaggtgcattgtcaatgaacagtaatattttgaaaggaatctttctgagctcattttctgggcttaaaatactcagtaaatcatgctggaaacagatgtgccatcatccaggctttgttgttccgttgataaagcacaggcagggtagatttagcataattcttaagggccctaggatttttggactggtgagtgagcattggcttcaacttaaagacaacagctacattagcccttacaagagagtcagcctctcctttgaagctttgaagccaggcattgacttctcttctctagttatgaaagtcctagatggcatcttctaatagaaggcttttttgtctccattgccaatctgttgtttagtatagccacctttatcaatgatcttagctaggtcttcggaataactcactgcagcttctccatcagcacttgctacttcgtcttacacttttatgtcatggagatgcctactttctttaaacctcatgagccaacctctgccaacttccagcttttcttctgcagctttcttgcctctctcaaacttcatagaattgaagagagtttagggccttgctctggattacgttttggtgtaagggcatgttgtggctggttttgtcttctacccaggccacaaaaacttcatctcagcaataggctgttttgctttctttatcgtttgcgtgttcactggcataacactttaaatttccttcaagaacttttcctggttgggcacggtggctcattcctatagtcctagcttggaaagctggtgggaggatcacttcagcccaggagttcaaggctgcagtgagctgtgattgcacaactgcactccagtctgcagagtgagatcctgtctccttaaaaaaaataaaataaaaataaaggaaaaaaacctttttctttgcatacacaacttgggtaactggcacaaaaggcctagcttttgacctgtcttggctttcaacatgccctcctcactaatcatctgtagatttttatttaaggtaggaaatgtgcaactcttcctttcacttttgaacacttagtggtcatcacagggttaattggcctaattttgatattattatgtcttggggaaagggaagagagggagagagatggaagaacagctgatgggtggagcagtcagaacacacacaacatttatcgattagattctccatcttacgtgagtgtggttcatggcaccccaaaacaattacagtagtaacatccaagatcacagatcactatgacagatataataataatgaaaaattggaaatattgtgagaagtaccaaaatgtgacataaagacaagaagtgctgttggaaaaatggtactaatagacttgctaaacacaggactgccaccaatcttcaatttgtaaaaaatgaatatctgtaaagtaatgtgcaataaaataatgtatacctgtatcatattccctgtgcatctgcttagtacactttaaagactgttaatggtgatgatgataaaagccacacattctttattcatcacttgtcagaatgttcatttgtttattttagtgagtcatccttcaaataagaggaaaacagcatgttctttcaaagaatactgtctgggaagcaagggtacttctcagatctaggagcaggagaatgagaaaagctgaaatgacaagccctgtattatttttgaagaagagttgtattttttatgggtagccatttgtaaaccagcctaaataatgaaattgtaggagtttagaataatatcccagtacattaggtcaattatgtggtcagaagccccaaacaaatattgagtgtattctcatattacgattttgttttctgaagttaaatggaatgatttatatgcttatcttctgttgcatcttaaaaagatgtattattagtagacaaatgcagaggttgtgtggttatataagttatctattactctgacttcttaagcagcagggcaagaatggacatgtttttctaaaataagacttttctccatcttacatgggtgtggttcctggcaccccaaaacaaagctggggccgggtgtggtggctcacgcctataatctcaacactttgtgaggctgaggtgggtggatcatctgaggccaggagttcgagaccagcctggccaacatggcgaaactgcatctctactaaaaatacaaaaattatctgggtgtggtggtgcacacctgtaatcccagctacttgggtggctgaggcaagagaatcgcttgaacccaggaggcagaggtttcagtgagccgagatcgtgccactgcactccagcctgggcgacagagcgagactcccatctcaaaacaaaacaaaggtgggtgtcttgagtgccttttgagtataggccttcagactttctgaggattgggaaagcatttttttttaaccttaaaatatttattgaataaagaatggcaagatcagaaaaataagctctggttaggatttgatgtggggcttcattctcagctctgttgctacctccttttatgatcttcggtggtctcttttcctgttcaaaccccagtttccttatttataaggagataatgaggagaccagacttaatattctctaaagattctttcagctctaaaaacttaatgattcaagcaggttgcctgtgaagaacaatgcatttcttccaaaagagggtgctgtggtatttctcagtactttagcatcttcttgaaaggaactgaacaatggtagaatctcagcttaattttgtgtcttcagactcccaacctttgagaaatagtgtctaattccttcctttatttagatgaggcgatataaaccaattcctgatgttactgacacttaagtaagtttcaaagaaaaaaataaaaaatacacataattttaccaggcaaatatagacagttttgtcagatgtggtggctcccagcactgcaggaggatcacttgaggctggtaatttgaaaccagcctaagcaacaaagtgaccgtgactcaaaaaaaaaaattaaaaattatctgggaatggtggcgtctgcctatagtcctagctgttttgttggcttggaggcggaaggattgcttgagcccaggaattccaggtttcagtgagctatgattgagcaattatttcaccactgcactccagcccaggtgacagagtaagactctatctctctttttttttttcttggggggacagggtctcaccctgtcgcccagactagaatgcagtggcatgatctcggctcaccacagcctccacctcctgggttcaagcaattctcctgcctcagcctcctgagtagtttggattacaggtgcccaccaccacgcctggctaatttttgtatttttagtagagaccgggtttcaccacgttggccagcctggtcttgaactcctgacctcaaatgatccacctgcctcggcctcccaaagtgctgggattataggcatgagccaccgcacccaaccgtaagactctagctttaaatataaattacatatatgtatatatttatatttatatataatatataatatatttatataatacatttatattagagagagagaaggagagagagagatagttttaacattttgatgtattttcactcttattcaacttcttcccataaaattgagaaaatatataaattatgtgtgcgtgtgtgtcattttatttgtttttgtctttttcctttctgggttttttttgttgttgttgttgttttgacaaggtcttgttctgttgcccaggctggaatagagtggcatgatcacagcccactgcattctcaacctcctgggctcaagcaatcctcccgcctcagcccccaagtagctgggaccagaggcacgtgccaccacacctggctaatttttttatttttagtagagatgaggtctcactaggttgtccacactggtatatcacattttatttatccattcatcagttgagttgttcctactttttggctatcatgaataatactactgtatgaacatttttgtgcctgtttttgtgttgacatgtgtttttatttctctttagtatatatgtaggagtagaattgtcagttcatatagtaattcttctattaggtttttgagaaactgtcagacttttttctccaaagggctgtaccattctacattctcaccagcagtatataaaggatctaatttctccatatccttgctagcacttgttgttaactgtcttttttattatagtcgtactaataggtgtgaagtggtatcgtaagtgatttttgactcgtgtttctctgatggctaatgatgttgagcatcttttaatatgcttattagccatttgtgtatagtctatggagaaatgtccattcagatcctttgcctattttaaaattggattgattttcttttattattgaattgtaagagttctttatgcattttggatattaggtccttctcagatatatatttgcaaaattttccccccattctgtttttggcttcactttcttgaagatgacttttgaagcacaaaagtttttaattgtgatgatgtccaatctattttttttctttcataacttgtctttttggttttgtaccttaagaaaccattgtctagggtgggcgcagtggctcacgcctgtaatcccagcactttgggaggccaaggtgggcagatcacctgaggtcaggagttctagaccagccttgccaacatggtgaaaccccatctctactgaaaatacaaaaattaacctggcgtggtggcaggcacctgtaatcccagctatttgggaggctaaggcaggagaatcacttgaacctgggaggcaaaggttgaagtgaaccaagattgtgtcactgcactccggcctgggtgacagagcaagactctgtctcaaaaaaaaaaaaaaaaagaaaagaaaccattgtttaatccaaagtaacaatgatttacatctttttttctaggagttttatagttttacatttaggttttttttctctttgagttgatttttgtacttggtatgagtccaacttcactttttggtatatggatatctagttgtcctggcactatttgttgaaaagactatttttctcctacttgaattatcttggtacccttcttaaaaatgaattcaccataaatgtgaaggtttatttctggactctcaattttattccattgatctgtttgtctgtctttatgccagtaccacacagtcttaattagtgtagctttctagcaagttttgaagtcagaaagtgtgggccctccaattttgttccttttctaagttgttttggctattcttggtcccttgaatttccatgtgaattttagaatcagtttgtcaatttctacaaagaagccagcagagattttgatagaagttacattaaatctgaggtatgttgttttaatttgcatttaaaaaataaataatggggctaacttttttcaaatgtttgttaacagttttagtttcttctgcaaattcatatcatttctgtaagccaggaaatccctgacaccctcctgtcaagctaaaaaacaagaaacacaatagagctgggcatggtggctcatgcatgtaatctcagtactttgggaagccgaggtgggaggatcacttgagcctaggagttcgagaccagcctgggcaacatagtaagaccctgtctctacaaaaaaattaaaaaattggctgggtgtggtggtgtgcacttgtagtcccagctattatggatgctgaggtgggaggatcacttgagcccaggaggtcaaggctgcagtaagctgttcttgtgccactgcatagtagcctgggcaacagagcaagatcctgtctaaaaaaagaaaaaaaaaaaaaaaaaaccaacaacaaaacacaacagaacactgattgtacttttttttttttttttttttttgttgagacagagtcttgctctgttgcccaggctagaatgcagcggcgcgatctcagctcactgcaacttccgcctcctgagtttaagccattctcctgcctcagcctcccgagtagtttggattacaggtgccaccaccacgcctagccaatttttgtatgtttagtagagacggggtttcaccatgttgaccaggctggtcttgaactcctgacctcaagtgatccgcccaccttcgcctcccaaagtactgggattaaaggcatgagccaccacgcctggccaattgtacttttaagcactaaggagtttagagccccagatattctatgtggacgtcatgatgctcatgcttgtttgttttaataagactctagtacaaagggtcacattttcatagaagctacactttttcagttccaagagcgaataaagacaggcagccctctaatctataaaattgaaagtcgatggctcagggttagggccatttcttggtaatgttgagatggttgggctgctctagaacaaatatatacaggagaacttggaagtgttggccaccttcatggccttgaagaccttagctctgcacaccatgctgtgaccttactcctgtcctgtgatcagatagggcacgcccagccagtaaggttctccatacagtctgcgaccactggtgtttcccagtccactgcctgccaggaatgcgactgcagcagaggaaggcagtcaggaacatggtgcatgtggccgagccccttaggactctctgcatggtggaaacatgcccacctcagggtggggccttctgctgccttcctactcagattttctaagcccattctgtaaaattaatagcaagctaaaggtaggtgagataggcctatggagacattttttctacaaagggacatgcagcatttatgaaaactgttggcccacatgtgacagtgtttaggtcctgagtacttgaaaagtatttggtggccactcaaaaagcataccttgccccttacctgcatgatttggatttgctgtcattctctaagtgaccatgacatttgggggtgcctaatggcaccctacatgttggacacagcttcatgcattggttagagataggctggtactgagaaatttataacattgctagttaatttatactggcaaattcttgtatgcctacttaatatttgcttgtatcaaaatacacctctctattgtctagagagtagaggtgtcagtttctggaaacactgcagaaaaactttactagctttccatgtggtagcttcccacatggactctattttttgaattgtttgtttgtttgttttctgccaggcaggaaatggctagaaaaaagtttcttaaatttagaaggtcttaaagtctacttgtctaaattccctgccgccatcttctcacaactgctttctctgtgtgttgtctctttttgtctcaaaaggtcattggatttaatacccacatgggtagtctaggaggatctcatcttgagtccttaacttgattgtatttgaaaagatccttttcccaaataaggtcacattcacaagttctgggtgttaggacataaacatatatttttgaagttcacccttcaacccattataccaccatgtcccctatctcactttcctttctaccagattcactttacaacactccaaacaaggagtttcaggtttgtagtcatgacacattcgtcattttatgtcaatatatgctgtttatgaacaactctaaaggttaaaaattattcattctattgagctaaatctattctggtataatatttgagaacacattctagatctctcctgcacagttaataggggttaagaaagactagtcccatgattctcaggttgagggagaataacacatgcactgcctctccaccattctgacacggcattataggaggtgtaagatcctctctaacaccagccccgcaaaacctcagacttaatgaacagttcatgacattgtgagccagttgtgatggaaatgtaatgaatcccctccaggagggttgggagcaaacaaaaaagactgaggaacagcaatttcagtcttcctcatgatagccattcagatgaagacaactactatattttcctgagtctgttcttttccaagatcaacacctttaattttaattattccccatgacatggcttttattctattcattcagcaaatatttattgagggcctaatatgtgccaggcagtctagtaggtattagaatgatgcagggatgagtatactagaatccatgtcatctaagattataatctgggggaggatgtaaacaaataaattgcaagacactgtgataagtatttggataatgtttagtataggatctaagggagcacaagcagagattcctaagccagtgttaaagacctgaagatcaagaagagactggggaggcaggacagattcacattccaggcagagggagcagccagtacaaatgcccacaagttgtagtagatattagctgggtttctggcagcccagcatcctcatccatccacttcctgttttagagccttgcctcccataggggagaacgcaaggtggttccaggcaattgtgcaggactgggactagggtgaggagagtgagccacttgactcagctgtaacatttaaggggataccaaaaaacttataattaagataaagaatattttaatgcattgtttattaaaatcataattgatgcaaaaaaatccatgatgaataaaatatcaaaaccttaaagaaagacatgatcagtataattggttttcccttttgcctcaagctctaatatggcttggtatggcactgctgttgattctgtctttctttaaatttttctattgtatttcaacatggatttttttttggcattagttttgattttttgaaatattgtttgtcttgattggggagtttgttggtgctcctttaaattgtgtgccaaaaacgagtgccttagtcacctcaccctggctccagccctacaaccaggacataaacacaaaatctatgcttggccagttgtgctgtctcctggggctttgactctggagcataaatgtggttagagacatttcacagtggtggcagcagaagttagtatcctactatgacctggcctcccatggtcatgccccttttctgagcggttgttctggtattcaagaaccatattctcttcgtttttgaaaatcacagtcatgtttgtttatcttcagacttctattcttccctttctcccttctttacagataaccagtagtggttgtatattaatatatgcaagctttctttttggtatctgaggacaaaatttatccaggtgtagcaaaatgaattcatcggaagtaactatttttttcagtcacttcacttgtcttgtacttcttttcccatttaatctttctccaccatttccacctgaacgtaaccttgaagatttatttttagttgtcatttcttaatattatattcacctctccaaacacaaaaatactttctgttatctttagcttaagaagaataatagcagtcactgaacctgaacacatgaacaacagagattaaaggatgccagattcagaggtcctcactaaaagtaagcaccagaggcatccataaagaaaacaatgttcaccaagaaacaactggaagatttagagatgttattcattaagaacccatacccaaactccagtctttagaaagaatggcctcaaaaactgacatctctccaacagtactacagatttaattcaagaacctcagagcaaaactcaagaaatgaaaatacaaccatattcaataaaaacaacagaagactcaacaataacaattactttagggaagagtggagagaaatattggcacaccacctggatccactaccggtgccagccctgcctctccaatttctataaatcatctggcaccttcagtccaagttagcatgtcccagttttaaggtccacacagataactctgttagtcatagaatagcctattatggctactgccaaaaccataatatatactaccccttccccattttggactcccaagttctttgcccaagttctgattctttggtctcttcacctaggtagaacttaactggccgttctgaattgcaagagagaaaaacaataggtagccaaaaattatttacctcatgctgggcattacctttcctgatagtttactgagtttgtgccactcttcacatttatcctgtaataaatgaatctctacctgtttttgttttgttgcttctctccatttttccccatcagagtcagttatattataattttgtttttgaagccttaccttctgtctgtctggggttacactccctgttatagtttctggcttagaattacctatcctacctctgaatgcttgaaatttactctcttagggtcaaggttccaggcttcctttgctattacaacaccgaagctaactagcatactgtcttcttataaaactcttgtcaccccacatcacttacagtttccttcttgtcagtcattatagtcttggatagaagttctctttgttgttttctccactttctgagaaatgaaattgtcaatgtggtatcaccttatcaggtgctcttttttttttttttaccagaatgaaacctctccccaatgctgggagaggtgacgtttcccgttactactgtatattgtgtctatatctgttttgtaatctgtattaggaaatcatcactatatcaaccacaagagtatcactagaatagaacatactttactaatgtcgtgagccgtagtgacacttgcctccttgtattaaccttctaagtgtactttttagactttaactttttttttttttttttttttgagatggagtctcactctctcgcccaggctggagtgcagtggtgtgatctcggctcactgcaacctctgcctcccaggttcaagcaattcccctgcctcagcctcccaagtagctgggattacaggtgcgcgccactgcgcccagctaattttttgtatttttagtagagacggggtttcactgtgttagccaggatggtcttgaactcctgacctcgtgatccgcctgcctcagcctcccaaagtgctgggattacagacgtgagccactgcacctggcctagactttaacttctaagtgtacattgttcagattccagagattgttattaggaatgaggctagtagcttattttccatctacttgagtctttgctgataaattattggaagactctactactaaataataattttaggtatcataccagcacctctagtacctctgtatgggagttctgctcagttttagataatcttatgagatttcaaactctatcccatcactggctttaatgctgtcatatatctaataagggaagtgatatattcctttctttctctctcatttccttaaaggcatggcagacctggaggagatgaacacttaaggaacctgagcaagtggcatactgtttatcttttagctagcattgtaaagccagagatatgaatcataggggaaagaaaggacagaaaaagaacagtgcttcttcaaaaatagaaaacttttttttatttccacctagtgtcatcataatactatatatatctagagatattctctatcataggagccaaaatttgtcttaaatcagataagtatctaagttatcaaggacagattttatttagcaaatattcatttagaacttgctgtgggatatatgttcaaagtgctttatgaacagtaatttattgaatactcatagcaagtggaatctcctatcagatgggaactactaccagttcccattttactaatggatgaggaaagtgaggcttagagaggctaagtaacatccctaaggtctcacagctagtaatgggggagagctggaatttgaattcaagaaacctggcaccagagtctatgccttaaacactaattatgcagcctctccaatatattttcttcctaaagttccaatagagaataatgatacaactcatactagaaaatacctaatgagcataaaatactgtttttgtttaaaacaactaattaaggactttgtcagacgtgtaacactttaaccttcttagttataacttggccaaaagctgcttagttaaaacaatgttccttccacattattattgtctgcctggcctcccacctatttcctaggattcaaattagacagttggtgtctagctcttgtttgtgtatatttgacaatgaactccttttttttttggtcacatgtgttctgggattgtggaaagtttattgattgtgtccagggttagacgaatgatgtcctttaatctaatctcttttaccttaattatagttctgacctgctaattatttctacctatccatgttcacatccaatcttctcttccatgtaagtgttgctagtatcagaaatttttttccatgtttgcataggttttattttattctttcctaaatgtattaatctttattgtttcaagaggaactttattatagttaatatagtatgacttaccacatacatgtatttactaggacttctgaatacatttactgagaacttgaatactttggtgtaggagatttttctcctgtaatgaaggaagccccaagaaactaaatcaataaacaaaaagctaagaattctgtttaatacctgcttttctacccaacacttggtgtatttttttttcttttttttaagatggagttttgctcttgtcgcccaggctggagtgcagtggtgcgatctcggctcactacaacctctgcctcccaggttcaagcgattctcctgcctcagcctcccgagtagctgggattacaggtgtccaccaccatgctcagctaatttttgtatttttagtagagatggggtttcaccatggtgaccaggctggtctcgaactcctgagctcaggtgatccacccaccttggcctcccaaagtgctgggattacaggcatgagccaccgcgcctggcccacttggtgtattttaaaatgtgtttatgctttcttttttggtagccatgacatctccctggcaactgtacaacctgtctaatctataaattatagtgaagagtagaaaacagcttagggctgggcacagtggctcacacctgtaagcccagcactttgtgaggccaagacaggcagattgcttgagcttaggagttcaagaccagcctgggcaacataacgaaaccccatctttaaaaaataaaataaaataaataaacaaatgagaaaagagcttaagaagcatagctcctaaatcacttgcctctagcctaaccaaagctgtaactctaagttttcactagacttctggtgacctagtgatacctgttattactctcataaaaccaccagcttaagtatgtatattttactatagttggtatagattctagctttcctagtctgtgaaatatttaacaaagaccctctgttgttaatatttgtgccatgatgtttctcaaattaactatttggtgttagccatgtaagctttcaaatacaaacattcaatattcattaaatctttaactcctcatcatgtgccaggctctgtgctagatactatgacagatgcaaagatgaataaaatgtagtcccttcctttgtttaggggtttataatcccacagatacctaaatcattaatatgtagaatatttacaagggctgtaagaaatgtttaggcaaagagctaaaacatccacaggctaaggaaaactacttttagctaaggagggatcaaataattatgtggaaattggcatttaatctggatcttggcaggttagactttgataatcagatttggagagtggaaaaggggctgactccactgttcagacaacaacgctgtttagacagcaccacataataaagtagtactttggagataggcagtgatgggttggggggagtaataaatattgcctaactttgttctattaccaaacttgtggcaactttactgtgacgagatttgaggagaaagataaaatttaatacccaattgaaaatagatggttaaacaaacaagcaaaaattattattattatttcattattttttgagacacgatctctctgtatcatccaggctggagtgcagtggtgcaatcatggctcactgcagcctcaaactcccaggctcaggtgatcctcccacttcagcctcccaagtaactgggcctagagacatgcactaacacacctggctaatttttgtatattttgaagagacagggtttcaccatgttccccatggctagtcttgaactcctaagctcaagcgatccacccgcctctgtctcccaaagttctgggatacaggcgtgagccaccgtgcctggccccaagaaaaattcttaccgtccttgtgatattggtggattttggttatctctaaaatcagatttcttccttttgattataagaaacagttttaatggattccacttattttccttaaaagttatgttagccaggcgcggtggctcatgcctgtaatcccagcactttgggaggccgaggtgggtggatcacgaggtcaggagatgaagaccatcctggccaacatggtgaaaccccgtctctactaaaaatacaaaaaatttagtcgggcgtggtggcaggcgcctgtagtcccagctacttgggaggctgaggcaggagaatggcgagaacgtgggaggcagagcttgcagtgagctgagatcgcaccactgcactccagcctgggtgacagagcgagactctgtctcaaaaaaaaaaaagttatgttatgacaatacaacacattggcataatgtccccttagaagcatggaaatcatctgtgctttccttcattcaggtttctccagcttgcacctataaatctgaaccagtcctttagcttttaatgttcttcttcctcttccatcctggtctatccttacataagagaactcccaccaaaaatatccttacttctcccagggactctctacttctcagagagtcccagtttatatcttacagcaaaatgaaataaataggaatttgggcatattttaaactttttttaaaattttagtttaaaattataatttttttctttattgttcacagttaagtaacaagtaatttttttttgcacaagcccgcagaaatacgtaacaggtaatttaaagacttaaatcagccgggcgcagtggctcatgcctgtaatcccagcactttgggaggccgaggtcggtggatcacaaggtcaggagttcgagaccagcctggccaatatggtgaaatcccatctttactaaaaatacaaaaattagccgggcgtggtggcacacgcctgtagtcccagctacttgggaggctgaggcagaagaatcgcttgaacccaggaagtggaggttgcagtgagccaagatcgcgccactgcactccagcctgggcgatagagcaagactccgtctcaaaataaataaataaatgaagacttaaaatcataagtgctagctttacaatattaatttttaaaagataatagccagccattgagcattattgccttcccttgtgtgtgaaaaaagaaaacataacatgtaactctgaataaatatagagttaaaaaaataatttcaacttctgttttagattctggggctacatgtacagatttgttacacagatatattgcacgatgctgaggtttggattacgaatgatcccctcacccaggtagtgaacatagtacccaatagttagtgttttcaacccttgccttcctccctccatctccccgctagtagtcccagtgtccgttgttgccatctttatatccatgagtacccaatgtttatctcatacttgtaagtgagaacatgcagtatttagctttctgttcctgtgttaatttgcataggataatcgcctccggctgcatccatgttgctgcgaaggacatgattttgttcttttctgtggccacatagtattccatggtgcatatgtaccacattttctttatccagtccaccattgatgggcatctaggttgagtccatgtctctgctattgtgaataatgttgcgatgaacatatgagtgcatgtgtctttttggtaaaatgattttatttttaatatatacccagtaatgggattgctgggttgaatggtagttctaagttatttgaaaaatctccaaactgctttccatggtgactgaaccaatctatattcccaccaacagtgtatgagccttcccttttctccacagccttgccagcatctgttttttactttttaacaatatccattctgactggtatgagatgggatctcattatggttttgatttatagttctctgatgattagcgatattgagcattttttcatgtttgttgtccacttgtatgtcttcttttgagaagtgtctattcatgtcttttgcccactttgtaatgggactatttgttttttgcttattaaattgcttaagctccttatagattcctggatattagatttttgttggatgcgtagtttgcgattattttctcctatttgtaggttatctatttcttctgttaatagtttcttttgttgtgcagaagctctttagtttaattaggtcccacttgttgatttttgtttttattgcagttgcttttgaggacttagtcataaattctttctgaaggccgacgtccagaatggtgtttactaggttttcttttaggatttctatagtttgaggttttatgtttaaatctttaatccatcttgacttaatttttgtatatggtgaaaggtaaaggtccagtttcattctcctgctatgactggccagctatcccggcaccatttattgaatagggagtcttttccccattaatgctggtattttaaaagggcatgaagatgttggcctatagtatgccaaccttttcatttcagttactccccacccctcataaaatactttgtttacattatgccctgtagatggcagtacttatatgaaaaatgtaagtttagaaagagctttgagaatgattagcaggtggggtctttaatgagaaaggcttaattgacatgttctttgtcaatttttttcattcactggatttttttcaaacaatcacaagctttctttatcactcatgatgtttccattgagttttctttcaccatcgcctgacctccctagaccccacttttgtttcagaaatcacatgttacacaatcattttctctttagagggcagtgattagaaactagttgattacatatatgataggatcctgtgtaaacttctgggtacatattttttttctcaagaagctcgagtgccagccagatgtcattactgtaaattcttttttttttttttttttttgagaccaagtatcactctgtggcccaggctggagtgcagtggtgcaatctctgctcactgcaacctctgcctcccaggttcaagcaattctcctgcctcagcctctctagtggctgggattacaggtatgcgccataactcctggctcatttttgtatttttagtagaaacgggtttcgccatgttgcccaggctggtctctaactcctggactcaagcaatccacccgccttggcctcccaaggtattgggattacaggcgtgagccaccacgcccaacccattactgtaaattctgatagagatggggaaagcagtatcacatagctttcaaatatgatttcattacaaatctacagttatagggtcaatcaagtatatctttgagcgggagaaagtaactcattcaggaatatgaaaagctgtcttgttctccctaaacattggggattttgactgtgggattcatttagtaagtattcatcgagtacttatatgttaggcactgtgctgggtaggtatcctgcattacaattatgaaaggacatagtccgtactctcagatatgccttttcaagttagtgaaacctggtgattcttgtgaaagaggtatgtggaagatacggtaaaagcacagaataggaatagatggttatggcagatattaccaattaattacaacacacttttcttccaagtctgctggtctcaaactcctccacaacacttgagaagctggtattgttcaatcaaagaagacatgcaagaagcctgttgcctaaacatggcatggtgggagtagtgcctaagatactactgagaaatgttatgcagtatgccaccaactgtgtaaagacaggaaaagagaacacacacacacacacacacacacacacacacacacacacacacttgcttgttgatgtctagtctctagaaggctactgaagaaatggataatactggttgcctctcgggagaacagctaggtggctgggggatggagtgggagagaaactttttattgaatatcatttggtttcttttggagtttgagccatgtgaatttattacccatacaaaaatgaagttcaaggtttactaccttacatcacattaccatgtctgaggagaatatataccagttgtcttttatttggtgggttttttaatctactaaactcctaatcatatactaaatagaataaaagtattgccaaggatcatttaagtatcttgtaacactttttgttttggttatgggaaattaccagtttttatttttcacgcttctcaactagtatatcctgataaaccttgagtggctgagagtggaagtggttcctcccacaaaagccaactatagatttttttttatgtacagcaaagagctatgtgtttttgtatttgtttggctttgttgttttaatggaaattatacatgagctatgccagataatcctggcagaaaacagattgtgaacagaaaacatatggttagtaagtccatttgcattgctcagaatttagagcaaattaacatatttccttgttgagatgaattggagtagtcatagtaggacagatagaggcgccaactctcttgaaataaatttttatagctgaaatttaaaaatactgggaatgtgaaaggaaagtccttagaatcagccataccccaggggtccttagaaatttgatatgtgtttatggatcacgtaaagatgatgttgagggttgtaaagtataggtttattcaatctaaggaactttaggtctagttgaaacctgataaataaaacagaatgaaagtcacatatacacaaggaattgcataagttatgaactttattatatacatgcatacttgctaaagcacaatatatagtcagtagacatcaaatggctggttaatctttatgaactctgtttctgttaattggataagaaaaacagcttataccatggtagcatataacagtttacagatcacttctgcagtgtttatctcacttaatcataggttcaagattttattaatatttggggagatggtttatatcataatgaaaatcatatcttttattctgacttccatccccctgtttggtatggccatgcagattttttttttttttcattttggagtttttttgagacagggtctcactttgtcacccaggctggagtgcagtgacacaaacatagcttactgcagcctcagactcctggcctcaagcagtcctctcacctcagcttcccaagtagctgggattataggcatgcgccaccatgcctagctaatgtaaaaaaaaaaaatttttgtagagatggggtctcactgtgttgcccaggttagtttctaactcctggcctcaagcagttctcctgcctcaacccatgtagaagtttttgatagaaaaacagcaattatgtaaacttttcttgacatacttagcctgccaattaagaagaaaacctccatctctgctaacgtggtgtttccacccctttttattacttaatttttgcttggcccatagtaagtccttgccagagcatggtaaaatctggcaacgtcccaaactgtttctaccattccttctccttcctctttttttttgagacagaatctttcttcgttgccaggctggagtgcagtggcatgatcttggctcactgcaacctccacctcccaggttcaagtgattctcctgcctcagcctcctgagtagctgggactacagatgcatgccaccacgaccggctaatttttttgtatttttagtagaggcggggtttcaccatgttagccaggatggtcttggtctcctgacctcatgatctgcccgcctcagcctaccaaagtgctgggattgcaggcatgagccactgcgcccagccctccttcctcttttacaacaggtaggagttccattccaaggttctggatttttggactcattctcttaatctctttcagttttaagaaatccatctctcttctgtgctctcaaacttcagtttccccttttcttttcattcgtcaacccattcggcaaatacttattgatcatcataagcatcaggccctgttttttgcgccagggatacaccaatgaattaagtagagaaaactcccttcactcatggagctaacattgtttctgataggtacttaccatcggctacggcattgcataactctagagtattatttttctacatctctcttcctaataaatatatgaattgtaactttgtctctagaattgttgtagagacaatgaatattgcctctagagttgttcagtgcacagccagcttagttctatacagtagtcttatctactgtgcttaattaggatgtctgtcaaaactaatttcctatagtaaaatcagtcagcttccacattctaacaattgccaacgtgcaatcccttcgtttaagaaaagcatgcagtcctctccatggtgcaagggtggaagaggattttgtggagaaatcatcctttgtatttcctcagattacctgtgttaggccaccctaaaatttgcttgttgcttctttctttaccttctacagtattgaaggatttttttcctttgtctttgagtagttctctaatttttttcgtttcctttttttttccctgcacagaaaaactatgttcacatttcttttcccttacaatgatcacagcatgtgtttttcctgagctctgcagtggttcttccaccttgatttatgttcagtaaatgtgcaattggtaagaagtctgtgctctgcattttgaaggcaaagttacaattcatatatttattaggaagagagatgtagaaaaataataccattagattccattataatattttcttgcttcgtgactctgctcagtcctcttaagtttgttaaagctcaggctttccttatgatcaaaatatggatctgaaaaacacttattaatactacttactctactcccttatatagaaaataactttgaatttgtctaagaaatcatgtcaagacgcatctttcaatgaaatgtgtgctcgaagagagtaattctttgtgcatgtagggttggaaaaggtgagaagtatgtttacttgcacgtcattgtagttgaaatcagatggaaaggtttagagattgtgcaattagggaatgttttctacccacagattctgtagccgtgtgtttcacattcattaacaattaggcccaaggatacttggattcgcatctgctttggaaactattttttccaaatactgtgtttcctagatctttactgaaatgatcaacattaggtatgaactgcaccaactttcctctttaagatagctttgtttgtcctttgatcttttctgtccatgttcagcctcttaaaaccatctctgctgcaaatgtcatttatatgatgcagtaagacactctttcaaataatttttggatgtatgctaatcatatatgagacacaaaggctcctacgcccctagccttacttccctcttggcacttttacttacttcatttttttttagacttcaaatgtgattaactctctcaaatcctttctttcctctttcaactgttgttccttttttttttttttttttaagagtaagggtctcactgtgtcacccagtttggagtgcagtggtgtgatcatagcttactgtagcctctgaactcctgggctcaagtaatcctcccacccagctcccagagtagctgagactgcaagcacacaccaccatgcccaactaattttttttttaatgtttttgtagagacagaatctcgctttgtttcccaggctggtctcaaactcctggcttcaagtgatcctcccaccttggcctcccaaagtgctgggattacaggcatgagccaccacacctgttccctatttttaatatcttataactgaatgctttaatcctgcaacttaagatacatcttcactgcttaattgaaatggcactctttcaatgttaccagtaacctccaaggggaaatggaagctaatattttttgaaggaaaatttgtattattttaattatttttatgtacagaaaactcaacagtgtacatttaactcagtttagtggaaagttctttagcctttgccttttcgagcttggtgatgcgagccacagacttgggacccaggacattgcctccctagtgatggcggatttcatcatatctgtcattgtaattggtcctgatagcttccaccagcttagccaaagtgtctttgtcttccgagttaacctgtgtaaagttgacagtggtgcaggtcttcctgtggactagatgtcccagtcttgccttccccttgataatgcagtaagggacccccattttatgacacaaggcaagcaggaagacaactagcttgatgggatccacttcatgtgcagtcaccaccagctgagccttcttgttctcctccaaggtggtgatggtgttaactcctgctcgaaggacaggtggtcttttagtggggacgtcccctttgccagcagctttcttcttggcctggacaaacagcctctgcttcttctcttgggaagctaatattttttagtaccttctgtagaccaagcaaaagttgccaatgctagacacttgtatatggagtacctcatttaattcttacagctgttattggtattacctccttaagaatgtggaaactagccaggcgtggtggctcatgcctgtgatcccagcattttgggaggccgaggtggtggattgcttgagctcaggattttgagaccagcctgggcaaggtgacaaaacccatctctaccaaaaaaacaaacaaaaaaacaccacaaaaaacagaaaacaaaaaattagccaggcagagtgatacacacatatagtcccagctactggggaggctgaggtgggaggacatcttgagcccaggaggcggaggttgcattgagccgagattgtgccactgcactccaacctgggcaacacagcaagaccccatctccaaaaaaaaaaaaaaaaaaaaaagcataaggaaactaagacccagaaaaggttaagtaacttgtctcatagctagtaaatggcaaagtaacaggattagacatgtctcattccaaattccttgttctttcccgtgtaacacactgttctttatattttaacctactgatctatttatctgttttcttgaaataccatggtagactctttgagacatgcttttctgattctcttggatctccattgctttaatcactaactcataaatagctagcttgctctagtttctgtcctcctcatctaaacctctcaaaagactggtatacaattcttttcttgctacccatttgctccctaacccctaagcccactgaagtctggcttagtctccatcattgcattgaaaatgctctccctcaggacagcagtaacttcctaattgccagttttgatgaacatattttagtctttatcactctttttctgcatttaatactttatagattcctttcttcttgaaattgtctatgtctttgaattctgtgacttcacattcttatccttctcattacactctctgaccattccttgttctctcttgtttttgaacttcccttccttctcttactccttaaatgttggtgttctctgatgttctatctctgcatctttaccttagacaggtacttgaaactaaatactgtatgtccaaaactgaacttgccatcttcctgccagacatctacaccaataggtggtaccaaatgttcaccaagtcttgccaattttacctcctaattatttctctctctctctcatcttctttctttctctctctttctccttctttctttcatttttcttttctttcttttctttcctttcttcctccctccctccttccctccttcactccttccttccctccttctcttccttccttctcttccttcctttccttcccttccttcctttccttccttccttccttctctctctctctctctttctctctctcgacagagtcttgctctgtcacccaggctacagtgcagtggcgccatcacagctcactgcagccttgacctcctaggctgaaatgatcctcctgcctctgcatcctgagtagctgggaccacagacgtgcgccaccacatccaactaatttttaaatttttcgtagagacaaagtctccctatgttgcccaggcggatctcaaactcccagactcaagcgatcctcccacctagacctcccaaagtgctggggttacaggcatcaaccactatgcccagctctgtttctcaaatccattcttttctcttcttcttttaccatatctttctcatcagatccttgttagtacctgcttaaatccctatcatagcctcctaactggtttctcatcttcagttttgtttctttcaaatctatcctcttccacaggcaaaaatgaccatgtaacttaaatcaatttacagttaatgttttgactagggagatatctgaatatattaaaatatttatagttcccctttccaattttgccttttcaccttcttaaacttctattttttatttgagacagcgtcttgctctgttgcccagactggagtacagtggtgctatctcggctcactgcaacctctgcctcccgggtacaagagattctcctgcctcagcctccgctgggactacaggcgtatgccaccaagcccggctaattttttttgtatttctagtagagacggggtttcactgtgttagccaggatggtcttgatctcctgaccttgtgctccacccacctcggcctcccaaagtgctgggattacaggcatgagccaccgtgcctggccttaaatttttaaattagatataatatctgttcattaagtcaaacaaacaaaactctaaatacagtgcacatagccattctaagttaacacatcttttttttttttctctgcgttttatgtgaagggccagaaaccaaacactgtattaaaggtgggcactgtgcttaaacaatcctatgaagaaattagattctcattttacaaatgagaaaactgaggtgcaattaagtcacttccctgaatcgttaataaaagtaacagattcagaattgaaatgccaatctgacaccaaagtctgtggtcttttaccgtgccgcactatcatgccctgtggtatgcatttgtaattcccaaacccacatatctagaccgcccctcactgggtagttctctggatttgtttacacctgtaggtttggacagcctaccaatgccagaaattaggatttggaggatgagtatgtataggaaaatgacacaaagaaagccaggttgtaggaaagttaacctggcaatgtcacaggagaaacagcattgaaagaccaaccaaaagacctaatgacatcttgaactaaagtgatgacagtggaatctaaaaaagaggaaaagaatgtgcttaaaggaatgaaagtctaggactttgggaaaaatatgtcaactctgttgtcattaaacctcttaattctcttaaaatcttaacctttttaagattaagattcattaagtgaaacaaacaaaactctttaaatacagtgcacatagccattctaagttaacacgtctttttttctctgcattttatctgaagggccagaaaccaaatactcttattaaagctggacactgtgcttaagcagtcctatgaagtaaggcatatcaaagcttttttaaggcatcacaaggctatatataaatgtatgacattgtgcttttacagcctaacaataacaacacgtagtcttttacagcttatagagtcctttcattaatattaagtgatttgatcctcacacatccctatggactaagtgttgtatttttcttactttacatataaggaaactggcttaaaaggctgtgacttgcccagaggtaacagctctcaaaacactacactaggccaggtgtggtggtggctcacggctataatcctagcactttaggaggcgaggcgggcggatctcttgaggtcaggagttcaaaaccagcctggccaacatggtgaaaccccgtctctactaaaaatacaaaaaaattagccaggtgtggtggcaggtgcctgtaatcccagcgacttgggaggctgaggcaggaaaacccagaggcggaggttgcaatgagccaagattgcaacaccgcactccagcctgggtgacagagtaagactccgtctcaagaaaaaaaaaaaaaaaacaaactacactaaatccacttcctatgctttctccagagatgtctgcttccctaaaaacaaacaatattttttcaaagtacatgatcaaggtggagccccttttctcctcagcatttgaataccagcttataattaagagtttattagatcaggcaacgagctggtgaagaacaagaacagactactgtatagtgttcataaaattagatggctggtctaaattttagaaacaagattctcgtgacctttgacaggttacatgtacatgacacattgtttctttggcatttcagacgttgcctgcaagcattctgtgaatgaagccataccagtgtcatgccaaatcatgaactgtcctgccctgtacaactaaagaaaaccaagggtcttctgctctggcctctatagaataaattagaaaagttggctgggcacggtgccccatgcttgtaatcccagcactttgggaggcagaggcgggcagatcacctgcggtcaagagtttgagaccagcctggccaacatggtgaaaccttgtctctactaaaaatacaaaaattagccaggcgtggtggcgtgcgcctgtagtcccagctactcaggaggctgagacaggaaaatcgcttgaacctggaaggcggaggttgcagtgagtggagatcatgccactgcactccaacctgggtgacagagtaagactccatctcaaaaaaaaaaaaaaaagaagaagaaattagaaaagatgttgaagagcttagtaggaatgttgtactgattggaattagagttggtggttcatcaatcatttcactaccaccaaagttatgccagtttccttgcattctgcatatacacatttttattttagcattctttaaaaatactgtggttcctgcttcctgggcagtggtcaacttttaaaccatctttttttttttttttttttggtttaaaatttacccgggtgggttttcttgatctttgtttgtttacgcccatccatagctacatgtgtatgcacacatgcaggtagttacagccatttccaaggcaaccaattgtgttttgagacagcaaataatttcagggacagctgtggtgcctcccaccttcttttgctggtgtcacttttcctatgctgtattagctatacaggtgaaaagaaccaacatttagttcaagtaaacatccttggactagcatgtaggatcacactggatctcctcatttttttattctacaacatatcagaagttcatagcagttttctggctattagattgttcttaaaatttaatatcttcacctattgagttacccaagccagcaatcacagtgatttctacctccttgttcctcctcctccacattgattaaatcaacaaattctgctgaaattgcctcctcaattagtccctctggccctgcattatccaatatggtagctactagccagtgggtctgttgagcacttgaaatgtggctgaccaaattgagatgtgctgtgtgaaatagccctccatatttgtgggttcccctcgcccgtggattcaaccaaccacagatcaaaaatatttgaaaaaaattgtgtctgtactaaacatgtacagactttttttcttgtcattattccctaaataatacagtataacaactacttacatagcattcacattatattaactattataagtaatctagagatgattttaaatatatgggagggaaggctaggcgcagtggctcacgcctgtaatcctagcactttgggaggccaaggcgggagcatcacttgaggtcaggagtttgagagcagcctggccaacatggtgaaaccctgtctctactaaaaatacaaaaattagtggggtatggtggcacatgcttgtaatcccagctactcaggaggctgaggtaggagaatctcttgaacccgggaagcagaggttgcagtgagctgagaccatgccactgcacgccagcctgggtgacagagggagactccgtctcaaaaaaaaaaaaagtatacgaggatggcaattttatatcagggacctgagcatccaaatttacagttaaacttttggctctcatttgtggctcacattatatttctcttggacagtctgctctggattattttggtcttagacccttttcatctctcactgttgctgaagtctaataattggcctcaatacattccaaacctcagtgagaatgttctttctgaaatggaaatctgaaactgtcactttcctgctactaccacccttcagaggcttctcatcacaaaacccaagatcctgtgtgccttatgcaagagtcctgcctacctcccagcctcgactcacctctcctcagcttttcttctctcccaccctgcactgtacactccactggtcctaaaattcttgttattctctcaacataccgtaacatttcactcatttgtgcctttgcatttgctgattctttaatctagaagattaaagaagttctaaactggggagttccattttagctttaaaaacttttcataggcttctcttttctcctaccctggtgattctactgacaccttttatttactcccactgggctctaaactcactgagggcagggaccatgtcttgtttacccttatatccacccgtgcttcaggtagtacctggagcagaaaaggtacacacatttggtaaatttgtgtattatttgtattgcattagaataatatacatcttagtgatttatttatgtctgtcttcctactatggaatgaattatttaaagaaaagaactgaatcttatgatagaaagatctaaatatccctgcacctcaagtagtacctatcatatgtagacaccatataaatatttgtgttgaatttaataaactcaggctgaacctactctgcatatattgtgatgactttcagattaacctttagacacattcacagggttactctcttggaagatctctagggatcctcatttatttttggtctttggggttactgtatgttctgctgttggtgttttttactctttgagtattgtttttcttcctttacaaagatagtgtacatgtttattgttgggggggagtcaaatcatatcaaatgatagaaaatgaaagccatctccctagttctattccccagaagagaccactgataagagtgtagtgtgtatcttttaagactattttcagcacatacatacatacgtattttgcacatatatggcataattaatatattgttctaaaatttacattttcatctatctagctagctagctatatctcacgtatttccaagtgcaatattttggaagttttaaatagtcagattagggccatgtttggtattgtgactttgttcctgacctgggtagagtgctgtgcttagctgacatattttacaatccagtgatcactcctgacattatttgcagagtgctcttaccagcagaggagaaagagctactgtccccaaagattggagcaaatagccctgagggaagtggaaaatgtctttggagtgttatttcttttatcttaaaatttagtgcagatcttgcattcaaagacatcatggtatatctgtgtttgtttcctttgtttttacaaggagtttctcccaaaaaactgaacctgaagtaatggtcactccaggaatttatgtcttgtttatcctatggcttcaagtaccttcagtgtattgccaagtactgctcatgtacactccagctgagaaatacagtgttaggtttccaacaaaagtacctaaggatttcccacagttcacttaagaaggatgcaaaagatgttactggaataatcatagtcgcagttagctgtagaataaaggacaggacccggtatggtggctcacgcctgtaatccccacactttgggaggcagaggcaggcagatctcttgagcccaggagtttgacaccagcctatgagcaacatagtgagactctcatctctataaaaaaatacaaaaattagctaggtgtggtggtgcgccccagtggtcccacctacttgggaggctgaggcaggaggatgacttgagcccaggaggttgaggctgcagtgagccgtgatcacaccactgcactccagtctgggtgacagagtgagaccatgtctaaaaaaaaaaaaaagaataagggacaggtttaataagggaatgttttaaaaagaaaggagttaaaattgagagttatatgctacaagaagagtgactgattaagaatgtaggtttgtggttagaatgtaggtttgcctaggttcgaaacctagttctgctacttactggcctgtaactttgaactagttccttaaccttgctgtggctcagtttccccataagtaaaagggaagtaggagtgggtggtaataatggtaccaaattcataagggtgtctatgaggattaagtggtgatgtgtataagcacattaatatttaaagtacttttgacatatcataattgcctagtaactcatagctaaaggtgaaaaaaatggaagactcttctttttggtttaggtcattttttaaatttatatacctgaaaaaaagaggcttaaaacagctcttctaccaagaacgaactcagaccatccatgtttctgccttgattcaagtatagtgaatacacttgtctcattttatattctaattcctcacatcaatccccattattgcttcccaccatttccactttctgtgtcccatttctgccaagaaaagcagaagtaagggagatgtgagggcttggggatttctaaaaacttttcataagtcctcattgttatgttatattgaactatagttatgttaatgtaatatttgccaaatcttccctctgggaaacacaaagaatttcctccattagagactaacattttaactttttagaggaccagtattatggtgttacatacataatatgagagttactcgattatgagagtttattaaatataatttaatgcagaaacccacttttttaaattctttttttctcttatgtttacttatcttcttggatattatctttttttttttttaacttcattttgcacatggggaaacttaggctcttaatttgcctcaaaggcacaaagtacattactgagcctgaatgattgggtttaaacatatgaggttgctatttttatacctcaaaaatggtagaatattggcaattttacgtggttctctaataaatacaaagcctctgtgtgtgcgcgcataaaatatatcatgtgtaaagactgttttaatataaatgtgtagtttaaagagtaataataaaactaacacctttgtacccaccagttgggttaagaagttccctgtgtgtcctgtttaacctcttctaacctcgtctcctttcccctgctaacttcttcttccccaactctccaccccagtcaggtaacataatcctgacttctgtgtaaataattttcttgcttttcattgtttaggattgaaaaactgaggagtaagctcaactctagctgtgtgaggaaggggcaagattgtcactgtcagatgaaagctcccttgagaagataagctgagcaaggtctttggtttatgatctggctttattctttgggagccccttctggggaagtcagagctagtcttacaaaacagagggtttaccacatcagggcatctggcaaagctgtagtttggaccaggtacccaaaaacatccaacagaaaatatggtcaaacagaacaagctgctgtttttctgcttctaaactcaccatggctttcctccagctttcaggagtaggtcaaaacaaaaattttttacattttcaataaaatgcaagtcttcactgattacggcatcatgggatgtcagggagtatggaaactctagactacagttaaaacaagccaaatacaggctcactcaggcattctgtgctccagttaaaaggatggtggccatgcacagtggctcacgcctctaataccagcactttgggaggccgaggcgggcagattgcttgagtccaggagttcaagaccaacctgggcaacatggtgagacccccatctctactaaaaatacaaaaaattagctaggtgttgtggtgcatacctgtaatcccagctacttggggggctgaggaaggaggatcgcttgagtccaggaggtctaggttgcagtgagccctgattgtgccacttgcactgcagcctaggcaacagaatgagaccctctctcaaaaaaataataaagtgatggcagtgaggatcttggtgatgacagtatgcaatgtggctatctcttgagtcacttttcaatctggattaattgccctctgtatctgatacacagcaatcatcctgggatctcccttcaccatcctttgggggattcccattaccgctctcctgtattggaactccaatttcctgtcttcctctttcttgggttagtctctttagtgaaaagttctccaggagcttctcaaagaagggtacataggaggtaaaatttttatgagtttccgtgtctgaaaatgcctttatattattcttacacatgatggtatagctgaaaatagatctcaggttagaaataatattatttcagaattttgaaggcagtgttttatgctcccagtgttactcttgaagtctgaagacattctggctccttatcttttgtatatgatctgctttattctctctggaagtttttggagtcttctttttgtctccagtgttttaaaattttacggtgctgtgactttgtatggtctattttcattcattgagttgaacacgcagactatttcattctagaaactgatatcttcttatttggggagatgttcgttggttattttgttgatgattccttcctctgtgttttctggttctctctctctaaactcaaataatgaatcttcagacttctatctcctaccccagcaaaagcaatatgtaactgagggggcaagggtatctgagtctaggaatctaatccttcttcagcagttttccccagttctccttagttcagccacacacttccattaagtcttactcctttacttccagttctggagtcttttgaaaattgggttggttcttagcttacctctcttcagatttgactttgttggatctgtaaagtcagttaccacttgtttatctgctttccagcttccaaaatcttgttgctattgtctctaaagtcattgtggatttgtgattttagaaggtctatattatagttttaatggaatttcaagtggggttaagattagatgcatgtgttcagtttgccttaacctgaaagtttatgttctactcctaccaagtgttgacagagattatcacaaaaaccacccaaatgtgtgataatgccaaaagaaactcttttttctctgtcttttgttttattctttcctctctcttcttttcttttttgctctttctttgttttggatgcggggagaatatagtaaggattgggagctctaaattccctaatcccgtcccgattgcgtagtaatagctaacatttattgagtattttcccatgtgctttgtgtctacatacattatctaaagtaaccctcataataacccaattattatttctactttaccaatgatgaaacaggctcagagaggaaatgtaacttccccaaggtcacacagttggtacatagtagaattagaatctgaacccaggcagcctgatgccaaagcttgtgctcttaattatgattattgaactattaagtaatagaagttggaaaggtctctattatgtgtctatccagtctcatttatgtataagtccttccaccgcagagctgcatagattgcttaaaacatgaactggagatgtctaaggtgtatatccctacttcaggctagcatcccatttctcttactattttttctgcttccagtcatccattataaggtgtctttttatatagccaggtatcttatatatttcgaacagacagtactttaccagaaaacagaatccataaccatagtgtacaactgtgtggggctttgtagcaagacaaaagctgtgtaaattagtgcagccatggccaggctacacaagttttcaagcttctgaactccccactcatcttactctttctcttctagtcatgaaatggagccctttgatcctgacagtattcatatactttcccagagtgagcaaattattccttatatatggactggacctagaaccctagggtgaatttttaataaaccttttgagagtggaaatttaatcaaattttgatatttccatatcaaaataagttagtttaatcttcctgaaattagttttcagtcttcagaatacctatcctttcttgccttacaggatagggaggaaacacagatatcttacagagaaaataaaaagaccaaatgcatataaatgtttggagaaaagtcacactgtgagtcaggaggcaaatctgtcttctagacagctttgactctcagctagctgaggaaatccatctaggccaacgatttaatagttttctaaaaggctggatgactgtgtgggtgctaatggcatcagagaagatagtggtgagcaggaaacatcccacacttgacaggatgttcccaaagcaggaagggatttctcttcctccgtagaattgtttcattaactaaggacgagaggagataattgaaatctccctaaaataccaaagactgacgaaagcaggatataggacatggtgggtctaatgtaaaccagtgggatcatttatgacattataatgaagtaataatattttgtatatatccatatatccattttttcccaaagagattcaaaatgctttatatagtgagtcagtcattaaatacttttagatctgtgtacaaagaggcagaagtaggactcctgctcagtcagcctcagcctctctcctctggatacaccaccagacttagaaagcttgcagcttacataccacctggtgaaagtttccttttctcatcttccatttctctcattttcatcaagtgctaatctgtctgttgtatggtatatagctctgaagtagttccagcaagacaatatgatcaagcttcctttaaataaatcatgatctctttctctctctgcaagcagcaacagctgtcaaaggtagaactgaagccaaggcagcaccaatggagcaggctgctaatgaaaatatgacaagaatatttgaaactagaagcctcaagccacaactttgttaggtttcctgcactctccaccttggtggcattttcagaggtacacagaaaaatgttgaatatagcagtcacttgagaaatacagtgtcactctatgtctgggacagggattctcgtcccaaaacttagctcaagagaaaaacaagaggaacgaagacaaagaagggacttaaactgggtattagctaacctacagagagtaatagcatcataaaaacaagtagaaaaccgcactggactagtgtaagttatgagttccctgtttttttccactgtacattttgtggcgagcacaatgcatcaattacaggcattatgtttgtgatatcctgagttctggaacactgcctcaagagagttcatcaatcattgtctttttccctaaagtggtcttgcgttctctcagtctgtgggaaataattgtcaaaattaataaatgcacatgaaagaatatttacttttcttgctttctcctgtctgcttttgacttaaccccattatatcctcaaatccagccagactcaaataggaaaattcccacccaggacaattaattccagttcaagccccaaattaccatgaggttatctttagtgaggtaatcacataaaaagtgaagatgggctgggcatggtggttcatacctgtaatctcagcactttgggaagcagaggcaggaggattgcttgagcccaggagttcaagaccagcctgggcaacatcatgagaccctatctctacaaaaaataaaaaaataaaaaattagccaagtacgatagcatgcacctgcagtcccacctactcagaaggctaaggtgggaggatcacttgagcctgggagagtgagaccacaatgaaccatgatcatgccactgcactgccacctggataacagagcaggaccaaaaaaaatgaaattgaattattacctggcttttttgttgttgttgttcttaaagaccagtgtgatagtatatttcctggctttagtctcccaaacaattgtagaactggtattagaaatcctttatatcagaacgctatgtgggttacctgtggttattttaaggacttccatattttatggaatttcaaatatctcagcttatgaataactaaagatactgtcttaaatatcatcatacatttaaaattaatttgctcttctttcaaagttcaggctttgaactatagctatgtgaatgtgtaaagaggaggcaggtcaaagactaaatcactttacatcctccctggtgtgcacactcacatggttttatccaagaaaaggggccaggcacagtgggtcatgcctgtaatcccagcactttgagagtcccaggtgggcagatcacttgaggccaggagttcgagaccagcctgaacaacatggcgaaaccctgtctctataaaaaatacaaaaaatagctgggcatggtggcgcatgcctgtggtcccagctactcgggaggctgaggcaggagaattgcctgaacccagtgagccacgatctcgccactgcacaccagcctgggtgacagagcgagactcggtctcaaaaaaaaaaaagaaaaaaaaagatgtcttatacccctcaaatgcatggtgccttgctcctcaaacaccctacctactcccagtttggacttagaacagctgctgaccattttcggggaaaacagtttctactttaatcagactccccttctacatcaggtcctttagagaaaattattcctgagtttagggatctgtgaacttcctccggttcctgaagagctgtttacattgattcattttacacatagaataataagatcagaagctgccagggaatgacactgatgcattttccaaggagtgccagactagctgaatagaattgaggtctgctcctaactaaggctcagataaagtggagcttctcctcaccatcccccgactgattcattaaagggagggaagttgaacagaaggtagagaggtagattgaggaaggaaatgtacttcagcactgacacgtggcctccctgaaccaccttatcaaataggcccctacttgtttcctaaagtccttaaaagagggagatattgccagagagaacttgccttgagagccaggtggttttgagatcctgtatttatttttcagtcttttggaggtggccaatctccattttattttttttttcgttttttaaaattttttatttccgtaggttattggggaaaaggtggtgtttggttcatgattgagttctttagtggtgatttgtgagattttggtgcacccatcacccgagcagtatacattgcacacaatttgtattttatcccttaccccttcccactcttttcccctgaatccccagagtccattgtgtcattcttttgcctttgcatggtcatagcttagctcccacttatgagtgagaacattcgacgattggttttccattcctgagttacttcacttagaataatagtttccagtttcatccaggtcgctgcaaatgccattaattcgttcctttttatggctgagtagtattccatcatatatatatatgccacagttcttttatccacttgttgattgatgggcatggaagtcattacacagaaaagatacttgcacacacaagtttatagcagcacagtttgcaattgcaaaaacaagatcctttttttatattaccacttaggaacaccttgactaagtccctaatttctctttcctttaccttctttatcctgtaaatgagaaaacactgctgacttccctcataaattgctatgagaaataatagaaaattatcgaagataatttcatctttccatacaaaaaattgtatgtaaataatgttgtttatatttttgggttttgtttgtttgtttgttttgagatggagtcttactctgttgcccaggctagagtgcagctaccttggctcactgcaacttctgcctcctgggttcaagcgattctcctgcctcagcctcccgagtaactgggattacaggcgcccaccaccgcgcccagctaatttttgtatttttagtagagacgggggtttcaccatcttggccaggctggtctcgaactcctgacctcgtgatccacccacctcggcctcccaaagtgctgggattacaggcatgagccaccgcgcctggctgtttaatatttttgttaatgatgacttgacaaattttaataacactgtaaggatagtggaggggtcggggaggcacaggtgcaggcgggagggtacctgaggaattcctaccttggaccagaatacaaaaccatggatcctatactgatatgaatataaatttggaatagtatctccaattactaataataaataggaagaattatattagatgactgacatttcaattatgtttctaccagaaagtgcattttggccaaatattaacatgaaaccagaagtcaatcatgaccaggcatggtatctcacgcctgtaatcccaacactttgggaggctgaggagggaggactgcttaagcccaggagtttgagtctagcttgggtaacatggtgagaccccatctctaaaaaagaaaaaaattagacgggtgtaggggcacatgcctgtggtcccagctactcaggaggctgaagcaggcggatgacttgagcccaggacgtcaaggctgcagtgagccatgtttgtgccactgctgcactccagcctggatggcagagtgaaaccctgtctcaaaaacaaaaaacaaacaaacaaaaaaacaaattaaaaagaaggcagtcattatcctttctggctgtcttccagttgccttctttcatggtgcaggcaggatgctgagccctgtaaatctccccactgggccaactgctgctgcctgtaggtgtgggtggtctccaaccatgactgggctttaccctgtccagctctctctacgtgtctgcagtcagctcctgctcccaatccccacaccagctatatctcatctgcactgttgccctcaagcctcctacttcaccatccctctgccaatgacttgcctcctgttgcacacagaaaacagaaaatatcaggatgaatgacttcacatctctacctacataccacatacacacacctacacacaaaccacacaatcagactttcctatgtttagacctacccttatccttccatctcagtggcaagaggtgttctctccacctgttctgtagattctatccccggctttctcaggaaccttgttttcctttctgtgcccatatcttcagcctctaccttgctacttgctttttctgatcagaatatgaatattctcaagtctcttccatccttaaaaaaattgagaaactttctgctggtcaggtgcagtggctcatgcctgtaatcccagtactttgggaggccaaggcaggcagattgcttgaggtcaggagttccagaccagcctgggcagcatggtgaaaccccacctctacaaataatacaaaaattagccaggtatgctggtgtgcacctatagtcccagctactcaggaggtggaggcgaatcacttgagcccaggaggtcgaggctgcagtgagctgtgattcgtgccactgcagtcctccagcctgggtgacagaatgagactgtttcaaaaaaaaaaaaagagagagagagagaaagaaagaaagaaagaaaagaaagaaagaaaaagaaagaaagaaggaaagaaagaaaaaaagaaaagaaaaaagaaacacacacacacacacttttctcccttcgcagtgaagcttctgggagatgggattttgaagaggccacaacactcagtatctgaaatgaagagcagaatcgattgtttgctcagacaaaatagagctatacttataggacagagtctctctgggcaaagcaaactgcatccttatataggatttagggaaccaactgaaatctcagtcctgccccctctggcatcatcaaaatgactccccttggttgtaggccacactttggttcttatctgacatggtgtccccgtagcactggtacatagctgctccctccttcttgaaatgctccttatagtctctttctgagagaccactgtctcctgggttttcatctttttggtcatgcttcagtctctgttataagcttttcttagtaccccatccttcaaataatggtattcctcaagtgtcttcctccactatcttccctccagagtttttacctgtcctgttacggctcatctactctctgatggcacctgccattgcatgttccctgaatgactcccaaatctttatctgcagcccagatccctctcctaagtggtagagagccacataactggccgcctactagatctctcccaccttgagatatcaaaagctcctcctctcatagactctatcttggtaccatcatctatccagctgtccaatctgtcttgctttatccctctccttgtttcccacatccagtcagtgactaagtctgctcaattctgctttactaactcacaaagagctctgttcttttcatttttactgccagttttctcattatctcttgcctgaattactgcagaagcctcctaattgatctcccttttgtggcccagccttcatgcagtccacaattttgatctctctaaaatggaagtcatgtcagtctcctgttttggtttgtttgcttgtttgtttgtttgtttgtttgttttgagatggagtttcgctcttgttgcccaggctggagtgcaatgacgcaatctcagctcaccacaacctctgcctcccgagttcaagcgattctcctgcctcagcctcctgagtagctgggattacaggcatgcgccaccactcgcagctaattttgtatttttagtagagatgaggtttctccatgttgatcaggcaggtcttgaactcctgacctcaggtgctccacccgctttggcctcccaaagtgctgggattacaggcatgagccaccgcgcccagcccactctcctgttttaaatcctttgattttcccccattgctttcaggcaggaaaagactttatacaacttataaagacccctgggatctaacccttgcattcatttccagtcttatttctggcacgtcccatgtcatcctcccacacctctgcttgagtcacatttgacaccttgcagttcctcaaattcagtgtgctaataaagagcctccaccttcaacttgctgctcctgttcttggaaattcccattccttgccgggctagttcatctgaaaactcagctctgctgtcacttcctctgtggtgacttccctgaccaccctcctcacccacagtctgattgaagtgcccatcctttgtgttccatcttagtgcatacattatattatattaatttgactgcaaagaccttgaggttagagataactgtgtttggttgtttttttgtttttttgagatggagtctcactttgtctcccaggctggagtgcagtggcgtgatctcggctcactgcaacctctgtctcctgggttcgagcaattctcctgcctcagcctcccaagtagctgggactacaagcatgtgccaccacgcctggctaatttttttgtatttttagtagagacggggtttcaccatgttggtcaggctggtctcgaactcctgacctcaaatgatccacccgccttggcctcccaaagtgctgggattacaggcatgagccaccacacccggctggaataactgtttttttatatctgtattccaagtaccacatgcctagtgacttacagaggaggttcttcttaatctttgataaatgaactggccttttcaattcatcaggaccattatattttattttatcaagagatagggttttgctgtgttgcccaggctacacttgaactgctgggctcaagcaatcctcctacctcagcatcccaggtagctgggactacatgcatgtaccaccaaacacagcctctagattcaactaccagtttgcaagaagcatagaagactggagactatgttacatgataccatagggatgcaatcggtaaaatctaaatggaggaaattctctatgaacaatcatatgccttagactataagggagaaaagataaatagataaagagcttatacagagtcttaagagagataccaggcaatttcaatgtatgggaattttttagatccttattcaaaaaacaattgtgactcagaaatatgagtcatttatgttacatttatgttacataaattttatattaaatatattttacaacaagaaaagattttatcaggctgggcgcagtggttcacgcctgtaatcccagcactttgggaggccaaggagggcggatcacgaggtcaggagtttgagaccagcctggccaacatggtgaaaccccatctctactaaaaatacaaaaattagttgggcgtggtggcaggcacctgtaatcccagatgctcgggaggctgaggcaggagaatcgcttaagcccaggaggcggaggctgcagtgagctgagattgcaccaccgtactccagcctgggtgacagagcgagactctgtctcaaaatctcaaaaaaaaaaaaagaaaaaagaaattgtgcgtatctttttttttttttttttttttttaagacagagtcttgctctgtcgcccaggctggagttcagtggtgcaatctcagctcactgcagcctccgcctcctgggcttaagcgattctcctgcctcagcctcctgagcatctgcgattacaggcgcctgccaccacgcccaactaatttttgtatttttagtagagatggggcttcaccatgttggtcagtctggtctcgaactcctgacctcgtgatccgcccaccttggcctcccaaagtgctgggactacaggcgtgagccactgcgcctggccctgtgcttatcttttaaagcattcttatatttagaaatgcattccaacatatttacaggtgaaatgatatgtctgggatttgtttcaaaataatccgagagaaggaagtgaattggtatatagatgaaattggattggccgtgagctgataattattgcagctgagcgatgggtacatggcagttcattatgctattctgcctgcttttgtttatatttaaaatttttatgataaaatccttttttttttttttcttttttgagaccgagtctcgctctgttgcccaggctagagtatagtggcaccatctcagctcactgcaacctcctcctcctaggttcaagcgattctcctgcctcggcctcccaagtagctgggactacaggcgcttgccaccatacccagctaagttttttgtatttttagtagggactgggttctaccatgttaaccaggctggtctcaaactcctgacctcaagtgatttgcccgcctcagcctcccaaagtgctggcattacaggcatgagccactgtgtctggcctgataaaatcttttattgttgtaaaatatattaacataaaatttaccattttaaccatttttcagtatacagttcagtggcattaagtacttcatgttgtcgtgcaactgttgccaccattcatctccagacttttctcatcttcccaaactgaaactctgtatccgttaaacaatagctcctcattctcctctccctgctgccctgacaaccaccattctatgctgtctttatgaatttgactactttaggtaacttatgtaagtgcaatcattcagtatttgtcctttagtgtctggcttttttcacttagttttcaagttcatccatgttgtagcatgtattagaatttcattcctgtttaaggctgaataataatctattatatgtatataccacattttatcgatctattcatcttccagaaattgacatttgggttgcttccaaaacagtttttaagttctttcctggaggtatcccataatgaatgttcttataaatgaggtatattgatgatagttatcttgctgaggaacagacgaagaatttctaatttctgaagacatcagatcccaaaggctttagagtttctgaacagctacaatccataaaacctcaggaagtgccatagactgcagaggaggaggtaaaaaggtataagcacagggaaaggaagttaacatttgctgtttaggattactgagaaaaactcttgctctcattggcctctcttacctcccaggcagcttttctatttccggagcatccctacacagttatttctaacccatgtagccctgccaactatatttttaccctaagctcaggaactacttttcatcagttttatgccaaaagttgatgtgtcacatatgagtaaaaaaaaaaaaaatctcttatctcctcctactggagataagccaaattagggcagaagccaaaccagaaaaattcaaaccaaatattaatctgaaatatgtttgtttgttcatttgtttgagacagggtctcaccatgttgcccaggctggtctcgaactcctgagttcaagagatcctcccacctcagcctctcaaagcactgggattacaggcatgagccaccgcacctggcaaaatatgtttttattcttctgatttttagagaattatccttaatcatcttgagaaaaaacagtagacagaaaattaaaatttaaccccgatggtaatcagaataaagaaaatgcagtggcaaaaggagacgtatttcaaggaaaaataattttgtgaaaaggaaaggtgaaatagtaggaaatattggaaacagaaaccccaaatcagaagagagaaaaaaaagaattctaagatgataagtctgacttgagtaagcctccatcttcccattccagaagtctgggccaagtgtactccttatcagtaagggaaagtatcactaaggaggacccgtgatgttgtgtgggatggggcaggcagggtgtgggggcggggcagagataccgtattttaggttaagcctgaggtattgggtactcaggaggtattagttctgggatcagtttggaattttagatgtgctctagaatgaaccgcgtattgtttattttgttgtgctatgtagtccagactccagaatgtatccttccggtattatcacacagttttgattaccatagctgtataagaaggactaaaatgaggttaactgatttttctgcttcattctttcttttcaaaattgttttagctattctacttcctttgcctttactgtctatagccttccaattcatgaacctggacgatggtgttgagttcttctatatgcttgctgattttctgtccagttatctcaattgttgagagaggagtgttgaggtttccaactgtagttgtagatttggctatttctcctcctggttctgtcagcttttgctttcacatattttgcagctctgttgtttggtacacacatttaagattgctatgttttcttagattgaccctgttaccattatataacgtcttttgtgtctctggtaattttctctgctctgaagtctattttatttaatattaatatagccactccagctttcctttcattgtttgcatgctatataactttttccatccctctactttccaccagtctatttgattatatttgaagtgagtttttttttagatagcatatagttgggtcatgttttttaatccattctgccagcctctgtcttttaattggtatatgtagactttttatacctcatactgttattgatatgttagggcttatatttgccatttattttttcttttctgtgttttgtctctgttttacttttcctcccttcctatggactattgaacttttttagaattccgtttttatttctttataatggctttttaaaatctatagtgtttttttctgggtgcagtggttcacacctgtaattccagcactttgggaggctgaggtgggtggatcatttgaggtcaggaattcaaaaccagcctggccaacatggtgaaaatcgggctttactaaaaatacaaaaaaaaattagccaggcatggtgccgtgcacctgtaatccaagctactcaggaggctgaggcaggaaaattgcttgaacccgggaggcggaagttgcagtgagccgagatcagactactgcactccagcctggcggacagcgagattctgtctcaaaaaataaataaaataaaataaaatctatagtgtttttgagtgtatctttttgtatagcatttttagtgatcactgcaggtgttttggaggtttttcgggttttttttttttttttttttttggtgggagcttttccagatagggtttcactctgttgcgcaggctggagtgcagtggcactatcatagctcactgcagcattgatctactgggcccaagggatcctcccacttcagcctccagagtagctgggaccacaggcacacaccaccatccccaactaatgttttttatttttagtagagacaaaatcttgctttgtttcccaggctggtctcaaactcctgaactcaagctgaggcagaaattaaagaaagaaagaaaaaataaaattaaaaaagagaaataaactttcctgtattaggctgacttgacccagaggcagcaacaggcacaggccagacccaagaaaagtcttgataatactatctaatgtgccctgaagactctcccagtactccctcaacataaggaagagaaaaacaaattttcctttgtcttatagtataagtttatagattcctgttctctgtaactagtaacttcaagtattctgttttacctaaacagtacagtgaaagtcatgagacatctgagcaggcctaagctatagccacctaggtgccatagtgaatgtcacagaataagccgtgctaggcactaaggcaaacctagataacagccatctagattgcatagcaacagtcatgtgtaatcctgagttatgcacctatcacagtttgattaactgtctttgttctgcctctgtattcttgctttcgcaccaccataagtttgtttcaggctagcccaccccctttttgaagggtatttaacagtcaagtgctgtctttgttcttagcccagttttttagatgttaagtctgctaggtctgagtgcactcaataaagatcctcctgctttaccccgaagtctgtctagtcctcctgatttctgcaacaaagcgatccatccaacttgacctcccaaagtgctaggattacaggtatgaactaccacacccagccaactctatttgttttatacatacacagactcacacacatacacagcatcataatctactgatgttattttaccaagttttctgagtaagactgcctctttcctggtctttggctagagagaacaagcctttgttgggtttttttgtctgcacacattggcatttctaggttgacagcttcttcagctccaattctgagatctatgtggcaaaaagaaaacccagggaactcaccaccatgtcagtccttgtgtactgaggtccccagccagtttgccatttttccctctacctttccaagtcttcttatgtttattttatatataatgtccaaggtttttagttgcacttagtgggagacatagggagaagtacatctactccattttccctcctggttttacttttgatctaacatagaatcttaagttgaattttctgtctttttaaaaaaattattccaagtagccaggcgcggtggctcacgcctgtaatcccagcactttgggaggccaaggcgggcagatcacgaggtcaggagtttgagaccagcccgaccaacatggcgaaaccctgtctctactgaaaatacaaaaattagctgggcgttgtggcgggtgcctgtaatcacagctactcaggagattgaggcaggagaatcacttgaacccaggaggcggaggttgcagtgagccaagattgtgccattgcactccagcctgggtaacagagcgagactctgtctcaaaaaaaaaacaaacaaactattccaagtatacctatgacactgattcagaccactggatccagccttcgaatttacccgagaggaagtgggttcatggctggactgtcatggagtttcaggccagggcttttatgctgcacactcatctttttccctgtgtctttcaattattctcctttgttttcattgttttcagagagctgcttctagtagagacttctcagccacaagatggtgccccagaatagttcaagataggcttttctgctcttctttgggccccagtctttaatgtactattagtaaactcaaggccatttatctgaaccaggatatagctatgaagacacaactgtattatcttaagccatgttttcccagttgcctgaaaacttaagcaatcagtatcagaaatagtttttgtttgaattttttttataattttattattattattattatttagagatggggtcttgctgtgttgcccaggctggtcccgaactcctggcctcaagcagtcctcctgcctcagcatcccaaagtgctgggattacaggcctgagccaccagacccagcctatgtcttttgagctatttgaatccatgaatcaaagtttactagtgtagatgtttgccttttattactagcccaacttttaaaatagcttataagattatgtttaaaaatacatagaataactttctttgccatgtctactgagagaacgaagaccattctcagcaaccagactgtcaacattccagaaaatggtgacattactctgaagggacacacagttactgtgaaaggccccagaggaaccctgcagagggatttcaatcacatcagtgtagattcagtcttcttggaaagaaagaaaagaggctccaggttgataaatggtggggaaactgaaaggaactggctgccgttcagactatttgtagtcatgtacagaacatgatcaagggtgttacactgggcttccattacaggatgaggtctgtgtatgctcacttccccatcaatgtcgttatccaggagaatgggtctcttgttgaaatctgaaatttcttgggtgaaaaatacatcctcagggttcggatgagaacaggtgttgcttgttcagtatctcaagcccagaaagatgaattaatccttgaaggtaatgacattgagcttgtttccaatttagaggctttgattcagcaagccacgacagttaaaaacaaggatatcaggaaatttttggatggtatctatgtctctgaaaaaggaactgttcagccggctgatgaataagatctaagagttgtccagcttctgaaacaagatgccggatgattcctaagacctatttgtgatgtttaaatgatgcaaaagacctattgatttggaaagaaaaataaaataaaaatacataggacagaaagactggtaaatagacattaacaatctttgggtagtgagctgtgagtcatttgttctttcatttttcaagttttcaaatatgagctactttatgatggatgaaaatggatgttgggcatattcttcagctaatcagaaaatatttattaacgaaaaaatatatttatgacccatccaatgtgtgtagagccagcatatatgttttcttagtcttgatagttacataagaaaatattgggggctgggcacggtggctcacgcctgtaatcccagcactttgctaggctgaggtgggtggatcacctgaggtcaggagtttgagaccagcctggccaacatggtgaaactccgtctctactaaaaatacaaaaattagccaggcatgggtggcaggtgcctgtaatccaaggtactcaggaggctgaggtaggagaatcgcttgaacctgggaggcagaggttgcagtgaactgaaattgtgccactgcactccagcctgggtgacagagcaagactctgtctcaaaaaaaataataataataatattgggtactccgttactaaaggcagggactatggcttaaaatcctgcagctgtgatacctaccatgtgccttacacatagagaggtctaggaaataactgcttgagcacagaaaccattattcctagctttgaaggaaagaactatattttactagttgtaaatctttgagtttggtgtcctcaaggtaattacctgcttgagtgttagctcacatgaagtgggcaagttgtgtccattcttttttttttttagagatggtgtctcactctgttgcccaggattgcagtggtacgattgtagctcactgtagccttgaactcctcaagcaatcctcctgcctcagcctctcatgtagccaggatcacaggtgcatgccaccatgcctggctaatttttattttatttattcattcattcattcattcattttttttgagatggaatcttgctctgtcacccaggctggagtgcagtggtgtgatctcagctcatggcaacctccaccccacggattcaagcaattctcctgcctcagcctccccagtagctgggattacaaacatgcatcaccacgcccagctaatttttgtatttttagtagagatggggccatgttggctaggctagtcttaaactcctgagtcaagtgatctgcccaccttggcctcccaaggtgctgggattacaggtgagagccaccgtgcctggcctaatttttttttttttaatagagacgaggtcttgctatgttgtccaggctggtctaaaacttcttgcctcaagcagtcctccagtctcatcctcccacagtgccgaagttacagatgtgagccaccatacccggcccattctatgtcttaattatagaactaataattagggataaaaaagccaactactccttactgaaataagattagcaatggagtggacaaaaattcaatatcagtccaaagcaataaacagtaatatttttaaaattcagctggccaggcacagtggctcacgcctgtaatcccaacactttgggagccgaggcggttggatcacaaggtcaggagttccagaccagcctggccattatggtgaaaccccgtctctgctaaaaatacaaaaattagccaggcatgatggcgtgtgcctgtagtcccacctactctggaagtgccaccacttgtgtggcagaagacttgtttgaacccaggaggtggaggttgcagtgaactgagatcgcgccactgccctccagcctgggcaacagagcaagacttcgtctcaaaaataaaaaataaataaataaaaaataaaaaaattcagccctcgataattcattattagatcatcagagtcaacgtgtatattggatataacaggtacgaatgtaatatttgatagctgattaaataaatgaattcattttattgatgataggactttaagtaatgtcctgaaaatctacagaggaggaacttatgagtaaagagaagctagactaaaataaataccttttccaaccaagacccaagaaaataaaggatttctgcaagacctttcaacttgtgatttttgtgggcccaccaattctcataaagatcttttatatttctgatacatgattatataatacaagttataattttttcagcttttgttttacttagtaatatccatttatagcttagtttaataggtggtacataaaagtaatttatgtacttttccttatgaaaaattgagtataggcaagctcaccaaagtactagacttctaaaacccaagtctagacctttgaggagttcatgtgcacacaatgaagtggaggccagtgggaagtggagagaatggggataaagtaactgactggaaagtaggctacagggtagaaatcgacagatctttagtagaaaaggggatttcaatgaaaggaggcagtattagcaataaagtcataacatagaaaagtcactgtctagtctaatcatttacaaacttaaaaagaagtagaagcttttattcaaatcaaaacttatgtagaataccaatatgataaatatataaaggttgagccgtttgggtcgaaacaaggtttgacatgtataggaaacaaaatcccatccctcttgagcctctctatctctatcctagtgggccctagagagcacagtttaaaacagctgaactaggctgggtgcagtggctcacacctgtaatccaggtgctttgggaggccaaggcaggagaatttcttgaggccagaagttcaagaccagcctgggcaggatcgtgagatcccatctctaccaaaaaaaaaaaaaaaaaaattaggccaggcatggtggctcatgcctgtaatcccagcactttgggaggctgaagcgggtgggtcacctgaggtcaggagttcgagaccagcctgaccaacatggtgaaaccccgtctctactaaaaatacaaaattagttgggtgtggtggcgcatgcctgtaatcccagctacttgggaggctgaggcaggagaatcacttgaacccgggagggagaggttgcagtgagctgagatctcgccattgtactccagcctgggcaacaagagtgaaactctgtctcaaaaaaaaaaaaaaaaattagccagacgtggtgcacgtctgtggtcccaactactcaggaggctgaagtgggaggattgcttgagcccaggaattcaaggctgcagtgagctatgattgcacctgtgcactccagtctggacagcagaatgagatcctgtcccacacacaaaaataaagaaacccccccctgcaatgtagcctgaccagcaggcagatgttagacattaatgtgtaatagggaagcattttcctcaggctttcaaagatgggaaattattgtggattgttttcttaccccctaccagaaaagagtgcttcaccattgaggtggcctgctggaaaaatcactccactaatttgagagtcttcccttgaacttttgtggttctggctttgtgttttttagctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatgtaagtgttggaggtaataggtgaattatactgtgctgcagacatctatctgcttgttagttacctactttaaacctatcttttaaatgcatgtgtatgtgtatactcaccctcattaaaaaaaaaaaaagatttgagacaacttacaaaactacggtttcttctaaaaaagaaaaacactacagtttctacggcaggataaacttaaacagatgaggaaatcaggataaaggagaagtggagggaagttaagtcaggagtgagattagtacaccgaatacatgccataagatcctaagtagatcatttagcaaatacttgacaaacaggagcaccttctatgttcttggagaaagagcagtgaaaaagacaaagtccctgccctcttagaatttacaataaacagataaacaaacaggtaatgtcattccaggcagtgattagtactatggggacaataaagcaaggtagatagaatttaggtaagggataggtcagagggttgtgaatggggtggtcaggaacagcctttctgagggggcagattcgatgaggagtgagttatttgagaaatggggagaggtggtgggaagaccatcccaaataatacgaaatatttaaaaagccccgatgcaggccgggctcagcctgtaatcccaacactttgggaggccgaggcgggcagatcacgaggtcaggagatcaagaccatcctggctaacggtgaaacctcatctctactaaaaatacaaaaaattaaccgggcatggtggcgggcgcctgtagtcccagatactgaggaggctgaggcaggagaatggcgtgaacccgggaggcggagcttgcagtgagccgagatcgcgccactgcactccagcctgggcaacagtgcgaggctccatctcaaaaaaaaaaggagcccaaaggagccctgaggcaggcataagcttggcatgtgtttgaggaaagcaacacggccagttgggctataatagcaagagggaaagtaataagctctgagattagagagaaggcagaaaccgcaatgcagaggaccttgcagatcctggtagacaagcaagaggcctagattttattctaaatgtagggagaaaattgctgttgagctgcagcttcccaggaagccaaaggaaccatggtaaacatggtcagtaacaaaacctacagtaagccagccacagtggctcatgtctataatcccagcactttgggaagccaaggcaggcagatcactcaagatcaggagtttgagaccagcctggccaacatagtgaaccccatctctactaaaaatacgattagccagatgtggtggcacacgccttgtagtcccaggtactcgggaggctgaggcagcagaatcacttgaacctggaaagccgaggttgcagtgagccaagatcgtgccactgcactccagcctgggttacggagtgagactgtctcaaaaaaaaaaaaaaaaaaaaacaacccacaaacctacagtagccataaagtaagaagaaaatagctaattaggaggagtacagatccgcaacagcacatatgaactcaatgcactgttgtgcattgaggttttcatattgtttgtgctaacaaaagtttatttccaactttgcttaatgagtgtatatgcctcagccccaaatctaggtttcatagtctgaatgtgataacttcaagatttgtcagtattctccaaatcatttattttattgagacggagtctcactgggtcacccaggctggagtacagtggcacaatctttgctcatggcaacctccacctcccgggttcaagcgattctcctgcctcagcctcccaagtagttgggattacaggcacccgccaccatgcccaactaatttttgtatttttagtggagatggggtttcaccatgttggccaggctggtctcgaactcctgacctcatgatccacccacctcagcctcccaaagtgctaggattacaggcatgagccacctcgcctggcccccaaatcatttattatttaaaaagtacagtagctctcaatcataaagcaagggagaagcaaacctctcatccagttcccaaaccacatcccttctttttttagctggaagatggtgcttccatttctccaagagcagaagacctaatggcaacattgggtagacagtaagattgtaggcttgggaattagtttacccaggttgagatcatggccctgccactccctgtctgggaaaggtttttcctttctctctgtcttccttatctcttgtgtaacttttatggggttgttttaaggattaaataagataatatgtgtaaataactcatgtaaaactcttggcatagcaccaagtacatggaaaacatatatgttagttgctgtcatgatcattattattttccttatatggaaaaattagataaatttgaagtgttatgaccaagaagcctgttggaaagtggtctcactgcttggtttggggtctgtatttattgcatcagctgaaattccaaactcagttgtaacgatcaattcactgaccttctttgtcgctttggatttgaatatttaagtgtttaacattaaatctgttttccactaatgtgccaaagaagcttttcaaacatacactagagagaataatatagtgaatagtgagtcctcatgtaactgtcacccggctccaacaattaccatcattttgctaattttgttccataaaccgaatacattttttctttttcttttttttctggagagttataaggcaaattttgtcattttatcatttcacttgaaatacttcaggataaagaaaactttaaatggtcctatttagggtcatttgaatcaaggcatagggcatatcacaagttgctgtctgaatctcctaaagcaaggtcgttactgccatttttacagcacatttattaaaataataagtgctaaggttgatggtctgttggaggctttgagtcactggctcttaccaaagaagatgttttggggtgctgatccaggtgactgtctagaagctgctctgaaataccagttcagctttaggggcagccagttatttggtggcttgcaagaaagtctcatcctgccctagtagtattttgggtgtttcttgaatttgggtgaagagagagggaaaaggtgtgctctgtgatagataaggcaaataggaaaaatgcccaaagagaagcaacttttaagtgtgaagagagcattgttagaattcatcgttctagtggaagagtccagtgagctgtgagaatcccaggcattagcattctgttcccctcagctttccatctgtgttctagatagtattgcttaccagctaaggactttgaggtggttcttaagtattactagcatcatgttggtcaagaaatcagaggcacctccaaggaaagtaagtaaaaagtacggtgaaaaacactgtcctctgcctcttcagctgtgcttgattgtgtcctttcttatgcctggttcagctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcaggtaatggtacctgttctttatgtaatattaacagagtcaagtatacagtaagaatgtggcatagaaaaagagtgtcacaactaattgaaggttgcaaatgctttatttttctcagttttaggttagtatttggaactagccaggtcctagaaagagtctgctagagttttcataggccaacctcaaattaattaaaacacttaggggccaggcgcagtggctcacacctgtaatcccagcactttgggaggccgaggtgggcaaatcatgaggtcaggagatcgagaccatcctggctaacacggtgaaaccccgtctctactaaaagtacaaaaaaaaaattagccaggcgtggtggcgggtgcctgtaatcccagctacttgggaggctgaggcaggagaatgtcatgaaccctggagacagagcttgcagtgagccgagatcacgccactgcactccagcctgggcgacagagcaagactccgtctcaaaaacaaaaaacaacatttaggatataccagttttgacttcaattaattatgtcacaaattatgacttcttttttttttttttttttttgagacggaatctcactctgtcgcccaggctggagtgcagtggtgcaatctcagctcactacagcctccgcctcccaggttcaagcgatcctcctgcctcagcctcccaagtagctgggactatgggcacatgccaccacgccgagctaatttttgtatttttagtagaggtggggtttcaccatgttggtcaggctggtcttgaactcctgagctcataatccacccacctcagcctcccaaagtgctgggattacaggcgtgagccaccatacccggccataaattataacttcttacatgtgttttttatttttgtttatttgcaatagctcaaattctttatttcttatagtttgttatacttctgctaagtaatttgttttccctgtttaattcatttctatgacagtctcaattgaattctcctttgattctagttaagatatctataatataaggacacatcttgtgtgaaagcaaagggagagaatccaaagtgagttattacagaaaagtacactggcccgtggtataataaataaggttcaattatcaaaaaatattggctgggcgtgatggctcacacctgtaatctcaacactttgggaggccaaggcaggtggatcacttgagggcaggagttgaagaccagcctagccaacatagcgaaaacctcatctctactaaaaatacaaaaattagccaggcgtggtggcgtgtgcctataatcccagctacgtgggaggctaaggtacaagaatcgcttgaacctgggaggcaaaggtttcagtgagccaagattgtgccactgctatccagcctgggtgacagagcgagactccgtctcaaaaaaaacaaaaaaaaacaacaaaaaaaaaacggagatgttggtcaaaggagaaaaaatttcagttagataagaggaatacgttccatgatgactgtagttaataataacaatgtgttgtatcattgaaaattgctaagagtagattttaaatgttctcaccacaaaaattgtaagtatataaggtaatgctcatgttaatgagctcaatttagctattctacaatgtatgcatatttcaaaaacatgctatacatgataaatatgtataattgttattcgtcaatttaaaaataagtaagaaaggctgggtgcagtggctcacttgtgtaatcccagcactttgggaggccgaagcaggaggattgcctgagcctaggagtttaagactagcctgggcaacatggtaagaccatgtctctataaaagtaagtaaataagaatatccaaaacaataaatttatagtaaatgtggtattaaatgataccatagtgattcaagatatagttgaagaactattaattcttaagtataataaaggtataaaggtattgatcttacatttataaaataagaccttatttcttagagatacatactgaagtattacagaagaaattacatatctgagatgggagggcagcgtatggatgaaataagactagagatgaattgataatggctgaagctaggtgatgagtacatgagagttcattatagcatttctctacttttgtttacatttgtcccttggtatccatgaggaattggtttcaggacctctcacagatactaaaatcctcaaatgctcaagtcccttatataaaatggcatagtatttgcatataacctacacacatcctcctgtgtactttgaatcatctagattatttataatacctaatacaatgtaaatgctatataaatagttgtttctgtatcttttagggaataatgccaagaagaaaaaaagtctgtacatgttcagaacacagttttttgttgttgttgttgttttgttttgtttcgttttgttttcatatattttcaatctgtggttgtttgccagggatacagaacctgcagttgtggaaggctgactggatttgaaatttttcactctcacacacaaaactgatagagccaacaaaagaacgtctgtattacataaatgtaatgcttctacagagagtctttagacttaaaaatgagacccctcaaaaaaaggaactcctaatattagggctcatcttcacagagtttgctgctgtttgaaaatccattattaagtgagataatccattatcaatactcttctggagcaaacttgagaagtgtcagaaagagaaatggccaagtagccctttagtgttgttctcaatgttttgttctctttttaattcaacagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattacttatcatccaattatttggattggagaagagggggcattcactcctctttttcttattttttttggaaatagagtctcaacttactctgtcgccagggctggagtgcagtgacgtgatcacagttcactgcagcctcaaactcccaggctcaagcaatcttcctacctcagccctcctgagtaattgggactacaggcatgtatcaccaggcttggctaatttttttttttttttttgtagagatggctgtctcactctgttgacaagactagtctccaacccctggcctcagtcgatccccagcaatttgggagattgaagcgagagaatcacttgagtctaggagttcaagaccagcctaggcaacatagtaagatctcatttctacaaaaaatttaaaaattagccaggcatggtagtttgcacacatagtcccagctactttgggggctgaggtaggaggattgcttgagcctcagaggtcaaggctgcaatgagccaacgttgcaccactgcactctagcctgggtgacagagcgagaccttgtctcaaaacaaaacaaagtgctggaattgcagacttgagccacagtgcccagcctcacttctctagactatgatggttttttcttcattctataatctcttttccaaattggttcaacattttgtgaacactattaatttcatcattcagtatatgtgggctttctaaaatatgccaatttttttccacttaatcaagtttgacttaatttaacaaagtgattatattttaatagttacatttctgttttttccactcactagccagcttacagtttattagcccttgatttcagctgaaaatattcatgtctgcaccccttcatgatagttctttctttacgtatacatactgtattcaatatgcaagaacaggcaaaaactactctattgtgataaaaatcagaatagtaattgcctgaggaaagggatatgagagaacttgagagaactttctcggggtgatggaaagtttcttatattgatttgggtaatagtaacatagctatatgtatatattagttaaaattcctcacactaaacattttaaattgatatatttacatttatgacaatatacctcaaagtaagttagggtaagaaaagataattacttacatgaaataaacaatgacctcttttatatcaaaccatatacatgtgtataattagggtatgtattatgcacagagaaacaatttaggaaaatccaaggaggggacgttttatcttcttacctatttactgaatgcaacattactgcacaccaagacaaaagagctctccaggaaaacattggatatattgagagcattaaaagatactgcaaaagctctaataaattcagtctgcttattttccaaatttcataaactacatacttaggaaactgtgctttcagtgagctaaacttctttttttaagtaactatcatagttttaagaaaaacattttaagaagacaaaaagtatttattaagcccatctaaaaggctaatgcaaattcccaaaaaaggagcacatagagatagaggaggaggccgaagtggtggctcatacctgttaattccagcactttgggaggccaagacaggaggatcactttaggcccagagttggagaccaacctgggcaacatagcaagaccctgtctcttaaaaaaaaaaaaaaagacgggagaagctacaagaagaaaactagaactttagagcaggagtaaccttagagcatgtaaagtccattttggagatgaggaacagacccaggaagatgacctggcttccctgaatcccacggctagttagtgcagacatttcagccataacccagctcttctaattcccaaatactctttcttctactggcacatagagatgggggaggagtcagggcatggtggcccacacctacagttccagcactttgggaggccaaatgggagaattgcttgaagccaggagttggagaccagcctaggcaacacagggagacccgtgtcgacaaaaaatttaaaaattagctgggcatggtagcacatgcctgtggtcccagctactcagaaggctgaggtgggaggatcacttgagccccagaggtcaaggctacagtgagctatgatcatgctactacactccagcctaggtgacagagtgagaccctgtctcaaagggagggaggtaagaatgagaagaaggaacaggggtgtacctcttttaagggcccaagtatcctgaatggctcagcagtatagaacattgtggtagagaaattacattttaaaataactctaatactgtttagaaacaaaaccctaacttctgcttgagataaactgaagtgcatctgtcccttgtccaggagtggggaaccattgtagggttgctcagcataagtcatactgccacggtgaccttgaggagtgcagggattccctgaaggaagcagctggtaccagacacttaggctgcccatttgtgttctgatcatttgagtgaaaaaaaggtacctgtcaagcaagctcctggacaccacaagaaggaggaattattttaaaagctgtactcttaaattgttagtatctttaaaatcagttgtgaacaatgaaggatttgaaagagcattgactttgccacttaaaagtatttctaaaatactttgtgcttcccccttgcattctgaatttatacacttttcctcctgctgttctcagacccagtggaaagaaaatctcaaggaagaaggctgagtttattctctcagggctctgttgggtctacctcatctgaggtggcttattcttcataggaaattaatttttcttctcaagtatgcacttaaatataattactgcttccttggtcctctagcagatttctcacttttatttatttttttttttgagacagagtcttgatcttttttcatctaggctggagtgcaatggtttgatctcagttcactgcaacctctgcctcctgggttcaagcaattctcatgcctctgcctctcgggcagctggaattacaggcatgcgccatgacgcctggctaatttttgcatttttagtagagacgggttttcaccatgttgccccggttgctctcaaactcctgacctcaggtgatccacccacctcagcctcccaaagtgctgggattacaggtgtgagtcaccccgcacagcctgaaatgaggcatctctatctatagtccagcagccctacaggaggcaggaggggagcaagaataagaaaggaaatttgtaaaaggcacttaggagtgagcagaaaggaaataggaccagcttttacctgcccagtcctggccagtgacaagcagtctgcttgagtctgtgctaaataaacaaaggaagttccatttagagctctacagaggggaagccatagaaattaacaggatgaaaatacaagagacaggaacacagatgaataaatgtaataaaatttgagaaataatctttacttttatcatctccatttatgctttttcatgatgtcctgacgttccctctccccaagtttagttttttgtttttgtgggtttttttggcattatttgatctgacgagtgcttccagaggttctactacatacacaacttgcttttaactggtaatggaaataaacaggaagacaattatctagtcactgatggcagctaaaaattattttgctaccagagtgccctcagaagtatactcttatctaatggatcgagttattatgataactgtggtaatttgttgttataaatagcagtaacataggaaggttttggtaacttctgacaagaaatttgatgtagagagttaatttcgagcacattaaaatgactgtcccactcatctcttcagtgctatttaaaagccagcccaagaagcaaatacttgagaaatcaatagtaggggctttaattttgaatatgatagacattaattcattttaatgagaccaggtcagattgcctcatcactctcagatggactagaacattatatagataccaagttcagttcacatctaaatatttaaagtctactattaaaagaggtttcctggccgggtgcagtgactcatgtctgtaatcccagcactttgggaggccgaggcgggaggatcacctgaggtcaagagattgattgagaccatcctggccaacatggtgaaaccccgtctctactaaaaatacaaaaattagctgggcatggtggtgtgcgcctgtagtcccagctactcgggaggctgaggcaggagaattgcttgaacccgggaggcggaggttgcagtgagctgagattgcaccactgtactccagcctgatgacagagcgagattccatctcaaaaataaataaataaataaggtttcttgtgctttctatgactgcatcagaacagagaatgtcagtatccaataggatgccagtggaattccctgacgattccatccatgcggctctgctggagcagggtagtgtcctaggctgggagaatgggatggagcctccacctcatgaagtagcttcctttggaggtggctatggcaggtcttcggagaggtaagtccctcactcagacttgttgcttgagatgtactatattactgattctttgaaaataaatcattcttatattttattcctctttacaatgaccttgctctagaatcccaagttgcttttttttctatcctgtgttccatggctgagcagtctattgctattaagttgttgtacgtatatatttttctatgcatatatactcattttttgtttttctatacatatatacttattctctaggaactctttcgtaacatgtttttttcacctgacagaaaatgaaaaattttccctgttcttacagtcacttcttcctcatgtattcttttttgtgtgtgtgtttgagatggagtttcgctcttctcgcccaggctggagtgcagtggcgcgatctcggctcactgcaacctccgcctccctggttcaagcaattctcctgcttcagcctcctgagtagctgggattacaggcatgtgccactatgcccggctaattttgtatttttagtagagacagggtttctccatgttggtcaggctagtctcgaactccagacctcaggtgatccgcccacctcgacctcccaaagtgctgggattacaggcatgagccactgcactcggcctcatgtattctaataattaataatgtaaattcataaaaaggggcagccagcttaaactacagcattgctggacaccataaaatagtatttgcatagctgtatactcacaaactgctactcaaggcttgctttgttcagaaggaaatctgtgttcacagaagctgaaccctgataatagctgttggctcaaattaagggtcacgtcctttggcacttagcgctattctggcaggagtggtcaaatccttgatgtaatgggtcttttctaagtcaggccctctgatctccaactcctaaagaaataaactctggtcaggccatgtttttgaagagaacgtctaaggaacaattgctgctttacacagataaagagctttttactgcttaaagcaaatcatgtaactctttgttcatcaacacaccaagggaagtttctgtgaggaaatcagtattgaatagtttgtactttatacatgttataagaatgtacttttcgggccgggcgtggtggctcacgcctgtaatcccagcactttgggaggccgaggcgggcggatcacgaggtcaggagatcgagaccatcctggctaacacggtgaaaccccgtctctactaaaaacacaaaaaaattagccaggcgtggtggcaggtgcctgtaatcccagctactcgggaggctgaggcaggagaatggcgtgaaccagggaggcggagcttgcagtgagccgagatcgcgccactacactccagctccagcctgggcgacagagcaagactccgtctcaaaaaaaaaaaaaagaatgtatttttcggcctggcgcaatggctcacgcctgtaatcccagcactttgggaggccgaggcaggtggatcacctgaggtcaggagttcgagaccaggctggccaacatggcaaaaccctgtctctactaaaaatacaacaacaacaaaaatgtatttttcttccactcccattgccagtatcaccagagattccaactccatccacattttggtctcattgtttcttttttttttttttttctttttcttgagatggagtctcactctatcacccaggctggagctcagtggcgtcaatttggctcactgcaacctccacctcccggattcaagtgattctcatgcctcagcctcccaagtagctgggattacaggcacgtgccaccatgcccacctaatttttgtatgtttagtagagacagggtttcgtcatgttggccaagctggtcttaaactcctgacctcaagtgatcagcccaccttggcctcccaaagtgctgggattacaggcatgagccaccacacccagcctggtctcattgtttcttaactctggtctcatgatttgttgttgttgtttgttttcgaaatggggtctcactgtgttgcccaggctggagtgcagtagctattcacagtggtcatagctcactgcagcctcaaactcctgggctcaagcgatcctcctgcctcagcctcccaagtagccgggattacaggcatgcaccaccacacatacctgattttgtgacttttggctccctatgagatggccaacctttttgattagtttcaggattttaaactttcaagttcctcattttgtccacaacctccttacctgccccactcctttaacccaaccaccactgggttaaaccaccattgacctgttcttagacctatcccttcctcacccaggaagcctctattgacctttcccatctgactttgcttgcctttctccctaccctgcctctcaaagcattcatgggagggatggcttcaatagcagtgcaaattctttcatactttttacctcctttggtctccatcttttcagttctaaaccttattttgagtagccacaaaccattccactttctccactcctgtataccatagtattgctagaaaagtcatgaaattcccattaatttcctgaaagagctctcccaacctttgcagtcttaactctgcaaaggtaagttgcaagcagctaatctcctggagccttcatttccttttctgttaagtggggaagatgggccatcacagtgcttctcaaacttaataggcatagaatcacctggggatcccactcaaaatgccagttctgattcaggtctgacataccccgtgatgccaatgctgcagactgtaatttgagaagtaagggcctcagtgagctccacaattatataaaaaatagtaacaaaacaacacctgtgagtccaagtcctgagtcagtctcatcattctcacactcagcagacttaactggaaactaaaagccatctgttatgaacctcttcatcaatgtttgccttttccaataattttcctctcctgaatcttttctcccttttcttccctaggttacttaaaaagaaatttttttttaaattataaaatagagacaggatcaggttggtcttgaactctttgcctctatcagtcctcttgccttggcctctcaaggtgctaggattacaggcatcagccactactcctggccctaggttactttttctacctacatccacgctgttccttctttctgaattgggatcttgttctcagttaatccctttcctccagctctttcccatttacttacaaatacctttaggctctgactggacaaaactgtgctttcccagggatagtttcatagcaacattctcaaaagaaggcaccatctctgccattggtttctttccaattccacatttgcagctgaccaacttcacctgagacactcaaactgaaccactttgaaaacagcttattcataatagtgtaattgacaataatgaaattggaagtaactattcaaaataagggaagaagtaaataactgtaatttaattttttattttttgagacagggtcctgctgtcacccaggctgatgtgcagcagtgtgatcatgactcactgcagccttgacctcctggactcaagcaatcctcctgcctcagcctcctgagtagctggtactactggcgcactctaccacccccagataattttctaacttatttgtaaattaaaaaaaaatttttttttttacagacagggtctcactatgtttcccaggctggtcctgaactcctggcctcaagcaatccacttatctcggccttccaaagcgctgggattacaggatgagccattgcacctaacctaaacgtaacttttaacgttgcaatgattaaaatgatactttgcactttgggaggtcaaggcaggaggatttcttgcatctaggagctcaagaccagcctgggaagcatggtgagattccccccatctctacaaaaaagacaaaaattagctgggcacggtggcatgtgcctgtcgtctcagctactcaggaggttgaggtaggaggattgcttgagcctgggaggcacaggttgcagtgagccaagatcgagccactgcactccagcctgggcaacagagtgagacccacacagcctgggcaacagagtgagaccccacagggtcaggctggagtgcaaaggaaagatctcagctcactgcaacctctgcctcctgggctcaagcggttctcctgcctcagcctcctgagtagctgggactacaggcgtgcaccaccacacccagctaattttttgtattttttagtggagtcagggtttcaccatgttggccaggctggtgtcaaactcctgacctcaggtgttcactcaccttggcctcccaaagtgctgggattacaggcgtgagccaccgtgccccaccgatactttgtacattggcatagaatcaatgaaaaagcagctccaaaatagtatgtctagtaagatcccattttttaaatgaaggaaagaaaatacttggctggtcaggtgtggtggctcacacctgtaatcctaacacttcgggaggctgaggtgggagaatcttttgagcccaggagtacgagaccagcctgggcaacacagggagaccctatctctaccaaaaaaaaaaaaaagagagagaaagagaaaaaatacttggaggaaaatgtctggaaggaataacatttcattgattccacaatgtcaataggtatctctggatgttgggttgtggatgatttttacttcatcttcttcacagtctaaaatttttgcaataggtgtaataggatgttagactagaactcttttttttttttttttttaggagatggggtctcactctgttgcccaggctggagtgccgtgatgcaatcatagctcactgcagcctcgacctcctgggctcaagcaattatcctgcctcagcctcccaagtaactgggaccgctggcacacaccctataaggtggacaccaccacacctggttaatttattttttgtagataaagggttttgccatgttgcccaagctggtctcaaactcctgggctcaagcaatcctcccaactcggcctcccaaagtgctaggattatagataggcatgagccaccatgtccagcctttacaaattttttgcagataatctcttctttccattcctattgctgcttaccccagttcaggccttcaaaaactttcacttggtctattatcaatagcctcctggctgatgtccccaatgacagttcctcataaatacagctacaaggtttatcttcccaaagcataattctagtcttgccactctccttgctcaaaaacattaaatgtctccccgtagccttccaactagatagagcataaattccttagcttagtatccaaggccagctcctttcatttgtaccctaatccaaaacattttttgagtcatacttaggttaggctattgcctagcttgccctaaacacaggatcttttttcttcctctgcttgtttatgccactcccattccatgttgcattgtggtgcctcccatattgctcctaacattgctcttaacacacctgttaagagttctccctgttctaagctgagcttggacatgcatcttccaacaggtagtcttacattccctttggcccgtgagcatataaggtcattttctcatctgtgctgctctgttacacatttccttgtgtattacggactacctcatgttagctttgctttcattcatgtttcatctccatggaactctggtggggacgctgtcgggttcatctgtgtgtctcccagagcagctagcccagcttcttgcccaaagagggagctcagtaaatgttgaattactttggagaatttgtttgaaaatatcttcctgatttttacctctaatgcctacttctcctttaagtgaatacccctcttgctccttggtcttttgtgtgtgagctggctaagtgggaacttaatctgtggtgtctgatgcctcactgatcctcaaaaaaacagtaacttctcagtgccatcctctataatcatatgatatcttcagtgaattaaaggtttattcattagacatctactctgtacttggtactgtggtaactgggataaaacttgctatgtacttgtaagacatcatcccagagtttttaatctttggaatgtttcagtgcctaaatctgctgtctgtggttgatttttggaacttgcctttgtttcaccattatggatgaaatacatttagagtgaagtttgaggatctcagctgaggttcatcaagtcattcaaaagcaagtagaaaataaaactggagtcaggtgcgatgactgtaatcccagcactttgggaggccgaggcaggaggatcacttaagcccaggagttcaagaccagcctgggcaatatagtgagacattatctctacaaaaaacttaaaaatcagccaagcatggtggtgcatgcctgtagtcccagctacttgggaggctgaagtgggaggatcgcctgggaggcagaggttgcagtgagccaagatcgtgccactgcactctagccagagtgacagagcaaaactctatctcaaaaaaaacaaaaaacaaaaaaaaaaaccgtagcacactcttgcttttctatcaataactggactctcaagaactggtttctaaattagtgactgaaaatattggtcaaaatgatcagaaacctcattcatttgcattttctctctccctctctccaattaccctcaagagaatttggttcattctgagcatcacagatgacttaattttgtggtaagaaaataggaattagagtcagccaattaggaaacctcaaggaagaggaagtgtctctaggctaaagggaaggctgttgagtcttatttcctctctgttcttgactcactttcttagtgactggccaatctctgcacctccctttccccaccttcagggagctgagggtgggggtggggaatagagtgaataaagtctaaataaagttcataaagatcccaagatgtagggaggtaccatgaaataattgatcttgcagttccatcccccatcaacattcatgggtgaaggctgcatgtgtgtgtgacacgataggtaagaattagctgctttccaaattaagacagagtgagtttcacttctgaataatagcagtgtgcagtgcaggcccatgcagtacctatttggtttcattctttactagggatagatcaaagcgaaatagccaacaattcaggccttattcatcagtgcgccccctcctttcacaaagaagctgagttccagtcaaatagtaggtggcttaatttcaccgtagtggacttctatgccttttaaagtgggtacagcatactcacctgtttgagagaagaagaaactgagattatggtcaccaagtaatctgtggcaaggctcagattcaaacccagtgctgctgacactcagagcagaacctgaccattttcaaagttcacaatatgaccgttcgcttctcccacccttccccatcttatttttcactggaacatttgctgttctctcaagctatgaagggcttcctgtgttaacatgcctaaggggaagctgtatgttaaaaaccaccaacggttaagcccaagccagctggggtcttccgttgtttcttccagtattgtggggagacccatgagaattctcagtgtttttcaaagtccttggcttccagaaacaagaagctgagcatcgggttttcatttaagacagagcttggaaaaacaagaaatatcaaaagccgtaagaggataatactgaagttattatagctaaaaaacaagggtgaactgaaaagctaaaggttttggctctatagaggggttcatgtatagttgtatttaaatgtcctttgggttgaagtgatacaagtttattccctctcaaaccaaaggacagcatttattctggggaatggctgagataatccaggcccagaaccacactgactggttagtaaggggatggcacagaagggaaatgatagttgtgtgacttctatgttgctaaacactgtattgcatccaccattggttccagagggtagaagaaccacactagatgttacagacaagggggcagaggagggttgctttattggaatctggggtttgaagggcttatgagaagcataacctcatgtaagttgcctcatgtaagtcacagaagtcacaccccaaaccacatttggtgctccatttgtccgtttcctttacccataaattatagaactagagtagagaaagtacccttttctcctcctccaacactcatccagaatgactgaagtcctaggtagccaaccatagctactggggtgcaagaagaactgaaggatctgagaaagacaaaaaagggaaagatacagagccaggttcttgtcctcagggaggaagctctgaattagtgaaaatctggccagagagctgggcagagtcctacgtccctttctttacccagaactgctacatccctagctctgtccttattacagctgtcctttggggccccttaacatcaggatactcctctaagatgctgtattgcaagtggccaactcacagggcactgtgtttcaacccctgctaatatcatatggaaacacaaataggcttctttttttttattccctggctcactgaaactgccggcagagcaccttaagctaagggctacattcttatcttgcctttaaacaccatgtgattcagcatgtctgcagtctctgggaatctacactgccactttctacctttgccttgtgggtaacccttaccttccacctacctccacccccaggggagaatgtg

SEQ ID NO: 1169 - DNA, 5709 bp, Homo sapiens
gcatcgtgggcactgtagtttccgccgcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcacctgccttcttgcttttaagtagccccaaaagcagaaccttgatttgtctgtaaggaagaaacacaaaccttttaaaaagttccacttcgactctgcaccgccgacccccaatctctttaattttgccatagaagaggggttttttcaacatctctctcactatctggtgctgatctcactgcataatgactttctatttgtttggtattcgaagctttccgaagctttggaagagcccataccttgggctaggcccagggcactcttatgtctcgctgtttctggcagaccgctgtggcatcaggaaccagcagaggttgttttctcttaaaacaatgtctccacagaataccaaagcaacgaatctgattgccaaggccagatatctcaggaaagatgagggcagtaataagcaagtttattctgttcctcatttttttttagctggagcagctaaggagagatcacagatgaattctcaaactgaagatcatgccttggcacctgtgaggaacactattcaactcccaacacaacctttgaattcagaggagtgggataaacttaaggaagatttaaaagaaaacaccggaaagaccagtttcgaaagttggatcatttcacagatggctggctgtcatagctctatagatgtggctaaatctctgctggcatgggtagcagccaaaaataatggtattgtaagttacgatttactggtcaagtatttgtatctctgtgtctttcatatgcagacatctgaagttattgatgtctttgaaattatgaaagccagatataagactttagaacctagaggttacagtcttctcatccggggattgatccattcagacagatggagagaagcattgttgctgttagaggacatcaaaaaagttataactccttcaaaaaagaactataatgactgtatccagggagctctccttcatcaagatgtaaacacagcttggaatttatatcaggaattgctaggtcatgatattgttcctatgttggaaactttaaaagctttctttgattttggaaaagacataaaggatgataactattcaaataaactactagatattctttcatatctaagaaataatcagctgtatccaggggagtcatttgcacacagtataaaaacatggtttgagagtggccagtgttcgggctgtggaaaaaccatagagtctattcagctgagtccagaagaatatgaatgtcttaagggaaaaatcatgagggatgtgatagatggaggtgaccagtacagaaagacaacacctcaggaacttaagagatttgagaacttcataaaatctcgtcctccttttgatgttgtcattgatggtctcaatgttgccaaaatgtttcctaaagttcgtgaatctcaacttctcttgaatgtcgtctctcaactagccaaacggaatctgcgactgctggtcctaggccggaagcacatgctaagacggagttcccagtggagtcgggatgagatggaagaggtgcaaaagcaagccagctgtttttttgctgatgacatctcggaggatgatccattccttctgtatgccacactgcactccgggaatcactgcaggtttatcacaagagacctgatgcgggaccacaaggcctgtctgcctgatgccaagacccaacgcctgttttttaagtggcagcagggacatcagctggcaattgtaaataggtttccaggatcaaaactaacctttcagcgtattctcagctatgacacagtggtgcaaacaactggagactcgtggcacataccatatgatgaagacttggtagaaagatgttcctgtgaagtaccaaccaaatggctttgcctccaccaaaagacatagagattcttacctctatgctaagtttgtgtttgggtaccctctaggttggcatcagaggctcttgagctggtgtttgtttagggcattgcctctgtcctgaagataaaaggattctattaacagcattgacattgattttttaatgaaatgagatatatcttttcataaccagctgcgtttttttcccctaacatttgtttttggaggcttatcaagagttggagaacttagtgtagagcaaaacctgcatttctcctactgggccagctattccacttagcttgggtgactaatagtgcttttggtatccattttttgctacttctgaccttgccttccaggcctaccaatagcagaatcaatccatctgtccctgagatactcatgttgtttcaaatgcctcctcccatttctggcatagtctcattctctgtatgttatgccctatccacatggaatcatttatcgtcctctgtaataaactggccaagatactaaaggcttactattcatagcagtttttaattacttatcatccaattatttggattggagaagagggggcattcactcctctttttcttattttttttggaaatagagtctcaacttactctcctgggtgacagagcgagaccttgtctcaaaacaaaacaaagtgctggaattgcagacttgagccacagtgcccagcctcacttctctagactatgatggttttttcttcattctataatctcttttccaaattggttcaacattttgtgaacactattaatttcatcattcagtatatgtgggctttctaaaatatgccaatttttttccacttaatcaagtttgacttaatttaacaaagtgattatattttaatagttacatttctgttttttccactcactagccagcttacagtttattagcccttgatttcagctgaaaatattcatgtctgcaccccttcatgatagttctttctttacgtatacatactgtattcaatatgcaagaacaggcaaaaactactctattgtgataaaaatcagaatagtaattgcctgaggaaagggatatgagagaacttgagagaactttctcggggtgatggaaagtttcttatattgatttgggtaatagtaacatagctatatgtatatattagttaaaattcctcacactaaacattttaaattgatatatttacatttatgacaatatacctcaaagtaagttagggtaagaaaagataattacttacatgaaataaacaatgacctcttttatatcaaaccatatacatgtgtataattagggtatgtattatgcacagagaaacaatttaggaaaatccaaggaggggacgttttatcttcttacctatttactgaatgcaacattactgcacaccaagacaaaagagctctccaggaaaacattggatatattgagagcattaaaagatactgcaaaagctctaataaattcagtctgcttattttccaaatttcataaactacatacttaggaaactgtgctttcagtgagctaaacttctttttttaagtaactatcatagttttaagaaaaacattttaagaagacaaaaagtatttattaagcccatctaaaaggctaatgcaaattcccaaaaaaggagcacatagagatagaggaggaggccgaagtggtggctcatacctgttaattccagcactttgggaggccaagacaggaggatcactttaggcccagagttggagaccaacctgggcaacatagcaagaccctgtctcttaaaaaaaaaaaaaaagacgggagaagctacaagaagaaaactagaactttagagcaggagtaaccttagagcatgtaaagtccattttggagatgaggaacagacccaggaagatgacctggcttccctgaatcccacggctagttagtgcagacatttcagccataacccagctcttctaattcccaaatactctttcttctactggcacatagagatgggggaggagtcagggcatggtggcccacacctacagttccagcactttgggaggccaaatgggagaattgcttgaagccaggagttggagaccagcctaggcaacacagggagacccgtgtcgacaaaaaatttaaaaattagctgggcatggtagcacatgcctgtggtcccagctactcagaaggctgaggtgggaggatcacttgagccccagaggtcaaggctacagtgagctatgatcatgctactacactccagcctaggtgacagagtgagaccctgtctcaaagggagggaggtaagaatgagaagaaggaacaggggtgtacctcttttaagggcccaagtatcctgaatggctcagcagtatagaacattgtggtagagaaattacattttaaaataactctaatactgtttagaaacaaaaccctaacttctgcttgagataaactgaagtgcatctgtcccttgtccaggagtggggaaccattgtagggttgctcagcataagtcatactgccacggtgaccttgaggagtgcagggattccctgaaggaagcagctggtaccagacacttaggctgcccatttgtgttctgatcatttgagtgaaaaaaaggtacctgtcaagcaagctcctggacaccacaagaaggaggaattattttaaaagctgtactcttaaattgttagtatctttaaaatcagttgtgaacaatgaaggatttgaaagagcattgactttgccacttaaaagtatttctaaaatactttgtgcttcccccttgcattctgaatttatacacttttcctcctgctgttctcagacccagtggaaagaaaatctcaaggaagaaggctgagtttattctctcagggctctgttgggtctacctcatctgaggtggcttattcttcataggaaattaatttttcttctcaagtatgcacttaaatataattactgcttccttggtcctctagcagatttctcacttttatttatttttttttttgagacagagtcttgatcttttttcatctaggctggagtgcaatggtttgatctcagttcactgcaacctctgcctcctgggttcaagcaattctcatgcctctgcctctcgggcagctggaattacaggcatgcgccatgacgcctggctaatttttgcatttttagtagagacgggttttcaccatgttgccccggttgctctcaaactcctgacctcaggtgatccacccacctcagcctcccaaagtgctgggattacaggtgtgagtcaccccgcacagcctgaaatgaggcatctctatctatagtccagcagccctacaggaggcaggaggggagcaagaataagaaaggaaatttgtaaaaggcacttaggagtgagcagaaaggaaataggaccagcttttacctgcccagtcctggccagtgacaagcagtctgcttgagtctgtgctaaataaacaaaggaagttccatttagagctctacagaggggaagccatagaaattaacaggatgaaaatacaagagacaggaacacagatgaataaatgtaataaaatttgagaaat

SEQ ID NO: 1170 - protein, 567 aa, Homo sapiens
MTFYLFGIRSFPKLWKSPYLGLGPGHSYVSLFLADRCGIRNQQRLFSLKTMSPQNTKATNLIAKARYLRKDEGSNKQVYSVPHFFLAGAAKERSQMNSQTEDHALAPVRNTIQLPTQPLNSEEWDKLKEDLKENTGKTSFESWIISQMAGCHSSIDVAKSLLAWVAAKNNGIVSYDLLVKYLYLCVFHMQTSEVIDVFEIMKARYKTLEPRGYSLLIRGLIHSDRWREALLLLEDIKKVITPSKKNYNDCIQGALLHQDVNTAWNLYQELLGHDIVPMLETLKAFFDFGKDIKDDNYSNKLLDILSYLRNNQLYPGESFAHSIKTWFESGQCSGCGKTIESIQLSPEEYECLKGKIMRDVIDGGDQYRKTTPQELKRFENFIKSRPPFDVVIDGLNVAKMFPKVRESQLLLNVVSQLAKRNLRLLVLGRKHMLRRSSQWSRDEMEEVQKQASCFFADDISEDDPFLLYATLHSGNHCRFITRDLMRDHKACLPDAKTQRLFFKWQQGHQLAIVNRFPGSKLTFQRILSYDTVVQTTGDSWHIPYDEDLVERCSCEVPTKWLCLHQKT

SEQ ID NO: 1171 - DNA, 21635 bp, Mus musculus
  misc_feature (1)...(21635): n = A,T,C or G
agactattgggagctggtgagggtctccctatgcttatgaattctcactgggaaggcatagtaattctagaactgtgtgtttatgtatatgcattttcaaatgtttgtgtgatgcagaactatgccacctcccctgtaataatccattcaataccctcaggggaaaacaaaaaataaaaaccctctgtaactatagtgcactccagttttggctgatgcccaaggaggagccactaacagaagagttcactaactcagggccacgctaggtgtgtgaattccacacacaccccatcatccttaaatctctctcaggtacagccctgagttgtattttgaactttatttatttatttttgagagctttttttttttttttttttttttttttgtagccctggttttcctagtacgctctctgtagaccaggctagcctagaattcaaagctttacctgcttctgtctcttgagtgctgggattaagtgtgtaccaccactgccctgtgactttaagcaatttaaacagagacaggagactgcaattctgaccgcttgggcagatggaagacttatacagcaaaaatattgtcaggattatttttctttcctggctgtcctggaactagatttatagaccaaactggccttgaatgcagatcctgcctctgcctttaagtgctaggattaaagcatgtgtcacaatacctggctgcaggattatttaagtgcccctgggctgttcctttggagtgcttgctacccaggtccattctacccaccaggcaggattatgcttttcttggtaggagggcaggggacttaaaagattgaccaggacttaatggaggctgtgaccctgtgctgccccccttgagctgccccctagaggactgttctttgaactgggatagttgtattctactttgtgtaccttaatgtttcctaaaggagtttattagtaggtcctctataacatcggttttcctgaatcttgtgcccgtgtatataggttcctgtggagacctggtgttgacggcctctgtcctctcaatcacctccctcccataaggccatcctccccctccccaccccccatacataaggcgtatgtgggcaaagccatcttggagagggtgacaattgaatcaccctgtgagatgggggaccatccagacatctgagtgaaaggcctttcgataggccaagcaggcagtgcaaatcccctgaggctcctgcacttccccaggaacaaagtggaggtctgtggtggttacccttcgttgtcagcttgctgggagatggagtcacctaggaaacaagcctttggacacacaggagagctatccaggtcaggcaaatttctgacctctcctgttgggttatgctaagtagggcaagtgagcatagcggaccagaaccctaagggagggatgcatcataccctgggtgacaggtatagaatgacctgctgcagttggaactcccctgccacagtggactgtgtcatgcatgacctgtgagccagcttggttttgtcaggccattaaaacaaaacaaaacaaaaaacaaaataagaaaaccaggcatgcatgtgcctttaagcccaggattaaaggatagagttgtgtcatgttttagacaaaaagagggaagaagttaggtgacgggctgcagtcggtcattatgacttgagggaagatgaggtcagccaagggaggccagattaggtccaagtgacagaagccggaagctggggataagtggtcagattattatctttgcattttaaaaaacatcatattttatttttaaaaacccagacttactgagaagtctacagcagatgcccagagcctcttcatgtgtttccctactgaatgaaaatgaggacattgtagctatgagggagaaaacagccagaggcgactgcaaaggtccagactggagagggccatgagggaagaagaagagaagagagtggggccaaagagaagggaccaagagagaacacgtggcagaatgactggttctataggaaggagctgggggaggggagccctggaggcccaggggctagagaggtcgggtaggggcttgggtgatcagtgctgggaggagccaggtctctactagggacttgcaatgcagggaaagcccagactgccgccgtccagtttgatatgttattaggcccctcagccttttgttttaagtttttttgggacaaatgccccccctggcctcacttttagctctcacattagtattcttaggggttttttttttttttttttttttttttttttttttttttttttttagttaaaacccttagtgtgtgcctgtgctgtgtgaaccttcaagtgcatgtgtctgccatgtgtatgtacaggccagagaagcgtgctgtaatatcttcttttctctcccccactatatccttgagacagggtctctcactgtacattttgctgtttttttggctaggctgactgaccagaaaaccccctcaacccttctgtctctgtcccacccctagctccgagaggacggccatgtgcacccatgtctgtcattttctgtgtgtactgaggagccaacctctcgggcctttacgctggcacaggaagcacattgtgccatcttctccagccagtattaattaattatctataggaacaatttaagaggaaatgtgccaatactgcgattattcactcctttatactaaaattagtatttccaaaggacaaagatgttccctttcataacccattaacatattggtcaaaatcaggaaggctaataccaattcaatactattttctaccttataatctatattaaaattttgctagttattcagatgatatcctcaacagcttatttgtctgtttatgtagtagtgatgcgattgagctacggcctcgcctgtgggggtaggtactctcctgaggcacttctatgcctgcttgataacagtttttacttcatctaagctatatggcagtcagctgtctctgctttaagacctggaagaatatccatgtccccccttttcctctctgacttgaagagtaccagctgggtgttttgtgaagtgtttttcgcatcgtgtaccatgttggttttttcttttcctttgtatgcgcgagtggtgggtggggtggagtgggtggatgtgcacacgtatgcagacagctagaaggaccacagacttcctgctccattactggcctgctctatgccgggagataaagtctctgactgtaatgagtactgtagtgtgtcagcttgatgggatctagagtcccctagaaaacagcctctggcacacatcttgattaaggtgaggtggaaaggcctaccctggaagcaagcttcaacagttccgttgccttgggtcctgagctgtacaaaaggcagaaggaaggaaggaaggaaggaaggaaggaaggaaggaaggaaggaagagagcaggaaccctgggccttcagcttcctgcctaggattcaaggtgagcagtgctctcaagctccagctgtcaagacccccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagagagagagagagagagagagagagagagagagagagagagagagatgcttttagtccaggttgggctcaagtgaccatgctgctccagccttgaaagtggctaggaccataggtctgagccactgcacctgacacacatgtatgtggaggtcagaggacaacctcaggtgtcattcttcaggtaccatccaccttttgtttgatgcagggtctctcactggcccggagcttgctggagtaggttaggctggcaggtatcagaatgtcttgctgtgcccagggctggggttgtaggcataccctctcactccttgcttggtttttgttgtgttttgtttttaatgcatggattctgaggatgaacttagggcctgatgtttgtaaggcaagcaagctgtcctctgaactcatgcctgacacttcatttgttttctcttctttctttcttgtttttagattcacttttctacttgtttcttttttgagacagggtctcaagtatgtaaccttggctggtctgaatcgagttcactgtgcagaccaagctgatcttaaactcatagatatctgcctgcccagcctcccaagcactgggattaaaggcatgtatcaccatgcctgatctcactttattttaaagtatgtgtctgtgcctatgtgtgcatgtgagcagaggtgcccacagaggccagaggcatcagatcagctgacgctggagttacaggcctccagatagggatgctggggccaaactcaagcacaaagtcttaactgcagaggcatctttccaatcccacttcctatgttttaatggttgacctaatacacagctttgagtccttatggcatttctatcagaggtcgttgatataagtttgtcctattattgttaagtttggatatttggttaaggtggtatctgctagatatttttccaccctaaagttcctagcttccctttttaaaatcagtctgtttaggactggagagatagcttaaagataaaaagtgcctgctgttcttgcacaggaccctgttcagttcccagtgccatatctagcagctcacaacagcctgcgattctgatctcagaggacccgaagcctctctgctcttcgggtgtctgcactggtgtgcacacacctgcatatagacacacactcatcatacacatagcttttgttttgttttgtttttaaagatttgtttgtttactttatgagtacactgtagctgtcttcatgcacaccaaaagagggcatcagatcccgtttcagaaggttgtgagtcaccgtgtggttcctgggaattgaactcaggacctctgaaagagcagtcagtgctcttaactgctgagccatctctccagccccttgttttgttttttgagatagggtttctctgtgtagccctggctgtcctggaacttgcccaaatgcagtggcagctcgttaacttctccttgtgccttgtttagtgtagctaggcttgctgcagggtgttggggaaggaggcagactgctctgggcctggctgatgggtgtggccctgcccccacatctcagtctcctcatggtctccctactgtgagccttgcctcctgatgccagctttctcagccaggccatgtctgtcagagcctggattcactcttttcctctctgctgtccccagagtcaagggtgactgatattcaacagacattgataatgccctcgttcaactccatcagccccagtttgtttgaaatgactattttgccaaacataattttttgccttagtaatttttttctctctaaagttgggtacctttgttatcttcgaacattttcccctatattctacacattttgtaaaaaaaaaaaaatattttatatgtatgagtgttttccttgtatatgtaccaggtgcatgcctggtgccagaggtcagaagagggtcccacctcataggatttataaatggtcttgagctaccacatgtacgctgggaatggaacccgaatcctctgcaagagtagccagtgctcttggtctctgagccatctctccacccctgtattttatccccttattaaaaaaaaaagacaaaaaactgtaaaagatttgttttgtgttgctggtgtgtatgtacatgcacaactggcagatgttagaaaggggcaggcgggctgccgtgtgagctcaagcgactgaaccagggtctgtccaagagcagcaactgcctcactctctaagccttctcaggcctagtcctacagtcttaaaacattttttccatctctaattaacagttgctaattctttgcagctggttgattttctgttgacagtggtataagaaacacacacccaacagtggggtgctatccccccatcttcccatacttccattctatcccttctttcctccccccattcttcactccattctctccctcctttcctcctcccccatctcttttttctttgtttgtttttgttgtgttttgttctgtttttttcgagacttgtttctctgtatagctctggatgttctggaactcactctgtagaccaggctggcctcgaactcagaaatctgcctgcctctgcctcctgagtgctgggataaaaggcgtgtgccaccacgcctggccccatctcttcatctctttcctgtttgctctctctgacccctccccacttcccccacctctactcctggctgccccaccctgctcccccacaccctgccccacccacttcctcccatccccactccttttgctcccctgcctcccacccccattctctctcttctttttgagacagggtctcatgcattacaccatggccttgaagttactatgtagttaagattgacttgaactcttgattctccgacctttccccccaccccccgaccccatgggaggactatagtttcctccatcacccccagtcttccttgttgaaacaatacatggctggagagatgtctctgtggttaagagcactggctgtccttctggaggacccaggtttaatcccaccacaaacatctaaagttccagggacatctgatgccctcttctggcctccttcagccagcaccacgtgcacacagcacacagacattcatgtcagcaggacacccagacatattttaaaaaaacaaaacaacataatcacagagaaataatcagggctgggctggggatatagctgagctggctgagaaggtctgggttccatccccagcaccacttaaactggggtaggtgactgccacccccaaaatgccagagccaaaggcaggagactcaggtcatcctcagatacagattgagcctggaatacacaaaccttatgtaaacaaacaaacaaacaaacaaacaaatgcccccaaatacagaacataaaaatatggaggaaagaaaaccaagagcatttcctgagctttgttttaatcaggaaacttgggatactacgtgaacactgttcctcaagagagatgacttctgctgcgatgcgtgccatgacctatcaggcagttgtgcagagatgctctgaactaacattccgtcagtgcacagtgggatgcggagcctgcacacccagccacagggacaggagtctcagctgctgctgagtatgtcactggttttgttgttgttttattgagacaggatttctctgtagagcccaggctgtcctgggtctcactctgtagaccaggctggctcacacacaaagcacccacatagatctactcccacttacttgggaaagtgctgggattaaaagtgtgtgctgctaggcttaaattttttatttttatttttaaagtttcagcctctatagggctgagatcacagcatgtgctgctatgcctggttgctataggtaacctttcttattatgtgagcctctctgttgactgttggaagaggcaacccagggggtcgaagcaacccccacccatgcttgctgggtgtgtctagaatgccaggcccccatcgctgtcccccaagccatttctagcatgggttacagtatacaagctgtactttgctaaagggacacagagtagcttgcttacttgtgctataaatgaagcaccttactgcaagcctggtattcctgggtggacctactgtgtgcaggatggaaatccgggccatttagtgtttcccaggactctgaagtaaagaatgaccaggcaaacgaatgtgtgtgctgcctgctggcctgtgagctatgccctgcttctgacctggatctatagctagattaactcagtactcgatggctacagtccaagtccagactctgtcagcaacctgctttagtccttttgttgttgttatagaatttgggcttattgagagattttaagatactttaaatttctttcctgttttggagatttaaaaatatagatctgcaggatctagggttaagagaaagaaaagtgttcagaaataaagacacgcctgcgagtgtgggtgtgggcccctcaaaggagagtcaccctgcttctctttctttatcattcacaaagctgtttttacagataaaaaccagttatgaatttttaaaaggaaaagctctgaaacagacatataccataagaatccgtttccttaatcaagtcaggtgacaagttattcagagaaggatcacatagatctccttacttggggcttggggatggctccgtgcggctctgtgaggttccatgcggctcggtgtagagcacttactcaagcagcactgaggccctgggataaatctgcataaaacaccccactcagctaaagactttttgttactttctttcttaaagatttattttatttatatgagtacacggtagcagttttcacacacacccagaagagggcatcagatcccattacagatggttgtgagtcaccatgtggttgctgggaattgaactcagaacctctagaggaacagtcagtgctcttaaccactgagccatctctccagcccatggttaattttttaatataggtctttctagaagttttcttttcttttttttttaatatttatttatttattgtatgtaagtacactgtagctgtcttcagacactccagaagagggcatcagatttcgttagggatggttgtgagtcaccatgtggttgctgggatttgaactcgggaccttcggaagagcagtcggcgctcttaaccactgagccaccatctcaccagccctagaagttttcttttttaaataaatctattattattattattattattattattattattattattattatgaacaactctgtagaccaggctggcctcgaactcacagagatccacatacctctgcttcctgagtcctgggattaaaggtgtgctccaccacacctggccgttaagtaaatcttaatttattttcatatttgtatatgagtacctgtctgtacctatgtgggttggtgcccttggaggccagaagaggacgttggatcctctggattatggggtggtcgtgagccaccaagctggaactgaacaggtctccttcaagggctccaaacctttcagccatcgctctagctctcctagttctctaagaccatagcatgtgcaatgttagtactagcttaaactgggggccacaggagtgacctcaattccctgtggctctggcagggttcagcagccctaaaaacctttcaggaccacgagcagagttgagaggttttccccggccctgcagctttcttggagctcttcggcaggaagtgcacccacagtctcagggtctcaggttctggccaaacagcttgaggagcaagggagggaaaggaaacggttctcccctccatatcttccactccacccctactccccatcactcatctctgacacttggactccagtgaaaacctaagaattcccgtctggaccccgagcatcctttcatgcctccactgaacccttgggtccccacaagcaactatgggagtaggaatgggtggggcaggatgcaggggtggagtgggtggagccaagacccacttcctttccccctggggctcagtctgccccagtcctgaccaagcctcaggaagaactggaggtacttgccctggccctgtgccttaaccattaatctggtaagagggtatgatcttgctgggtacgggggtggggatgctcagaggatgaaggaatgtacctatagtttgaaaagatgaatagggtgagggggtaagggagtccagagccacgggctggaacaatgaatgaaggccagggggacatggctgctctggagtctgagctgccaaggccagggtgggagtcactggcgccatctgttcccctgttgtctctgataatagtgaaagcaagaatggaaaaacaaaacaaaacaaaaaaaaaacgttaaaccacaagatgggcttggcagttggcagggaagtgggcagaaggagtggggctggccaagtttccctccccaaccgcgttcttctgtaacttccctacattcaggtcccaactcctgctcctgcctgtccctctggagatggccttgcaccttctcctcctctttggggcatgctgggtccaggtggcgagcccagacagtctgcagaggacgacgatgctaccatctaccccacatatcacagctccaagtacctctgaagcccagaatgccagcccatcagtttctgtggggtcagggacagtggactcgaaggagaccatcagcccctgggggcagaccacaatcccagtttctttgacccccttggaaactactgaattgtcttctttggagacttctgctggtgccagcatgagcacccctgtacctgagcctactgcctctcaggaagtttccagcaagacatcagcactgcttccagaaccatcaaatgtagccagtgaccctcctgtcactgcagccaatcctgtgacagacggacctgcagccaatcctgtgacagacggaactgcagcatctacatctatctctaaaggaaccagtgcaccccccaccactgtgacaacaagctctaacgagaccagtggaccctctgtggctacaacagtaagctccaagaccagtggtccccctgtcaccacagctactgggtctctggggccctcgagtgagatgcatggactccctgctaccacagcaaccagttctgtggagagttccagtgtggcccgtggcacctcagtttccagcagaaaaacatccacgacgtctacccaagatcccataaccaccaggtcaccaagccaagaatcaagtggcatgttactggtgcccatgcttattgccttggtggtggttttggccctcgtggcgctactgctgttgtggcgccagaggcaaaagcggaggactggggccctgaccctgagcggaggaggaaaacgaaatggggtggtggatgcctgggctgggccagcccgggttcctgatgaagaggccacaaccacatcaggggcagggggcaacaagggctctgaggtactggagacagaaggctccgggcagagacccacgctcactacgttcttcagcagacggaagtctcgccagggctctttagtactagaagagctgaagcctgggtcgggtcccaacctgaagggggaggaagagccgcttgtgggcagtgaggatgaagctgtggaaaccccaacttctgacggtccacaagccaaagatgaggccgcacctcaatctctatgagcaacaggtattcatccaatctgctccttagccccggatcctgctgttagctgccgcacactctgcatttgtgaatatttgtggaccaaatccgtccatccatccatccatacattcatttccttcccccccaccccccgcaaccccccagccccgctgtctcccacctccccttcctctgtgctttctttggaaccaattgctgaatcaccatgaggatgatcttagtggacccacattttccccgaggatcccccttggaattctgggatcccaacaggccagaaaactccctaggatgaagctgtgaagcccatgcactcacatccttctcagcaggggccccttcaggaatgcctctcaactaccatttgctttggggccagcttagagcctggatggcaacatccagcttgctcttgggtgaactgtgacctgtgacttttcccagagcactctgatttggggctggctggaagctgctggtgggagcctgccagagatccatcacttctccttgggttagggatgcggagagttcctggctggtggtgtaggtgtaggtggtatagtcccgcacctactgtgtccactcagaagtatggtttgtgtgcaagataggacaatttaggtgatggctgcaaacagtactggtgaatatagaccatgggagaaagcagggcaggtgctggtgagttccaaaaggagggacccaggagctgtaccctgtctgctgaagacctaagtgtgtctgcagcccccagaagaatgcaaatgtgatggggactaaatgtgccatcaagtgtgcgttcttcagctaagctgccatatccttccctcagaggctccctcacaccagctctcaccacgcccacaccgtgcacacaccagtaggcacacatgcaagatcgggagaggagtcagccaagtgcggtgactgggtggcacaaacccctggtgttgatgcttttctctacaggctcagttgtctgtttcctcttccaccccaaggctgaagtctttcccttgtcgcagggtaataagagagagttaaatgaaagacaggcccaaggggtgggacatggttgccagagagtccctaagggtctgaggtacagagaggggacaggtcacaattgtgctgcctctgaccccgccagcccaggcacgtggtccaaaggtggttgctggaggagatgtgcaagaggaagctgttgagtcagagggcgctgcccttgagaacagactgacctacagaaagagatgtgtgcgtgcgattgtgtgtgacctggatgggaaaggggaaggtgggagggaggggatgaggaatggaaagggacatggaccagttgctaccacatcaagctgccatcgttccctcctcgagtctgtggggaagagggaaggactgagctgggcacacctgggccacactgaacccatttctactgctcactaggcgctgtgtgggccagctacaacagagatggctcgagtgagttgccagtggcccttaagggacacagcaactgttgtggttgtttttgccaaactgtgtgtcctgatttcaggctcagaagaaaatatcgctaagttgagaggtcaatggcttgtttcactgccacttctaaggtgtttcaggctgtcaggtgcatggaggaagacaaggaaatggggtagagatggtggctagcacccaacaggacctcagcccagacagggtcagatgttctgggtgctaagtggaatgacagacaaaagtgtccacaagaggaacaaaactaggaagtggttggtattctacctctgaaggaagacaaggaagctgaacgcttgtcccggatcttggccacatctctcttcccagtgactccggtgcctggcaggcagcaagcactcagtgcatgtccccatgaatgaatgtatgtatgtatgtatggatggatggatggatggatgaatgaatgaggcattggcagatagcaggggaaggcacttaacacaaagactagtaatgcaaagtatgtaagtggagcagagatcatggtggacacagacaggtggacaggtgtccttcagctcgggagagagaaagcccagtgagtaacagatacggaaaaggcaaaaatagaagaaggaggaggaggaggagaaaaagcaggcaaacagaaaacagggagatgtaaaacagtttcaactccatcagttatgaaaccatagcttgtgtttgtgacatcctggcctcgtcttcagaaatgtgtaatgacctcagaaatgcctgtggctgacgtggggtcgggaaaattaaatgatctgtaaatacatctgtaagaagctacatcctgcgtgtttagtgtggtcctcctaaacgtggggaatttaagtgtgatttttcaccttagttttctgtgttttacacaataaatgtctctaatttcacagttatgaaaaacattggtgagggggctgggaaatggcttcttgattagagcactgctgttcttccaggctctgttcccagcaccttaagcggcagctcccaactgtctgcagctccagttccaggagatccaatggcctcttacgaccttcaagggcaccaggtattcatgtggttacaaatacatacatgtgggcaagatacccatacgcataaaaataagtaaatcttttaaaaattggtaaacagatgtttcttagagagccacggagggtatggttggaagagagctgtggagacagtgtcagaaggcttgagttgtcttctgagtgttgggatggaatgggtggggcatcccatctgtcccacagagccactgtggagagtcagtgccattcttcctcccgttgccaggcaacatgtctaaagacatcctcaaacttcccagtgcttgcttgcttctctggtcctaagtccgtgactctcccactagtcggtcccttctccccatggtcctttcttcaggtctcattttgcctgtgctttcctgagatccttgcataaccccacccccatgttctgttttatttctgtttgttctcctcctcctccccctttctcctctttctcttcttctagttttggtcttttgttttgcagtttttcttcttgttgtttgtttgtttgttcatttttttattttaagacatgaagcctgggatgtccaactgacctggaactgctggcctgtctccctctggctcccaagtgctgggattacaggtgtgcaccaccatagccagctattatttcctttgttttaagaaggaaaggtttattctggattacttatttttctttgtttgagacaggcagggtcttaccattagcccagatgtcttgagactcactctcctccaatgtcagccttctaagtgttgggagtacaggagtattcagctatgcctggacaaatttttattctattttgcactggtatgcattaattattcagttttgtgaggtacatatatatcattgatatcagtatatgcacaacgctgagtaatcacatcagaatgattaacttgcctgtccactcagatacttatttgtgacaaagtgttcaaaattttttctttgagtcattttaaaacataaaccatgagccagccctggtaacacaagcctgttgctcctggaacttgggaagtgttacagaagggtcaggagcttgaggccatcctgggctacatgagaacctgtctcaatatcaacatctgaaacccaaatagttcaacagctaaatagtcacagggctgaaagatggctcagccagccaggtggtgggggcacctgcctttaatcccagcactcagaggcagagacaggcaactctctgagttcaaggacaaccaggtctacagaatgagttccagagcagccagggttgttacaaagacaaagcccatctcaaaaaaaaaaaaaaaggatggcggggtaaggggggaggaaatggctcagtgcttgagagcactggctgctcttcagaggtcctgagttcaattctcagcaaccacatggtggctcacaaccatctgtaatgggattcggataccctcttctggaatgtctgaagacagcgacaatgtactcacatatataaaataaagttaataaaaaaacaaaacaaaacacctaaaaatcctggggtgcgtggcgctggaaagatgactcactggtaaatgcagtggctgctcctccaggacgtgggttcaattcccagaagctcagaacctcacaactgtgtgtaacgccaggtccaggggatcggacaccctcacacatgcatgcagacaaaacaccattgcacataaaatacaaattaatatactaaaaccatcttggtctacacagcaagttccagggtgggaagggctacatagtgagaccctgtttcaaacaaaaaacaaactcacaaagcatttttcctggttgagtttggcatccagggtccctgcagccagccatcatgagctgcccctgagcaggcagtaagggtctccatatcaggactcagagggcccagtgctccaggtcagagcaccttgggatcctgtgtaatgcttggggaatgaggccaggctggggtgagcctcgagcctcgaggacaggcagcatcctttaggtatctttccctggtaggatctccttctcagggaagggaaaggcaggggcctctgctggcctgtcagggtcagggctggaaaacccgtgggttctgtgatttgggatttcatcatttctttttcccttaagtttctggttgctttaactgattccatgtgtgtgtgtgtgtgtgtgtgtgtgtgtgtgtgtgtgtgtgtgtgtgtatctggttgctttaactaattctctctgtatgtgcatgtgatgagtgtgtgtctggttgctttaattaattttctgtttgtgcatgtgtgtgagtgtgtaggtctgtgtgtgtctgtatgtctatatatctgtatgtatagaatagaaaagggcataagatctcttggggctcgagtgataggcagttgtgaggtactccacgtgggcgctaagacctgaactctggtcccaagtcttcaccaccgagccatctctctggctttccaagctcagcttatttcatgtggtcctggggatggaactcaggtcccctcatgcctatgcatctagaaccttagcacccaagccatctcctcctacttttaaatttcttttaacctataaactttatcgtcagaactgactacattcatgatatcatcatcgctttgagctgtcctgtggatcgcattcttacatgcatcaaaactcacactgtgagctagagagatggttcagccgttaagaacatattctgctctgcagaggacccaagttcggttcctacacccatgtcaggtgactacaaccatctgtgactctagcccatggggactcaatacctggaacctcttatgggcacagcactcgtatacactccctaacacagatgcacacaacacaaatacactgcattttaaataatgaaaataaatcttaccaggcatggtagtgcatacctttaaccctagcacttgggagtcagagacaggtagatctctgagtttgagcctggtgtacagagtcagttccaggacatccatggctgttacacagaataactcatctttttgagatgcaaaaaaaccaaacacaaccaaccagacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaactaagttaggagaaactggttctttaggactgcacagtgggtaggagcctgaggtgagccacctagtgttctcaacagcgagttacaagtaggcctgtgtttccagctctcttcctatggtttgtgacatcaagacaggctggctgcaccttggccaagatcccagtgaaaacagaaccaatcgttagccaagagagccacctgcttgcctttgcgtttgtacaggctctgcccaaaaccagcccactgccagttgtccccacagtacactcgtgtgacttctcaccagactcctcctcaaccatgaagctctgactcaaatgtcagtccttagtgaagttgtccctttgccctgccccctcctcagacagactgtctacactcctacagcaccttctgtgatggcgcaaatgactaggctgtatggttttttggtttttaatttgttggtttgttttgggggacagtttaatatgaccaaggaatggctttgaactcactatatagcaagggatgaccttaaaatctctctctctctctctctctctctctctctctctctctctctctctctctctctgtatgtgtgtgtgttcctgtggagaacagacgacactatgttcatatatgctatacagacaactctgcaatatttccttgagacagggtttcttactgaacttggagctgtcaggcattggggccaggggaggcgaggctagtggccagaaagcaccagtgaccctgtatcttcacttcctcctcttcccaaggcactagggttacaggagagcatggccacacccaactttttcacatgggtgctgtgggtccagactcaggtcctcaagtctgcacagccagtgctcttatacacagagccatctcccgagtctgtgaccttgacctgctgatccccctgcctccacctcctgagtgctggcattacaggtgagtgccaccatacctggcatgtgcagtgctggggactgcagatgctcagggcactgagcaagcgagcccccgactgagttccaaggccaggctgtgtggctgtgagggtgtcagagcagggagccttccaacgttgcgctgcatcgtctttacagagagcccaacacccaggctgccgaatacagggttgctgcccagaggtgtaagcacaggagtgaattccaaaatactctctggagatgattagaggcctaacaatgagggctgcagggttggaaagaggtttctagttgtttgttgttttgttctgggtcatctccatctgtggcccaggctgggctcaagtgcccctctggagtagctggaattacaggcatgaactatggtgatccatttatgatcagctgtaataacggtgtggtggataaatagagaagttatatcatttactgcatacagctatgcgctgtgccagcagaaatgccccttgagtcagaatgctgacatttggggtctgtaggctataatggttagcctgccccgtaagcccagaaatcaggaggctgaggcatgaacccagcttgagctatgtgcatatcaagactctcactttttttaatgtctggaggctgggtcctgccatgagcatgctttaagtccaacactctggaggcagaggcaggtagatttctatgagcttgagcccagtctggtctgcatagtgaattcaagagtagctaggactatgtagagagagagggggagaccctgtctcaaaatagacaatttaattaattaaaaaaattgaaagggccaaggctggagagatggcacagtggttaacagcactggctataattccagagaacccagttcgattcccagcatccacgtgacaattcacaactgtgacttcagtcccaggagatctgacaccctcttctggcctccttgggcaccatgcgtgcaggtgacacacagaggtacattcaggtcaaatacccatatacatttttttttattttaaaaataaatgctgggctggtgagatggcttagtgggtaagagcacccgactgctcttccgaaggtccagagttcaaatcccagcaaccacatggtggctcacaaccatccgtaacgagatctgactccctcttctggtgtgtctgaagacagctacaatgtacttacatataataataaataaatatttaaaataaacaaataaatgtttacatttttttaaataaggaagaggaggcaaagggaaggaagggagaaaaggtatttctgtttatgtaacaatttactgctggcatttggggcatttgacgacttaacctccttccatttgtactcttgttattctgctagggtcagaacatgctctgctttctgccagcttgtaggagagaagagaaggatgcctgatggcttgtatgatccaaatctggaagaaggtgtagcacttgtacacacactctgtttaaccagaattcagtcctgtgttggcctcagcaccaaggatcctgggaaatgtagtttagatggaaaaaaacaagcaatcccaaccacagggagggaataccaaatggaagatttgctgtagaaaacaactgcagccgggcgtggtggcgcacgcctttaatcccagcactcgggaggcagaggcaggcagatttctgagttcgaggccagcctggtctacaaagtgagttccaggacagccagggctacacagagaaaccctgtcttgaaaaaccaaaaaaaaaaaaaaaaagaaagaaagaaagaaaacaactgaaagatgcaaagaagaaaaacttcaaaggtgacccagaacctagtatagtagcacctgtgatcccagcacttgggagactgaggcaagaagattgccctaaattagcgggcagcctggactacatagtaagttccaggctagcctgatctacacaacaagatcttgtttctcaaatcaaaccgaaacataacagaagaccagccaggagagaacgggtgacagtggctgggagaacaggaaacagcagtgggaaggacggtgggaagcacttccgggatccaaagcgaggcaagcaaggggctggggcgaaaaggcctgcgtgagggtcccttaacttctaagcctggtttgcctcaccttactccccagtgaaggggcacaggaagtgggggcggaggggctgggagaggctttggtaatcagtccccagaagactgtagcaagaatggtttccagtgaagaaatggagaccctgctggcccttggcaggagctcctgtctcaggatggtgaaagcttcctgggcctacctctctccctcatcttcttccctcctcccctccctccttcattttctttaaaaacagttttacaactatttatttatttaatgtttgatgctcttccagaggtcctgagttcaattcccaagaacccacatggtggttcacaactatccacaataggatctgagaacctcttctggcatgcagacacacatggagataaagcactcatatacataaaatacataaacacatcagtcttttttaaagatttatttatgtattttatgtatatgagtacactgtagctgtatggatggtagtgagccttcatgttgttgttgggaattgaatttaggacctctgctcactccagtcatctcctctcacttactccttgctcgttctggctcaaagattgatttattattatatataagtacactgtagctgacttcagatgcaccagaagagggcatcagatctcatggtggttgtgagccaccatgttgttgctgggatttgaactcagga

SEQ ID NO: 1172 - DNA, 1256 bp, Mus musculus
cttgccctggccctgtgccttaaccattaatctggtcccaactcctgctcctgcctgtccctctggagatggccttgcaccttctcctcctctttggggcatgctgggtccaggtggcgagcccagacagtctgcagaggacgacgatgctaccatctaccccacatatcacagctccaagtacctctgaagcccagaatgccagcccatcagtttctgtggggtcagggacagtggactcgaaggagaccatcagcccctgggggcagaccacaatcccagtttctttgacccccttggaaactactgaattgtcttctttggagacttctgctggtgccagcatgagcacccctgtacctgagcctactgcctctcaggaagtttccagcaagacatcagcactgcttccagaaccatcaaatgtagccagtgaccctcctgtcactgcagccaatcctgtgacagacggacctgcagccaatcctgtgacagacggaactgcagcatctacatctatctctaaaggaaccagtgcaccccccaccactgtgacaacaagctctaacgagaccagtggaccctctgtggctacaacagtaagctccaagaccagtggtccccctgtcaccacagctactgggtctctggggccctcgagtgagatgcatggactccctgctaccacagcaaccagttctgtggagagttccagtgtggcccgtggcacctcagtttccagcagaaaaacatccacgacgtctacccaagatcccataaccaccaggtcaccaagccaagaatcaagtggcatgttactggtgcccatgcttattgccttggtggtggttttggccctcgtggcgctactgctgttgtggcgccagaggcaaaagcggaggactggggccctgaccctgagcggaggaggaaaacgaaatggggtggtggatgcctgggctgggccagcccgggttcctgatgaagaggccacaaccacatcaggggcagggggcaacaagggctctgaggtactggagacagaaggctccgggcagagacccacgctcactacgttcttcagcagacggaagtctcgccagggctctttagtactagaagagctgaagcctgggtcgggtcccaacctgaagggggaggaagagccgcttgtgggcagtgaggatgaagctgtggaaaccccaacttctgacggtccacaagccaaagatgaggccgcacctcaatctctatga

SEQ ID NO: 1173 - protein, 410 aa, Mus musculus
PLIWSQLLLLPVPLEMALHLLLLFGACWVQVASPDSLQRTTMLPSTPHITAPSTSEAQNASPSVSVGSGTVDSKETISPWGQTTIPVSLTPLETTELSSLETSAGASMSTPVPEPTASQEVSSKTSALLPEPSNVASDPPVTAANPVTDGPAANPVTDGTAASTSISKGTSAPPTTVTTSSNETSGPSVATTVSSKTSGPPVTTATGSLGPSSEMHGLPATTATSSVESSSVARGTSVSSRKTSTTSTQDPITTRSPSQESSGMLLVPMLIALVVVLALVALLLLWRQRQKRRTGALTLSGGGKRNGVVDAWAGPARVPDEEATTTSGAGGNKGSEVLETEGSGQRPTLTTFFSRRKSRQGSLVLEELKPGSGPNLKGEEEPLVGSEDEAVETPTSDGPQAKDEAAPQSL

SEQ ID NO: 1174 - DNA, 22320 bp, Homo sapiens
agcctgggcgaaagagtgagaccctgtctcaaaacaaaacaacaacaataataaaactcatacataactacgtaaataaagttacaaaagcaactttagttcgttacaaaggacctgaagagagggatttaactgacctgcaaggtggaatggggctggagcagggccagtgggtcagacacctatgattatgccaggcaaaatggatacatgaagaaataaagttatagcatctccatgtagtaatagaaaaaaaaaaggaataacgaaattagcacactttttgggaatgtggacccaccagtagaattgagactagaaaaagttaaaagcattagaagtgttctctttctgagatcatgacttgttggggaaagggaagacttattgttcatgacaaacacttctgtgcttataacatgcattagcttaggaaacagcacttttctttttctctttttttttttttttttttttttttgagacaaggtcttgctctgtcgcccaggctggaatgcatgttgcgatctcggctcactgcaacctctgcctcctgggctcaagcgatccttccaccttggcctcccaaggcgctgggcgctgggattacaggcatgggccaccgtgcccggcctggtgcttttcagtgaataaataagtatgtaaacttctcttttctgactagacggaaattccccagaggacaagggtggcgtgacttgtcagtccttttcattgacagcgctgtggatgggaagaaagggcccctggtcccaagcaagccccagtcctgtggccctggaggatcagaagggtaattaagtgtcaaaggaaaacatagccagacatgagttactgtggtgaaaacagattttattcagtaactactcgtggtaggagaaagagctgagctccattctgatttgtgcagaggtgatttaggcatttaattagttaattagtttttgtgggacagggtctcgatctgttgcccaggcttgtgattgtgcctgttgctcagattgtgcagtggcacaatcatggctcactgcagcctcgaactcccaggctcaagtgatcctcctacctcagcctcctgagttagctgggacccacaggcgtatgccactgcacctggcttttttttttttttttttttttttttgaaacagagtctcgctctgttgcccaggctggaatgcagtggcatgatcttggctcactgcaaccaccacctcctgggttcaagcaattctcctgcctcggtctcctaagtagctgggattacaggcgcgtgccacaatacccagctagttttagtttgttttttatttatttattttttttagtagaaacgacgtttcaccatgttggccaggctggtctcgaactcctgacctcaggtgatccacccacctcggcctcccaaaatgctgggattacaggagtgagccaccgcaccagtgtctctctcttataacaccagctagtccttatcaggctttgactgtgggcccctcacctgtctaacttatccttcccaggaactttgaagaatactattattattcctattttgcaaatgaagaaactgaggcagattaaatgcctgacccaaggccatccagacggcaggcgatgcaggcaggagtcaagctcaggtacccctccccttctgtggcttccctgcctccaggcttctgccagcccctgtctaccttggtgtaggagcggcccctcaaagacctgcagggagccgggcacggtggcgcacgcctataatctcagcactttgggaggctgaggtgggcgtatcatgaaaccctgtctctactaaaaatacagaaattagccgggtgtagtggtgggcacctatgatcccagctactcagaaggctgaggcaggaggaacgcttgagaaccccagaggcggaggttgcagtgagccaagatcgagccactgcactccagcctggacgacagagcgagactccatctcaaaaaaaaaaaaaacctgtagagggaaggaggaactggggcctggggagggcagagctattatctcaggagaagcaggcaaacctctggtgacctctgatgacctcagggcaggatgggcaggccttcacaacagctccaggcacacccagcctcccgtccctggcctcatcactcccctctctgccctccaccctttggcctccttgcctttgtccacagttctgcagcctgataccctcttccttgtctcaaccagagaagtcttcagtcaataaacgtcatccaatgcctactgtgtgtcaagcacttcctgggtgctggggcactgtgcaagcacacacgcacagctgtgaggccatggggctggcattccagtgtggggagagcgacggaagcaaaataagaaagtccattacatggcgcatttgaaggcgcgaagtgctatggggagaaagcaaggaggggggttacagtccagagggaggggggtgcgattttttttttttttccagacggagtcttgctctgtcacccaggctggagtgcagtggcgtgatcttgcaaactccgccgcctgggttcacgccattcttctgcctcagcctcctgagtagctgggactgcaggcacccgccaccatgtccggctaattttttgtatttttagtatagacagggtttcaccgtgttagccaggatggtcttgatctcctgaccttgtgatccacctgcctcagcctcccaaagtgctgggattacaggcatgagccaccgcgcccacccgggggtgagattttaaatacaatggccagctgggctccgtggcacacacctgtaattccagcactttgggagaccgaggtgggaggctcacttgagtctaggagtttgaaacaagcctgggcaacaaagcaagatcccatctgtatgaaaaatttaaaaattaggccgggcatggtggctcatacctgtaatcccagcactttgggaggccgaggagggcagatcacttgagctcaggagtccgagaccagcctggccaacatggtgaaacactgtctctactaaaaatacaaaaaaattgctgggcgtggtggctcacgcttgtaatcccagcactttgggaggccgaggcaggtggatcacctgaggtcaggagttcaagaccagtctggccaacatggtgaaaccctgtctctactaaaaatagaaaattagatgggcttggtggtgggcacctgtattcccagctactcaggaggctgaggcaggagaatagcttaaatccaggaggcggaggttgccgtgagccgagatcgaaccattgtgctccagcctgggcaacgagagtgtgaaactccatctcaaaaataaaaataaaaatacaaaaaattagccgggcatggtggcgcgcacctgtaatcccagctactcgggagactgaggcgggagaattgctggaactcgggaggcggagttgcagtgaaccaagattgtgccactgcactccagcctgggagacagagcgagactccatctcaaaaaataaaaaattaaaattaaaagttagactggtgtggtggcatgtgcctgtagtcccagctacttgggaggccaaggcgggaggatctcttgagcccaggaggtcgaggctgcagtgagccatgattgtgccaatgcactcaagcctgggtgacagagtgagaccctgtgtctaaaacaaacaaataagtaagtaaataggttggccaggcaaagccatcctgagaaggtgacatttgagcaaagactgagaaagcagccaagcaacatctgggtggggagccctggggcagccaccacagatggcgcaaaggccctgggcttgctttctccagggacacatcagaggtccgggtggcaagggcgtggatggcagggccatgggtggaagggcagaagcaacgtggataagagaggtaggcaggggtcagatcggatgtggccaacttggcttctaccctgagtggggtgggagtggtctcagggctccaagcagaggaggggtggggtcagatgtttcatctgggtccctctggctgctgtgtggaaaacagcccggaggaggatgagatctcacacagggagaccagagctgagatgactgcaccagtccaggccagagaagacagaggctcaggccagtaggcagcagtgacggggcgaagagggatcagattctggatctttctctctctctctctctcttttttttttttttttttttttttttttttacagacaaggtatcactgtgttacccagggtggagtacagtggcgaaatcatagctcactgcagccttgaactcctgaactcaagcgatcccttctcctgagtctcccaaagtcctgggattacaggagtgagccactgtgcccagggcaggttatacattttttttgggaacaccacagaagccaagcacagtggctcatgcctgtaatcccaggacttctggaggcgaagatgagaggattgcttgagcccaggagttcaagaccagtctgggcaacacagcaagaacccatctctaaaaaaaaaggaatactgctgggcacggtggctcatgcctgtaattccagcactttgggaggctgaggtgggtggatcacctgagattaggagtacgagaccagcctggctaacatggcgaaaccccatccctaataaaaatacaaaaattagctgggcatggtggcagggacctgtaatcccagctattcaggaggctgaggcaggagaattgcttgaacccaggaggcggaggttgcagtgagccgagatcacatcactgcactccagccagggtgaccatgcccagccaactatgtaaatatcctatacacacacactcttctgatttcaccaatggttttaacactcactcttacctgaatccattattattatattggttatgtttatcattttttaaattctacattccttttacaattgttagctttcctacagtaaaataactttccagtggccgggcacagtggctcatgcctgtaatcccagcactttgggaggccgaggcaggtgaatcacgaggtcaggagttcgagatcagcctggccaacatggtgaaaccacatctctactaataatgcaaaaattagccaaacgtggtggtgcgcacctgtaatcctagctacctgggaggctgagggaggagagttgcttgaaactaagaggcggaggttgcagtgagccgagattgcatcactgcactccagcctgagcgacagagcaagactacatctcagaaaaaataaaacaaaaacaaaaaaaacttccatactgtcctacctcccttccctgctccctccctccttctctttgtctctaatattttcagaatcagtatgaactcattttcttttcttttttttttttttccaagacaaattctcactcttttgccgaggctggagtgcagtggtgtgatctcggctcattgcaacctctgcctcccaggttcaagcgattctcctggctcagcctcccgagtagctgggactaccggcgcccatcaccacacctggctaattttttggtaatttttagtagaaacggagtttcaccatgttggtcaggctggtctcgaactcctgacctcaggtgatcctcccgtctcggcctcccaaagtgctgggattacaggcatgagccactgcgcccagcctctttttttcttttaattaaaacaattaaatagagatggggttctctgtctgttgcccaggttggtcttcaactcctgggctcaagcaatcctcctgtctcgggctcccgaagtgctgggattacaggagtgagtcaccacgcccagcctaagtattgctcttctgtgatgatttgcaggcaacaatcacctcttgttcatattttcattatctttccctccaccccgagcctatagtctgtcttggtcagaccccatttcttgagtgcaccaggctggagtttggacccatccacatcctcgcagctctcctgagttggggcccaacatctggcttggggaacagacagctttgccgacagcagtaacaatttggttgaaatgataactttgtcaaaaatgaattttgccttagtgtttttttaaaggttgagaatcttgtacattcttacaacatttctattttctacagttaaaaaactgtaggctgggtgcagtgactcactcctgtaatcccagcactttgggaggccaaggtgggtggattgcttgagtccaagggttcgagaccagctaggcaacatagcaaaatattagctaggtgtggtagctactcgggaggttgaggcaggagaattgcttgaacccaggaggcagaggttgcagtgagccaagatcatgccactgcactccagcctgggcaagagagctagattgtctcaaaaaaaaaaaaaagtaagttccaattactttgcagccaattattcttgctcttctatttgcaatagcagaagattgaaatagcctcctagatgtctgacagtggaatgggttcttttctttttcttttttggtagagatgagggtctcactatgtggccaggcaagccttgaactcctggcctcaagtgatcctcccgcctctggaggcaggaggtagggtacagtcccagactcaaagcactgggattacaggagtgaaccactgcgtgagcctggtttcttttctttcccctccctcccttccttccttccttccttccatccgtccttccttccttccctccttctctcctctttcactctacctctttcttttcttcttttttctggcttgttaaaacagaaatacataataattatagtgaaataaactagggtatttactgcagcagttagtaataatgaaatgttggaaaacaatctaatgttcatccgtagggaatatttaaaatatagtgtatttctgccgggcgcggtggctcacgcctgtaatcccagcactttgggaggccgaggcaggtggatcatgaggtcaggagatcgagaccacggtgaaaccctgtctctactaaaaatacaaaaaagttagccgggcttcgtggcgggcgcctgtagtcccagctactcgggaggctgaggcaggagaatggcttgaacccgggaggcggagcttgcagtgagcagaaatcgcgccactgcactccagcctgggcgacactgtgagactccatctcaaaaaaataaattaattaaaaataaataaataaataaaatatagtgtatttctggccgggcgcggtggctcactcatgtaatcccggcactttgggatgctgaggctggcagatcacaagatcaggagatcaagaccatcctggctaacgcggtgaaaccctgtctctattaaaaatacagaaattagctgggcatagtggcatgtgcctgtagtcccagctacttgtgaggctgagacaggagaatcgcttgaacctgggaggtggaggttgcagtgagctgagatcgagacactacgctccagcctgggtgacagagcaagactccgtctcaaaaaaaaaaaaaattatagtgtatgccatggaatattatgcaactgttatatatgtgtgtgtgttcccaaagcattgttcagtaacaaaggaaaagtgcaaaacactaaaatggatgaatacatgcttgtgtaaacacagacactgtcaggaatgtttgtctggaggtgatgggtatggagcctttttgtctgatatattgggtgtatcaagaatgccaggtcctgagcagttttttttttttttttttgagttggagtctcactctgttgcccaggctggagtgcagtggcacaatctctgctcactgcaacctccacctcctgggttgaagcgattctcgtgcctcagcctcccgagtagctgggattgtaggcgcccgccaccatgcccagctaattttttgtgtttttagtagagacggggtttcaccatgttggccaagctggtctcgaactcctgacctcaggtgatctgcctgcctcggccttccaaagtgctgggcttacaggcatgggccaccgtgcccagccgtttatatgtattaactcttaatcatcaaaacaaactatgtggtattaccataattatcgccatttatacaaagcaacagagggataaggagattaaggcacttgcccaagtgcaagaggtaggacaggaacccagagtcccgtgctggtagctgcttttctgtgcacttaacattatctcatttaattcttgcagtcacttcatgaagaaggtggcggtcctagggcattggagaagttatgtgcttgttcaaggtcatgcagctggaagatggtggtggtaggacaggaagtctgtagggcctgattctgcagccctctagtctatactcctttgctcctgtgtccctcatcccccctgcagaatgggcaccccgttacctttctgagccactgtgcgcagaaaagagagcatgttggccaggctggtctcgaactcctgacctcaagtgatcagcctgccttagcctcccaaagtcctgggattacaggcgtgaaccaccacgctcagcctctgaatactttgtactcaagccatttttcagtgctgtgtttgcagtgagcacacccgagggatgaagacacgtctccctgtgggaacctgggcttaccagggcccctagaggaggggaatctctcaagctcagagctctatggctgcggtgcaggcccactgtgtgcatggtgtcagtctgggcccttccatgttgcccccgtgggacttggggtaaggggaactgatgcaaacatcacgctgctgttgcttggtgtgagcaattaattcctgtggctctcacccaggagtctcatgtctttgggtcagacaaactcatcagcttgtagaaatggcacagtcccacgggcctgttagaatcttctattgtgcacatgttgctcttaaaatatacaaatcagttttgattttaaaaaattatttatttttttagtgataggagttttgctacgttgcccaggctggtttcaaactcttgggctcaggaggtcctcccactttggcctggactgccagcataatgtatcaccacacccgggactgattttcgtttttcaagaacaaaaaccaaaaacatacacaaaccgagagtcaaagcttgctaattagaggaaagtcaggaaatgggaaccattcaaagaagaaaatacccccacctcctactctcacctatccaaagacaattaggtgaatcccttagtagatatctttccagacggttttccatatagattcccatatctggccaggcgcggtggctcacacctgtaatcctagcgcttggggaggctgaggcggatggaccacctgaggtcaggagttcgagaccagcctgaccaacatggagaaacctcgtctctacgaaaaatacaaaattagccgggcacagtggtgcaagcctgtaatcccagctactcaggaggccgaggcaggagaattgcttgaacctaggaggcagacattgtgctgagccgagccaagatcatgccattgcactaaactccgccttaaaaaaaaaaaaaaagattcccacatctttactagtttgcagaaataagatcctagcatatgcagtgtgtaggaaccaccttggtttagccacgtctctgtgactgggggccactgtggtgacccccagctccccggacagagtcaagagctcaccagcctgcaaaggttttcacggcccccagccagactcgggggcttcctcttgccctgctacttcctgggagctctgagggcaggaaatggcgccactcagctcctggcctaacagcttggggaccacaaatgcaaaggaaaccaccctcccctcccacctcctcctctgcacccttgagttctcaggctcacattcccaccacccacctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctcacacacacacacacacacacacacacacacgcgcgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaattttttttttaatttttaatttgtacagacagggtcttgctgtgttgcccaggctggtctcgaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgaggctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaaaaaaagaaaatataaaatatggtataagattaaatatattagttatgaaaataattgtaaatggcttattgaacttatagtcagtaaaaatcatgtttttgaaaattatgtaatgactttggaaaataccagcaatataatgttaagtggggaaaaaagcaagttactcctctgtaatacatatgattttagttttgtaataaaaattcccaaccatatatgcacttatagggaaacaaaggacccatcgcaaatgttttccatgctgatctccaaagtggtgagtttatgtgtgatttttattttgtttatgctcttctgtattttccgaatttcatacaataaatatctgttacttttacaatatgaaaaaatagtggtcaaaaaggtgttcaagggggtggcctgggggtgtctggtttgaggagagtggtaggggatgaggctgcaagtggaggttggagccatgctatgaaaagttcaagagtttgaattgagttctgaggtttgtttttgtttttgtttttgttttttgagacggagtctcaccctgtcacccaggctggagtgcagtggcacgggttcatgccattctcctgcctcagcctcctgagtagctggaaccacacgcgcccgccaccacaccaggctaatttttttgtatttttaggagagacagggtttcaccatgttagccaggatggtctcgatctcctgacctcgtgatccacctgcctcggcctcccaaagtgctgggattacaggcgtgagccacagtgctctgcgtgagccatagtgctctgctgagagtttgaattgcattctggaagtagtggtgaaatcaacacacctaagtctgctcttctcctctcttctagtccccagagtggtgagtagcatcgttctggtggcccaggcaaaacgccttaggaccaccgtgcagccccactctttccccattcctgctctccaggtgccaagtccctggctcttcttccaccgacccttgcatcccttccttctcttcagtcctcatcgcacctcaccgggatcctattgacacttcccctttgatttccttccgctctctgctagtgatggtcccagggacccttctaaaaggtcactgtgggctgggcacagtggctcacgcctgtaatcccaacactttgagaggctgaggtgggccaatcatctgaggtcaggagttcgagaccagcctggccaacatggtgaaaccccatctctactgaaagtacaaaaattagccgggcgtggtggtgtgcacctgtagtcccagctactcgggaggctgaggcgggggaattgttggtccccgggagatggaggttgcagtgagccaagatcgcgccgttgcactccagcctgggtgacagaatgagactccgtctcaaaaaaaaaaaaaaaagaaaaaagaaaaatagctgggcatcgtggcacacacctgtagttccagctactcaggaggatgaggtaggaagatcacttgagcccaagaggtccagactgcagcgagtcatgatcacaccactgcactccagcctgcgtggcaccctgtctcaaaatataataataataaaatttaaaaataaaataaaacgctgctctgtctaggtgatattcctctatccccaaggctgtcagggtggaaccctccttccttagcgtggcatataagcccctcgggacctggccctatctctcctctgaccacccctgcccggtcagcccttgttacagacagtctgtgctatccagccccatcaaattcctgttgctccctaaatatgccacacactttatttggaggagaggggtgaagaagggtagtttaacatgttcaaaatatttattttttccagacagtaaaataacattttttcctgttttgcaaaagttaattatcagcacattgaagattttccttttttttcttttctttttttttttttttttgagtcaaagtcttgctctgttccccaggctagagtgcagtagcgcgatctcggctccacctcccgggttcaagtgattatcctgtttcagcctcccgagtagctgggactacaagcacatgccaccatgcccagctaatttttgtatttttggtagagacggggtttcacaatgttggccaggctggtcttgaactcctgacctcaggtgattcacccgcctcaccctcccaaagtgttgggattacaggcatgagccactgcgcccggccagcagtcttaaataacagaattcacacacacacacacacacacacacacacacacacacacgcactgtattatatttcatcttatactttaaaatgtttccttttttttcctcaaaagtacacattaagatcatgtttacaaataaagccttgtcatccaaagtgaaaaatccagatggcaagatttggatggggaaggtcttgagaaatctgcgaatggagttcacttttgcagacaggaaatgggccctaatatatggttctaaggacattccatttctgaaaatgtacatttccacccgcttttcctctccttccttcctccctccctccctccctctctctctctctctctctctctttctttctttctgacaaggtcttcctctgtcgctgacgctggagtgcaatggtgcgatctcggcccattgcaacctccgcctcctgggctcaagtgatcctcccccctcagcctcccaagtagctgggaccacaggcacacgccacggcacccagctaatttttgtattttttgtacagatgggttctcaccatgttgcctaggctgatcttgaactgctgggctcaagtgatcctcccgcctcagcctctcaaaagtgctgggattacaggcgtgagccaccgcacctggcctgcatccccatttctgacccttgaccatgttcaagtgggaaggggaagccggggaagggaggacgggctacctgagggctgcgggtagaggtgactcctgtgagctgtgagccctcagcccttgggcagagggaacagaacagaaacagaccccatctctgagccaccaagctcagactcgtgtggcaggagacagatcacacaacactatcaacaaaacaacacaggtcgcagtggctcacacctgtaatcccagcactttgggaagctgaggtgagaggattgcttaaccgcaggagttcgagaccagtctggccaacatagcgagaccccatctctcaaaaaaagaaaaaaattagctgggcctggtgatgcacacctgtagtcccagctacttgggaggctgaggtgggaggacagcttgaaccagagaggtcgaggctgcagtgagctatgattgtgccactgccactgcactctagtctgagcaatagagtgagaccctgtcttccaaaaaaaaaaaaaaagagagagagagagagaagaatataatcaaaagtttctaaattcccaaagtagtaacaaaagcagacccaaacaaaagtagagagaaaatcttcgaaacttaaaaggctatttaggctaaggagcccacccagtggtgaccacctagttctgggaggtttggggcagggccattagacaatggaaactcaggttattttggagacaatcaacttgctcccaaaaatgagctgcaagcaggtgcctgtgtgctcagcccagtctggagctcagagcctgcctgccccactgcaccatcaccagcccagctgaaccagggtcccaggcaagccgtacaggctctgcgttggccttggagagaaccgccgactcccccgagttgcctgagctcggcctgaagccagccctccccacgctggctcacaataaatgccttgacttcccgccaactcttcctcaaccattaagattcagctcaactgtcacgggctctgtgcagctgccctcgctgccccaccccacgcagactttgtgttccttctccactcctgcagcaccccttgcgacagcatgaataacccggctgtagtgatgtgagggtgacactcatcaccagtgtgtgagcccctccaaggccacatgtcctctttgtgtttccagagcccagggcccagcatgcggtagctacctagtatatgtttactgaatggagggatgaataaattcatgcacaaagaatagttttatttatttatttatttttgagacagagtcttgcttctgacacccaggctgtagcgcagtggtgcgatcttggctcattgcaacctctgcctcccaggttcaagcaattctcctgtctcagcctcccaagtagctgggattacaggcatgcgcgccaccacgcccggctaattttctatttttagtagagacgaggtttcaacatgttggccaggctggtctcgaactcgcgacctcaggtgatctgcctgccttggtcttccaaagtgctgggattacaggtatgagccaccgcgcctggccttatttgtttattttcataaacaaatttctgttgcccaggctggtctcaaactcctggcctcaagtgatcctcctgcctcagcctcccaaactgttgggattacaggcacaagccacagtgcctggcccagttctgtcctttgagttgacctggtcatccaggaggatgttctgaggaagtgtgaaatgataatattattctagcccacgctggatacagtggcagtctggaaggtgaaagaggttgggtttgaaatagatttattggccaagtgcagtggctcacacctgtaatcccagcactttgggaggccgaggcaggagaa
